United States Patent 12,371,699 (NUCLEIC ACIDS ENCODING CRISPR-ASSOCIATED PROTEINS AND USES THEREOF) - sequence listing, part 7

SEQ ID NO: 5205 - RNA, 3654 nt, synthetic construct
  misc_feature 1..3654: note = Cas9 variant
  source 1..3654: mol_type = other RNA
atggaaaaacaaagaattctcggtctagatccaggaaccaactcattaggctgggcagtactggactttgacaactcaaaacaagaatacaacctagtgagaaaaggagaagtaattttcgaggaaggagtcggaaaatcagaaagaggagaattcagtaaagcagcttatagaacattttataaatcaacaaggaaacactacttcagaagaagactcagaaaaatagaagtgctaaaagtattagtaaaatatgacttttgtccctatctgtcagacgacctgttaaaacaatggcacgaaaaaaaaatttatcctgcagtaaaagaattcatggattggcaaagaacatcagacgctgaagggaaaaatccctattacgacagacattgctgcttaaacgaaaaattagatttaagtctcaaaagcgatcgatacgtattgggtagggccctatatcatttaacacaaagaaggggttttaaaagtaaccgcttaatacaaaacaacgatgaaaatgaagaaggcaaagtgaaaaaaggaatctccgaactcagtacagaaatgcaagaggctaattgcaactatttaggtgactatttttataagctatacacagagaaaggaaacactgtacaaatacgcaaaagatatactgacagagaaaagcactataaaaatgaattcaatgccatatgcgaaaaacaagaactaaacgaaacaatcgtcaaagaacttgacaaagccatattctttcaaagaaaattaaagccacaacgtcatggagtagggaagtgcacattcgaaccaaacaatcgacgttgcgcaattagtcacccggacttcgaacgctttcgaatgctttgcttcataaataatataaaaataaaaactccatttgaagaaaaccttagaccgttaaacaacgaggaaaaagcactgatcgaacctttattttatagaaaatcaatcaaaaacttcgactttgaagaaatagcaaagaaactcgctggaaaaaacaattattgctacataaaagacgacagttcaaaacaatacaaatttaattatagaatgagccaaggagcatcgacgtgccaaacaatagccaaacttaaaagcatctttggtgaagaatggaaaaacggtatagcagaaacgtatactaatcgaagaaagaaagaaggtttaaaaaaccaggcagaaatggtagacgacatatggaacgttctctactcggtatctgaatgcgatgtgctaaaagacttcgcaataaataaactacaattagacgaaaagacagcagataattttagcaaaacaaaattagcacagggattcgccacactaagcttaaaagcaatacgaaaaatactcccattcctagaacaaggttttggttatacagaagcagtttttttagctaacataccaacagtagtcgggaaagaatattggaacaacgaagacataagaaatgacataatggaagaaataaaaacgatcttttaccataacacactaaaaacgaacgacagccacaacacaatactattctgtatcaaagacattctaagtaacaacttcgacctagcccctggtgccatagacaaactatatcacccatctatgattaatgtatataaagacgtgatacccaatgaagacggtatcctacaactcggcagcccaaaaattgatgccgttaaaaaccccatggcgatgagatcactacacattatacggaaagttgtgaatgaactgctgcgtgaaggcataataaattccgacacagaagtaagaatagaatacgcaagagaattaaacgacgccaacaagagacatgctattgctgactggcaaaaaaaacagtatggaaaacaccaaaaatacagaaaagagataaaagaactattcaaagcagaaactggatttgaaatagaaccgaatgaaacagatatacttaaattcgaactctgggaagaacaaaatcatatatgtctatatacaggacaagaaataggcatttcggaattcgttggagaaaatccaaaatatgacattgaacacactataccaagaagtttaggaggcgattcaactaaaatgaatatgacgttgtgcgaaaacaaatttaaccgagagaataaacaaaaaaaattaccctctgaacttgcaaatcactcagagatactcgaaagaatagacgattggaaaaaaaaaatatatatcttacaaaaaaaatatgactctatcagaacacacaatggaatggacaaagaaaacaaagacaaaaaaatcgttagtaggcataaaattaaacttgaattagattattggaaaggaaagtataataggtttaccatgaccgaaataccagaaggattttcaagacgacaaggaatgggtattggtctaatcagccgatacgcaggactatacctaaaaactatctttcacaaaaaagacaatccacaaaagagcaacgtatacatagttaaaggatcaatcacagctgaattcagacgaatttggaacattcaagatgattacgaaaaaaaatgcagagataatcatatacaccactgcatagacgctatagtcgttggttgcataggtaaaagagaatatgatctaatggcacaattttacagagacgaagaaaaatatcgctgggaaaaaaaaaaaaagccattttttaaaaaaccctgggagacattcacacaagacatgttaagcctaaaggacgaggtcctcacagtccatttcaatcctagcaacttcactaagaaagcacacaaaaaagtattcacacctaaagggatatttgtagcccaaggcgactgtgcaagagtcaaactacataaaggaagttactttggggcaattgaacaaaaaggcgaaataaagtatgttatgagaaaaaaactatcagcactaaaaatagaagatatcgaacatattgtagacgcagtagtgaaagaaaaagtactagcagtggtaaaaaagaaaggatttaagcaagccatggccgaaccaatatacatgaatgaagacaaaagaatacttataaaaaaagtacgattgtttgtctctcaaacgaaccctctaatagtaaaaaaacacagagatctttcatcaaaagaatataaacaaaactattatgtagataatgaaggaaacctcatgattgcaatgtacgaaggagtcaaaaaaaacggaaaaatcgacagagaaataacagtagttaataatctagaagcagccaaattcttcaggcaatcgcagaaaaataacgcagaaaaacaactaatttcacacctgagtccaaaaaatggatacccactaaaaactgtcctcacacaaaaacaactagtactaatgtacgaagatagccccaaagagataaaactacgagacacaaagaatatggtaaaacgcctataccaagtattcggaattgaaaaagatggacgagtagagttaaaatttcaccaagaagccagatcagaaggtctgaacaagaacagtgcggcgttcaaaattcaagacacacccgaatccctatatcgacatacaaaatcaaatttgaaagttcttgttaacggcgtggacttcaaaattaatattttaggtgaaatatcattaatatga

SEQ ID NO: 5206 - RNA, 3654 nt, synthetic construct
  misc_feature 1..3654: note = Cas9 variant
  source 1..3654: mol_type = other RNA
atgaaatataactatgtactagggctggatataggaattagttcagttggatggggtttactagcactagatgaaaacaacaacccttacaaaataatcgacgtaggatccagaatattttccccaggagaagtggagaaaacaggagactcaaaagcaaaagaaagaagagagaaaagaggaacaagaagagtaatacgcagaagagagttcagactcgatagagtaagaaatctactctacgaaaaaggatatctaaaaggtaacataacaagtaacatcgtttcagtcaaaaacgaagaattaacaattatcttcaacgacatggtgaataattactacaaatccaaagatacaaatccgtataaacttaaagtagaagcgctggataggaaactaacaaatgatgaattatctataatattagtacattatgccaagaaaagagggtacaaaagcaatagagaagaaagtagtgacaatgacaacggtaaagtaaaagaagcaataaaagaaaacacaaatctaatggaagaaaagaaatacaggacaataagcgaaatgtacattaaaaacgaaaaatttaaaaataaaattaaaaatggaccagatgactacaagctatctgttacaaacgaaatgtatctagaagaaataaacaaagtattagacagccaaataggatttggactaattgacgacaactttaaaaacgaatatttagaaatctacaacagccgcagacactactccgaagggcccggatattattacgcgaaagacgcaaacggaaataaagttaaagtcagaagcccatacggtggtgacctaattaagaaaatgacgggagtatgctccttcgataagaaagccagagcgcccaaatatgcgttcagctcagaattattcgtatcaatctcaaagttagtaaatctgcgttacaaaatagatgacgacagctataaacaactcaccaaagaacaaattaacgaacttatcgacgaagctaaaaataaaaataaagttacttacaaatcactaataaaaatactaggaatcaaaaacattaaagtaaaagacctaaatctcagtaaatctgaatatataaaagttatagacgaactaaagaagaaactgaacatatcaaaagaagagaaaattgacatatactcactcgacgaagaaaacaagaaaatatatgacgatatatataatgaaaaacttttctcaaaaacacttatagaatttaaaggatacaatctactaaagaaagcaataacactaagctataacagcggcacttggaacgacgtaaaagacaatatagagttcctagatgaactggcactatactgtacagattataaagtaaacaatgaaattcaggaacatatacataactcactaatcatcgactccagattcgatgattcaaatttcgtcgaaaacctaccaaatttcaaagaccaccttatgctatcaacagatatcattagaaaactaatccccataatgttagaaggaataacatacgataaagcgatggacaaaatagggtacaaccatagcaacctctacaaagatacaataaaagaagatctgttagtgccagtatatgtttccaaaaatatcaccaatcaaagagtcatccgatcattaacccaagcacgaaaagtaataaatgcaataatcaagaaatacggtagccctaaaatcattaacatcgaaaccgcaagagaattagccaaaacacaaaaagaaaggcgtattatcgagaaaaatcaacaagacaaacaatacgaaaacgaacgaataaagaaacacttagtggaactagaattgttctcagacgaaagcaaaataacaggaaacgacttgctaaaatacaaactatggcaagaacaaaaagagttctgcggctacagtatgaagaaaatcaaactggaagacctattcagcaataacatagtacaaatagaccatatattaccatactcacgaacctataatgacaattacttaaacaaaacactggtatatactaaatacaaccaagacaaaggaaacaaaacaccatacgaatggttcggaaaaacagacaaatggcaagaatacgaagcgttcataaatagcctgtcgataagccaaaacaagaaagataactatctccttaaaaacctagatcaagacgctgaacgagaaatgagagagcaaaacctaaacgataccaaatatatatcaagggagctattatcgttaataaaagcatatcttaacgttgacgaagtaaatgcattccccggagcaatcaccgcaaaattaagagcacgatggggcttcaacagattaacccattcctatataagcaaaacctatatcatgcccgaagacatgaagaaaggaataaacaaagatagagacaaccacttacaccacgccatggatgcgctcgttatagcaagcatcacaaaatcactgcagcagaaaataaccctttacgaaaaattttccagatacgtagatggaataaccaaaaacgaactagggaaaatatccacgggaaacataaatgatgatctttacaactattacgatgaagaaactggagaaatcaaagaactagaactcagacaatacattaaaaaccaagttgcccaaaacaatatttacttttctaaacacaacgtatccaaactaatattcccaacaccatataacaactttgtcgaagaggcaaaacttagggtatatgaaagagatctcgaagtacttaaatggaatctgaaaaatctaggaacatacaccagcagcgaactaaacaggattcacgtattaataccaagtgttgctaaaaataaaataagtggacgattacacgaagaaacatactatggactcaaagaagtgggtatcggagaggataaagtaacttacaaaaccctcaaaacacctatcagtaaagtcaaaaagaaagatctcgataatatacccgactgcaaaggtggatcaaaagacatatataatgctttagtaaaatggtttggaaactgcgagactggagaagaagcactaaaaatgcacgatggtaaatatcctgtcaacccaaacgataaagaacaaaaagaaatcagaaaaattaaagtatacacaaaatacaacgcgaccgggcacgtagtaaacaatggtaacgttgaaaaaggaggaatatatagaatcgatgtattcaaaagcaaaaataaagaagacaataaactttacttcacatcatatgatatatttgaaatagaacaaatcaaggcttacgaaaaaggcaaaaatatcaactttagcataaaactagaatatggccaaggtaaaaataataaaatactactatacaaagacgtgaaaaacgaatacgacttaataatgagtatatacaaaaacgacctaataagaataaaaacaaaaacaggaaataaatccacagcctatgtagtaggcttctcaggaggtaaactggagataaaaagtacaattggagatgggtacgatataataggcaataataacatattcgacaaaagcatggagaggtatagagtaaccagtagcacgatagtaaaaatcgacaaattaagcataagcatactgggtgaagtaagcggtttatga

SEQ ID NO: 5207 - RNA, 3657 nt, synthetic construct
  misc_feature 1..3657: note = Cas9 variant
  source 1..3657: mol_type = other RNA
atgaacaaaagaatactaggattagatacagggacaaatagcctaggctgggcagtggtagattgggatgagcacgcgcaatcctacgaattaatcaaatacggagatgtcatctttcaggagggtgttaaaatagaaaaaggtatcgaatcttcaaaagccgcagaaagatctggatataaagctattaggaaacaatactttagaaggcgactgagaaaaatacaagtattaaaagtgcttgtaaaataccacctgtgtccatacctatcagacgacgatcttagacaatggcatttacagaaacagtacccaaaatcggatgaactaatgttatggcagagaacctcagatgaagaagggaaaaatccatattatgaccggcacagatgtttacacgaaaaactggacctcacagtagaggcagacagatacaccttaggtagagccctatatcatttaacacaaagaagaggattcctttctaacagattagacacatcggctgacaacaaagaagatggagttgtcaagtcaggaataagccaattatctacggaaatggaagaagcaggatgtgaatatctaggagattatttttataaactataccatgagcaaggtaataaagtaagaatacgacaaagatatacagacagaaagaaacactaccaacacgagtttgatgctatctgcgaaaagcaagaattatctagcgaattaatagaagacttacaaagagcaatcttcttccaactgcccttaaaatctcaacgacatggagttggaagatgtacattcgaacggggaaaaccacgctgtgctgatagccacccagactacgaagaatttagaatgctatgttttgtgaataatatacaagtaaaaggaccacatgacctcgaactccgcccacttacatacgaagaaagagaaaagatcgaacatctcttctttagaaaaagtaaaccaaattttgactttgaagacatagcaaaagaattagccggtaagaaaaactatgcctggatacacgataaagaggagcgcgcatataaatttaactaccgaatgacccaaggggtcccagggtgcccaaccaccgcacaactaaaaagtattttcggagacgattggaaaactggaatagcagaaacatatacactaattcaaaagaaaaacggaagtaaatcactccaagaaatggttgatgacgtatggaatgtactctattcattcagttcggttgaaaaactgaaagaatttgcacaccataaactacaacttgacgaagaaaatgctgagaaatttgcgaaaataaaattatcacacagcttcgcagcattaagtttaaaagctataagaaaattcctacccttcctaaggaaagggatgtactatacacacgccagcttctttgccaatatccccactatcgtcggtaaagaaatctggaacaatgaacaatctagaaaatatattatggaaaatgttggggagctagtgttcaactaccaacccaaacatagagacgtccagggaaccatcgaaatgttaataaaagatttcctagcaaataacttcgaactaccagcaggagcaacagacaagctataccacccatcaatgatcgaaacctatcctcacgcgctaaggaatgaatttgggatactccaactaggctcacctagaacaaatgccattcgtaacccaatggcaatgagatcattgcatgtgcttagaagagttgttaaccaactattaaaagaatccataattgacgaaaatactgaagtacacgtagaatatgcgagagaattaaatgacgcaaataaacgtagagccatagccgatagacaaaaagaacaagacaaacaacacaagaaatacggggacgaaatacgaaaattgtataaagaagaaaccggaaaagatatcgaaccgacacaaactgatgtactaaaattccaactatgggaagaacagaatcactattgcttatataccggcgaacaaatcggcatcactgattttataggatcaaacccaaaattcgatatagaacatacaataccacaatcagttggaggagacagtacccaaatgaacttaactttatgcgataatagatttaatagagaagtcaagaaagcaaaattaccaactgaactcgcaaatcacgaagagatattgacgaggatagaaccatggaaaaataaatacgaacaattagtaaaagaaagggacaaacaaagaacgttcgctggaatggataaagctgtaaaagacataagaatacaaaaacgacacaaattacaaatggaaatagactattggcgcggaaaatacgaaagattcacaatgacagaagtcccagaaggattttcaagaagacaaggaactggcattggattgatatctagatatgccggtctctatctcaaatcactatttcaccaggcagattcccgaaataaaagtaacgtctatgtagtcaagggggttgctaccgcagaatttagaaaaatgtggggcctacaatctgaatacgaaaagaaatgcagagacaatcactcacaccactgtatggatgctataaccatagcatgtattggaaaaagagagtacgacctaatggccgaatactatcacatggaggaaacattccgacaaggaagaggtagcaaaccaaaattctcaaagccatgggcaactttcacagaagatgtactaaatatctacaaaaatctattagtcgtccacgacacacctaataatatgcctaaacacactaagaaatatgtccaaacttcaaaaggaaaagtattggcacaaggagacacagcacgaggatcactacatttggatacctactacggagcaattgaacgagatggagaaatccgatatgtagtaagacgcccactgagtagctttacaaacccaaaagaattagaaaacatagtagacgaaaccgtaaaaagaaccatcaaagaggcaatcgcagacaaaaattttaagcaagcaatagccgaacctatctacatgaatgaagacaaaggcattctcattaagaaagtaagatgctttgcaaatagcgtgaaacagccaataaacataaggcaacacagagacttaagcaagaaagaatacaaacaacaatatcatgtaatgaatgaaaataactatttattagcgatatacgaaggattagttaaaaacaaagtagtaagagagtttgaaattgtatcttacatcgaggcagcaaaatattataaaagaagtcaagacagaaatatttttagttcaattgtacctacgcatagtacaaaatacggattacctttaaaaacaaaattactgatgggacaacaagtattaatgtttgaagaaaatccagacgaaatacaggtagataacacaaaagatctagtaaaacgtttatacaaagtggtgggaatcgaaaaagatggacgtataaaattcaaacaccaccaagaggctagaaaggaaggattgactatttacagtaccccatataaaaacaatgacgattatgtcccaatttttcgtcagtcaattaaaaacattaatatattagtcgatggaatagattttaatattgatatcctaggaaaagtaaccctaaaagaatga

SEQ ID NO: 5208 - RNA, 3657 nt, synthetic construct
  misc_feature 1..3657: note = Cas9 variant
  source 1..3657: mol_type = other RNA
atgaacaaaagaatattaggcttagacaccggaacaaattctctaggatgggcagtagtcgactgggatgaacatgcacaatcatatgaactaatcaaatatggagacgtcatattccaagaaggagtaaaaatagaaaaaggaatagaaagcagcaaagcagcagaacgatccggttacaaagcgataagaaaacaatactttagacggagattacgaaaaatccaagtactgaaagtattagtaaaatatcatttatgtccatatctctcagacgacgacttaagacaatggcacctccaaaaacaatatccaaaaagtgatgaactaatgctctggcaacgtacatcagacgaagaaggcaaaaatccatactacgacagacatagatgcttacacgaaaaactagacttaacggtagaagcagacagatatacactcggcagagccctctatcacctcacccagaggagaggattcctatcaaaccggttagacacatctgcagacaataaggaggacggtgtcgtaaaatcaggcatatcacaattatcgacggagatggaagaggcaggctgcgaatatctcggcgactacttttataaattgtatgacgcacaggggaataaagtcaggataagacaaagatatacggacagaaataaacattaccaacacgagtttgatgcaatatgcgaaaaacaggaactaagcagtgaactaatagaagacttacaaagagcaattttctttcaattacctcttaaatcgcaaagacatggagtaggtcgttgtactttcgaaagaggaaagcccagatgcgccgatagccacccagactatgaagaatttcgaatgctgtgtttcgtgaataatatacaagtaaaaggtccccacgacctagaactccgaccactaacgtatgaagagagagagaaaatagaacccttgttctttagaaaatctaagccaaatttcgattttgaagatatagcaaaagcactcgcaggcaaaaagaactatgcatggattcacgacaaagaagaaagggcctacaaatttaattatcgaatgacacaaggagtaccaggatgtcccactatagcacaactaaaatcaatatttggcgacgactggaaaacaggaattgcagaaacatataccttaatccaaaagaaaaatggcagcaaatctttacaggaaatggtagacgacgtatggaatgtcttatactcattttcatcagtagaaaaactcaaagagttcgcacaccacaaattgcaattagacgaagaatcagcggaaaaatttgccaaaataaaattatctcattcattcgcagctttgagcctaaaagcaatacgtaaattcctaccattcctacgtaaaggcatgtactacacccatgcatcattctttgcaaacatacctacaatagtaggcaaggaaatctggaataaagaacaaaatcgaaaatacatcatggaaaacgtgggtgagctagtatttaactatcaacccaaacacagagaagtacaaggaaccatagaaatgctaataaaagacttcctagccaataactttgaactacctgctggagcaactgacaaactctaccatcccagcatgattgaaacttatccaaatgcacaacgaaacgaatttggaatcctacaattaggttcgccgagaacaaacgcaatcagaaatccgatggcaatgcgaagtctacacatcttaagaagagtagttaatcaattattaaaagaatcaataatagatgaaaatacagaagttcacgtagaatacgctcgggagttaaacgatgcaaacaaaaggagagcaatagcagacagacaaaaggaacaagataaacaacacaagaaatatggtgatgaaataagaaaactttacaaagaggaaacaggaaaagacatagaacctacccagactgacgtccttaagtttcaactctgggaagaacaaaaccatcactgcttatatacgggcgaacaaatcggcataacagacttcataggatcaaaccctaaatttgatatagaacatacaatcccgcaatcagtaggaggtgactcaacacaaatgaacttaactctatgcgataacagatttaaccgagaagtaaagaaagcgaaattaccaacagaacttgcgaatcatgaagaaattctaactagaatagaaccatggaaaaacaaatatgaacagctagtgaaagagagagataaacaaagaacttttgcaggaatggataaagcagtaaaagacatcagaatacagaaacgacataaattgcaaatggaaatagattactggagaggaaaatatgaacgcttcacaatgacggaagtaccagaaggatttagtagaagacagggcactggcataggattaatatctcgatacgcaggtttatacctcaaatcattatttcaccaagcagatagtcgtaataaatcaaacgtatatgtagtaaaaggtgtagcaacagccgaatttcggaaaatgtggggattacaatcagaatacgaaaagaaatgtagagacaaccacagccatcattgcatggacgctataaccatagcttgtataggaaaaagagaatacgacctaatggctgaatactaccgaatggaagaaacattcaaacagggcagaggaagcaaacccaaatttagcaaaccgtgggccacttttacggaagacgtactcaacatctacaaaaatttactcgttgtacatgatactccaaataatatgcctaagcacacaaagaaatacgttcaaacctcaataggaaaggtactagcacaaggcgacaccgcccgaggatcgctacacttagatacatactatggagcaatcgaacgagacggagaaattagatatgtggtgaggagacctctttcatctttcactaaaccagaggaactagaaaacattgtcgacgaaactgtgaaaaggacaataaaagaagccatagcagacaaaaacttcaagcaagcaatagcagaacccatatatatgaacgaagaaaaaggaatacttattaagaaagttcgctgcttcgcaaaaagtgtgaaacaaccaatcaacataagacagcacagagatctaagcaagaaagaatacaaacaacaataccacgtaatgaacgagaataattatcttctcgcaatttacgaaggcctagttaaaaacaaagtagtaagagagttcgaaatagtatcatacatcgaagctgcaaaatactataaaagatcccaagataggaacatattcagttcaattgttcccactcatagcacaaaatatgggttaccactaaaaacaaaattactcatgggacaattagtactgatgttcgaagaaaatccggacgaaattcaggtagataacacaaaagacctcgtaaaaagattatataaagtagttggaatagaaaaggacgggagaatcaaattcaaatatcatcaagaagctagaaaagaaggactccccatttttagtacaccctacaagaacaacgatgattatgccccaatattcagacaaagtataaacaatattaatattctagtagatggaatagactttacaatagacatacttggtaaagtcacgttaaaagaatga

SEQ ID NO: 5209 - RNA, 3657 nt, synthetic construct
  misc_feature 1..3657: note = Cas9 variant
  source 1..3657: mol_type = other RNA
atgaataaaagaatactaggactagatacaggaaccaactcactaggctgggcagtagtcgattgggatgaacatgcccaatcctatgagttcataaaatacggagatgtcatattccaagaaggagtaaaaatagaaaaagggatagaatcctcaaaagcagccgaaagatcaggctacaaagccatacgaaaacagtattttagaagacgactaagaaaaatacaagtactaaaagtattagtcaaatatcatttatgcccatatcttagtgatgacgatttaaggcaatggcacctacaaaaacaatacccaaaatcagatgaactaatgctttggcaaagaacaagcgacaagaaaggtaaaaacccatactacgataggcatagatgtcttcacgaaaaacttgatctaacagtagaagccgacagatataccctaggtcgtgcattataccacctaacacagcgccgaggctttctatcaaacagattagatacctctgccgataacaaagaagacggagtagtaaaatcaggaataagtcaattaagtactgaaatggaagaggctggatgcgaatatctaggagactacttctataaactctatgacgagcaaggtaataaagtacgaataagacaaagatatacagatcgaaacaaacactaccaacatgaatttgacgccatatgtgagaagcaagaactcagttccgaattgatagaagacttgcaaagagcaatcttctttcaactcccactcaaatcccaaagacacggtgttgggagatgcacatttgaacgaggaaaaccgagatgcgctgattctcacccagattacgaagaatttaggatgttgtgttttgtaaataatatacaagtgaaaggcccacatgatctagaacttaggccattgacttatgaggaaagggagaaaatagaacccctgttctttagaaaaagcaagccgaactttgatttcgaagacatagcaaaggcactagccgggaagaaaaactatgcatggattcatgataaagaagaaagagcctataaattcaattatagaatgacgcaaggagtacctggatgtcctacaacagcacaactgaaatccatttttggagatgactggaaaaccggaatagcagaaacatatacgttaatacagaagaaaaacggatcaaaaagtttacaagaaatggaagatgatgtatggaatgttttatatagcttctcaagtgtagaaaaattaaaagaatttgcccatcacaaattacaattagatgaagaatcagccgaaaaatttgcgaaaattaaactcagtcatagttttgcagccctatcactgaaagcaataagaaaattcttgccctttctaaggaaaggaatgtactatactcacgcgagcttcttcgcaaacattccaacaatagtaggaaaagaaatatggaacaacgaacaaaaccgcaaatacataatggaaaatgttggagagctagtcttcaattaccaaccaaaacatagggaagttcaaggaacaatagaaatgttaatcaaagattttctggcaaacaacttcgaactgccagcaggagcaacagataaattataccacccatcaatgatagaaacctatccacatgcacaacgtaacgagttcgggatactacaactgggttcaccaagaacaaacgccataagaaatccaatggccatgagatcactgcacattttacgaagagtcgtcaatcaattactgaaagaatctataatagacgaaaatacagaagtacacgtagaatacgcaagagaacttaatgatgcaaacaaaagacgagcgattgcaggctggcagaaagaacaagacaaacaacataagaaatatgtggacgaaatacgtaaattatataaagaagaaacgggcaaagacattgaaccaacccaaacagatgttttaaaatttcaattatgggaagaacaagaccatcattgcttatatacaggagaacaaataggcattaccgacttcataggctcaaaccctaaattcgatatagaacatacaataccacaaagcgtaggtggagacagtacgcaaatgaatttaacattatgcgacaacagatttaacagagaaataaagaaagccaaactgcccgcgcagttaagcaaccacgaagaaatactagcccgaatcgaaccttggaaaaataaatatgaacagaaaataaaagaaagggacaaacaaagaaccttcgctggaatggacaaagcggtcaaagatctacgcatacaaaaacgtcacaaactgcaaatggacattgactactggagaggtaaatatgaaagatttaccatgactgaagtacccgaaggattctcaagaagacaagggacagggataggattaatatcgagatacgcaggtttatacttaaaaagcctattccatcaagcagattccagaaacaaatcaaatgtttatgtagttaaaggagtcgcaacagcggagttcaggaaaatgtggggattacaatcggaatacgaaaagaaatgcagagacaaccattcccaccactgcatggacgcaattacaattgcctgcataggtaaaagagaatatgatctaatggcagaatactatcgcatggaagaaacatttagacaaggcagaggtagtaaaccaaaatttagtaaaccctgggcaacattcacagaagatgtattaaacatatataaaaatttgttagtagtgcatgacactccaaataatatgcctaaacatacaaagaaatatgttcaaacctcaaaaggaaaagttctagcacaaggcgacacagctagaggttccttacatctcgatacatactacggagcaatagaaagggacggcgaaatacgatatgtcgttagaagaccattgtcatctttcacaaaaccaaaagaattagaaaatattgttgatgaaacggtaaaaagaacaataaaagaagcaatcgcagacaaaaattttaaacaagcaatcgccgaacctatttatatgaatgaagacaagggaatactaataaagaaagtacgatgcttcgctaaatccgtaaaacaaccaatcaatatacgacaacatcgagatttaagcaagaaagaatacaaacaacaatatcatgtcgttaacgaaaacaactacatgctagtcatctacgaaggtcttgttaaaaacaaagtagtacgagagtttgaaatagtctcatacatcgaagccgcaaaatattataaacgcagtcaagatcgaaacatattctcctccatcgttccaacacactcagcaaaatacggactcccactaaaaacaaagctgctaatggggcagcttgtactgatgttcgaagaaaacccagatgaaatacaagtcgataacactaaagatctagtaaagcgcttatacaaagtagtaggtataaagaaagatgggagagtgaaattcaaattccaccaagaagcaaggaaagacggactgttaatattctcaaccccttataaaaacaataacggatacgttccaatatttagacatagcaagaaaaacataaacatacttgtagacggaaaagacttcactatagatatacttggaaaagtaacattaaaagaatga

SEQ ID NO: 5210 - RNA, 3660 nt, synthetic construct
  misc_feature 1..3660: note = Cas9 variant
  source 1..3660: mol_type = other RNA
atgaaagaagaagtacgaggcaaaaaccggagccagacatgggcaattttagcaaaattctttgtgtggagtgaaaaagaaagtgtgtggaacgaaaaagaagcgagaactgaagaacgagtaaaagaatacaagctagtgggattaaaaagagatacaaaaggtaacgaattgaaactagaaaattatcgttggagagtacaagccctatcagaacaactaaatcccgaaatcgtagccatagtacttcaagaaataaatggacaaatatcagcatcatcagggtacctgggcgctatctctgaccgaagcaaacaactttattttaatagacaaacagtaggacaatacctaatgagtgaacttgagaaagaccctaacgtaagtttgaggaatcgagtcttttacagacaagattatttagacgagtttgacagaatatgggaaaaacaagcagaatttcatgaagaattaactgtagagcttaagaaagagataagagacattataatattttatcagcgtcgacttaaaagccaaaaaggattaatatcattttgtgagtttgaaaaacgcgaagtcgtggtagaagaagatggacgaaagaaaaataaaaccgtgggatgtcgcgtaataccaagaagccatcccctgttccaagagtttaaaatatggcaaacactaaacgacatagaggtatttgcgtgggataaacaatcaaaaagaaagaaagcagacaaaagttcaatattatttgacaattcagaagatgcactattagtagaaggaaaaagattcctatatcaagaagaaaaagaacttctagcaaaagagttatttgtaaaagaatctatgaagaaagctgaagtgctaaaactactttttgaaaactatcaagaactagacttgaactttaaacagatagacggaaaccacacaggttttgcactatttagtgcatattcaaaaatgatagaaaaatacggatacgaaccagtggactttaaaagatcagcagatgaaataatagaaaaacttgaaacaatcttcacaaacttaggttggaatacagaacttttatcaattgacctgagcaaagaagacaaagaacttgaaaggcagtcatacttcagattatggcatctattgtattcattcgaaggggataacaccccaaccgggaatggaaaactattagagaaaataatgcaactttgtgatgttgaaaaagaatatgcggtggaactcgctaatgtttcattccaggaagattatgggtccctctcagcgaaagcaataaagaaaatcctaccatacttaaaagaaggcaatcaatacgatgtagcgtgcgactacgcaggatatagacattcaagaagttcactaacaaaagacgaaatagaaaataaaatattaaaagataaactagaaatattaccgaaaaactcactcagaaacccagttgttgagaaaatattaaatcaaatggtaaacttgataaacacgttgattgatacatacggaaaacctgatgaaataagagttgaacttgcacgtgaactaaagaaaaatgctaaagaaagagaagaactaacaaaatcaatagccagaaatacacgcgaacacgacgaaataagacaactactaagaacagaatttggcatgatgaatgttagcaggaacgacatcatacgatacaaactttatgaagaactcaaagataatggatataaaacattatatagtaatgaatacataccaagagagaaaatattttcaaaagaaattgacatagaacatgttatcccccaggcccgattatttgacgactctttatcaaacaaaacactcgaatatcgtgcaataaacatagaaaaaggaaacaaaacagcatacgattttgtgaaagaaaaatatggcaatgatggcttagaaaaatttctgaacagatgtgaaacactattcaaagataaaagaactaaactcagaaaattaaaaatggaagaaaaagacatcccagaaggattcatcgacagagatctccgaaacacacagtatatatcaaagaaggcattcgcgatgctcaatgaaatcagccggagggtagtagcaacaacaggaagtattacagataaactaagagaagactggcagctagtggaccttatgaaagaattaaacttaccgaaatacgaaaaattagggatggtcgaaatgtttgaagataaagacggaagaaaaataaagaaaattacagattggacgaaaagaaacgatcatagacaccacgcagtcgacgcactaacggtagcctttaccaaagacgtatttattcaattttataataataaaaacgcagcatggatgccagcgtccaaagaacatgcaaacatcacaggtattaaggcccgatactttgagaacggtaaagctctagccccaatgccattagctcaattccgggcagaagctaaaagacacctagaaaatttattagtatctattaaagcgaaaaataaagttataacatcaaacgtaaacagaacgaaaaacaaaaatggcgagaaccgaaaattacaacaaacaccacgcggtcaattacatctcgaaactgtatatggaagtcacagacaatacgcaacaaaaatagaaaaggtaaatgcagcctttgatgttacgaaaatagctacagtgagcaaactagcctacagaaatgcactattaaaacgattagaagcatttggaaacgaccctaaaaaggcttttacaggcaaaaacacactagagaaaaacccattgtacttggacgaaaaccaaacagaaatggtacccgaaaaagtgcaaacggtagagttcgaaaccgtgtacacaataagaaaaccaatagaccctaacctgtcaatcgataaagtagtagatgtcaaaatacgtagcgttctagagaaaagactaaaagaatatggaggggacgccaagaaagcgttcgtaaatctagatgaaaacccgatatggttaaatgaagcgaaaggaattagcataaaacgagtttcaatacgaggcatttccaacgcccaatctttacatgaaaagaaagacaaagacggtaacctaatactagggaaagaaggaagaaagattccagtcgacttcgtcaacacgggaaacaaccatcatgttgctatatacaaaaagcccgtcttagacaaggtgggacaagtagtcttagacgaagaaggaaacccgaaatatgaactagacgaagtagttgtatctttcttcgacgcagtaacaagagccaacctgggccaaccaataatagataaggattaccgccgatcggaaggctggcaattcttattctcaatgaaacagaacgaatattttgtgttcccaaatgacaaaacaggatttaacccaaaagaagtagatctactgaatccagaaaactatgctctaatctcgccaaacttattcagagtacaaaaatttgcgtataaaaattacgtctttagacatcatcttgaaacgaccataaaagataccagctccactttgaaaggaataacctggaccgactttagatcgagtaaaggattagataaaatcgtaaaggtcagagtcgaccacataggacaaatagtatcaatcggtgaatactga

SEQ ID NO: 5211 - RNA, 3663 nt, synthetic construct
  misc_feature 1..3663: note = Cas9 variant
  source 1..3663: mol_type = other RNA
atgaaaagaatcctaggcctcgacttagggtctgcatcaattggatgggctctaattgaggaagatgaaaaaggtataagaatcatagccttaggatcacgaataataccttataacggaacagaaggccaagacttcgcaaaaggtgcgggtgaaagtagaaactcactgagaacccaagcaagaaccacaaggaaaggctacgatagatatcagttaagacgaaaatacctgataaatgttctagagaaaaatctaatgatgccgagcgaagacctaagaaaaatgcccaaaatgaacctatggcaactaaggtctaaagcagtcacagaatatatatctaggcaagaacttggaagactactattgtggttgaatcagaagagaggttataaaagttcacgttccgacgcaaaccttgacaagaaagatactgactacgtcaaagaagtaaaatcaagatttgataagataaaggagaaaaatcaaaccataggacaatatttttacgaaagtcttcaatgcgacgaatacttcagagtaaaggaaaacgtttttccaagagaagcatacatagcggaatttgatgcaatatgtagcagacaaaaagatcatctaggactaagtgaagaactcattgctgaaataaggaatgaaattatatactatcaaaggccattaaaaagccaaaaaggtctcgtatcagtgtatgatttcgaaggcaaatggatgaaccaaaatggaaaagaattattcataggaccaaaggtagcgcacaaatcatccccattatttcaactagctaaaatctgggaaagtgttaataatattaaattaagtacaaaatatggtgatacaatagagttaacactcgaagagaagaaacagctagtcgagttcctagataacaacgaaaaacttacaacggcagcactctttaaaatattgaggaaagataagaaagaatatatacttccaaaacaactggaaaaaggactacaaggaaacataacgaaatgtaaaatagctgatattctaggctcgaaatataatcaactattacaactaaatctagaaaaacaagaagtaggaaccccatgttacctatacacaaaatcaacaggagaggtattaggagaaaaacccttgcaatatatcgataaaagcgttgaaaaagagttattttaccagctatggcacaccatctatagcatatcagatgaagatgaatgctgtaaagccttacagaaaaggttcgacatagatgcagaaacagcaggcagactagccaaaattgacttctcaaaatatggcttcggcaataaaagcgcaaaagcaatccgaaaaatactaccatatcttatggaaggagacaaatacagtgatgcaatgtgttacgccggctataaccacagcaattcattaaccaaagaagaaaaccatgaacgaaaactaaacgataagctaaaattactaactaaaaactccttgagacaacccatagttgagaaaataatgaaccaaatgatacaattagtaaatacaataatagataaatacgggaagccagacgaaataagattagaactcgcacgagaactgaaacaatctaaagaagaaaggaacgatgcagacaaagctatgagcaaacggcaaagagaaaacaaagaggcagagaagaaactagaagaacatggtatacgtgccacacataacaatatattaaaatataggctatttgaagaaatgggggagaagaaacacgaagcaatatgtatttactgcggaaatcccattagtttttcagcagcaatgaacggtgacgaagtcgacgtagaacatataatcccaagatcaaaactttttgacgattctcagagtaacaaaacactagcccacagaaaatgtaatgcaaacaaaaacgatatgacagcttacgactttatgaaaaccaaatccaaacaagactttgacaaatatgtagaaagggttaatcaattatacgcggatagaatcatcagtcgtagtaaatacaacaaattacttatgagcgaagatgatataccaagtaatttcattgacagacaattaagagaatcacaatacatagcaacaaaagcccgagaaattttacaaacaatctgctacaacgtatggtcaacaagtggaacagttacggcagaactacgccacttatggggctgggatgatattacaatgaatttacaaatgccaaaatataaagaattaggactgacagaaatggtagaatggacttctgaccatggcaaaaatgtccactcaaaagaagtaatcaaaggatggaccaaacgggacgaccacagacaccacgctatagatgccctgaccatagcttgtaccaaacagggtttcatacaacgatttaatacattatcatcgtcaaaaacaagagatgacatgcaaaaagaactagaaaaatgttcaatacaattcagagaaaaacgatcgttacttgaaaaatacataatcagtcaaagaccaataagcgtatcagatgtagctgaagcagtatcacgcattctaattagcttcaaagcaggaaagaaagtagcaactataggaaaaagaaaagtcaaaggcaaagtagtacaacaaggaatagtagtaccaagaggagctctttctgaagggagcgtatacggaaagataagaactatagtaaggaaaatgccagtcaaatatttatttgaaaatccagacttaatatttaaaccatatataaaggctttagtcaaagaaagattagcagagttcgataatgacaacaagcaagctcttgcatcattaaagaaaaatcccgtataccttgacaaagagaaaacaaaacttctagaatacggaacttgcttcaaagatgaatacgttaaaaagtatgacgtcaaccctaacttcacaaaaatagctgatgtcatagacggaaaagtcaaacaaatactagaagatagattaagcaaattcggaggaaaacccaaagaagcattcaaggacgtagtaaaagacgggaaaacactgaagtggtatgaagacgaagggttagaaagaccgatcagaagtgtacgttgtttaacgggcctcagtgccgttgtaccagtaaagaaagatgaaaacggaatggacataggatttgtcaaaccaggcaataaccaccacgtagctatttacgtaggagcagacggaaaaggacaagaacatgtatgcacattttggaatgcagtcgaaagaaagaaatatggattacccatcatcataaaagatgccaatgaagtatgggataaaattacaatggccggtgatgatgtttatccacaatcattcttatctctattaccaaaaccagattggactttaaaactatcaatgcaacaaaacgaaatgttcatcttaggaatggaagaagatgaggtaaaatttgcgattgaatcgaaagattacaaattattatctgatcacctatacagagtccaaaaactatcatcaagtgactacaatttcatccaccaccttgaaacagacgtacaaaagaaaacaatgacgtatagagtaaggtcactatcaggcttattcgcgctaagaccatttaaagtgagaatcgactgcctaggaaacatcatcccaagctga

SEQ ID NO: 5212 - RNA, 3669 nt, synthetic construct
  misc_feature 1..3669: note = Cas9 variant
  source 1..3669: mol_type = other RNA
atgaagaaaagaatacttggtctagattcaggaacaaattcactaggttgggcagtcgtagaccgagatgagaacaatcaatacagcttaataaaatacggagatctaatatttgaagaaggagttaaaattgaaaaaggagtagaaagttctaaagcagcagaacgaacgagccaccgagccttgagaaaactatattttcgtagaagattaagaaaaatagaagtgctaaaagttctggtaaaatacaacctttgccctcaagtatcagaagaagaattacatttatggcacacaagaaaactatatccacaaaataaagaccttcttcaatggcaaagaactgacgaaaaagctggaaagaacccatatatatacagatatagatgcttacatgaagaattagatatgtcagtaagtgctaacagaatgacagttggcagagccatgtatcatctcgcacaacgaagaggatttctatcaaacagactagataacgaagaagacgaaaaccaaatcggagcagtaaaatgtggtatctcaaaccttaccgaagagatacaatcaagtggatgtaaatacttgggagaatatttttataaactctataatgaacatggaaacacggtgcgtctaagaacacgatatacttctagagagttccattataagaaagagttctatgcgatatgtgaaaaacaaaaattagataagaaattaatagaagaattagcaagtgccctttactttcaaagaccattaaaatcacaaagacacacggtaggacgatgcacttttgaaccaaacaaaccaagatgcgccgattcacaccccgcatatgaagaatttaggatgttatcattcataaatacaataaaagtacaaggaccttacgataccgaactaagagtactaaacacagaagaacgagactcaataactaaactattttgtagaaaaagcaaaccaaatttcgatttcgaagacattgccaaagaactcgcaggaagaaataattattgttatataggcgatgtcgtagacaaggcttacaaatttaactacaggatgtcacaaggagtcagcggatgccctactaccacttatctaataaacgtgttcggccaagactggcaaacaggaatagcagaatcttaccaagcaattgatactaaattaggccaaaaatctgtagatgccatgatcgatgatgtatggaacgtgctctatagtttcagttcgaaagacaaattaagagatttcggacgtaagaaattacagttaggagataaagaggcagacacgtttgcgaatataaaacttacacacaaatttgctagtctttcattgaaagcaatacgaaaaatcaatatcttcctaagaatgggcctagtatactcacatgctgtaacactagcaaatatcccgacaatagttggcactgatatatggcaaagaaaaaggaatttcatactagcagaattgcttccattaatagaaaatttcaatccaaaagaaacaaaactacaagaaacactggatttttgtgtaaaagattttctacaaaataactttgaactcaaaaacggtgctgtagacaaactatatcaccctagtatgatcgaggcatatccggatgcaggtttaaactcaaacggaatactccaactaggatctccaaggacaaatgcaattcgaaatcccatggcaatgcgaagtttacatgaaattagaaaagtaatcaatcaactactaaaagataaaataataaaccaagacactgaaatacacgtggaatatgcaagagaattaaatgatgcgaacaaaagaaaagcaataagcatatggcaaaaatcccaggaaaaactacataagaaatatgtagaagaaattacaaacttatacaaagaagagaccggtaaagctatagtgcccacggacacagatatcctcaaatttaaactctgggaggaacagaatcacatttgcttatatacaggacaacaaatcggcatagctgaatttttaggtgcgacaccgaaatacgacattgaacatacaatcccacagagcgtaggcggagattcgacagatatgaacctgacattatgcgatagtagattcaacagagaaattaagaaagctcaattgccgactcaactaggaaatcacgcagatatcctagtcaggatagcaggatggaaaaattcctatgaaaaactatctaaagacatagatagaataagaacacactcaggaatggctaaagatattaaagacaggctcatccaaaaacggcatcttttaaaacttgaaagagattactggagaggaaaatacgaacggttcacaatgaacgaaattcccgaaggattcagcagaagacaaggtgtgggcataggactcatatcaaagtacgcaggtctatatctaaaaagtctctttcacgataaaaatgaaaggaataaaggacacgtctttgttgtcaaaggtacaacgacagcggaatttcgtaaaatgtggggattacaaaacgaatacgagaaaaagtccagaaacaatcacgtacaccactgcatagatgcaatcacaattgcatgcatcggaaaacatgaatacgcccagatggcgcaatattaccacgatgaagcagaatacttataccaccatggaataaagccaatctttccgaaaccatggaaaacatttacagaagacttactggacctagaacatagcttatttgtggtacaccatagtcctaacaatatggctaaacaagcaagaaaaagaataataaccagcacaggacaacattgggcacaaggagactcagcacatggcagtctacacaacgatacttattatggtgcaatcgaacgcgatggagagataaaatacgtcgtaaggagagccgtaagctcatttgaacaaatgagtgacgtcgatagtatagtagatgacgtcgtaaaagaaacagtaagaaaagcactagaaggcaaaaactttaaagaagccgtgaatgcaccaatatatatgaataaggaaaaaggagtcctaataaagaaagtcagatgctatgcaaagagtattaaaaagcccatagacataagaactcacagagattcatcatcaaaagagtataagcgaaaattccatgtatcgaacgatataaactacctaatagcaatatacgaaggaacggttaaaggaaaagtaaaaagagactttgaagtcgtcaaaaacatagaagcggcaaacttctttaaaagatcacaagatagacgcgattacccgacaatagttccagaaaagagtataaaacacggattccctttaaaaacaacactaacaaatggaaccatggtgattttgtacgaagagaataaagaagagatagactttacaaagaaagaagacatatgtagaagactgtataaattagtaggaatgtcttcaatgatagttagtggatgtgaatatggagtactaagcctacgccaccaccaagaagcaagaccatcaaaagatataaaaagcaaaaacggagccttcaaaaatggcgaagccttacgaccggcgattactatgcttcacacacaattcaacgcgctagtcgaaaacattgactttaatatagatgtaacagggaacatagaattgatatga

SEQ ID NO: 5213 - RNA, 3669 nt, synthetic construct
  misc_feature 1..3669: note = Cas9 variant
  source 1..3669: mol_type = other RNA
atgaagaaacgaatactaggcctagactcaggaaccaactcattaggatgggctgttgtcgatagagatgaaaacaatcaatattctctaattaaatatggggacttaatattcgaagaaggagtcaaaatagaaaaaggagtagaaagctcaaaagcagcagaaagaacctcacatagagcattacgaaaactgtactttagaagaagactaagaaaaatagaagtgctcaaagtcttagtaaaatacaacttatgcccacaagtatccgaagaagaattacacttatggcacacacgaaaactatatccacaaaacaaagacctgctacaatggcaaaggacagacgaaaaagagggcaaaaatccatacatttaccgataccgctgcttacacgaagaactagacatgtctgtctcggccaacagaatgacggtcggaagggcaatgtaccatttggcacaacggagaggattcctcagcaatcgacttgacaatgaagaagatgaaaaccaaataggagcggtaaaatgtggtatctccaatcttaccgaagaaatccaatcgtcaggatgtaaatacctcggagaatacttttataaactttataatgaacacggaaatacagtgagactccgaacccgatatacgtccagggaatttcactataagaaagagttctatgcaatatgtgaaaaacaaaaattagataagaaactcatagaggaactagcaagtgccttatacttccaaagaccactcaaaagtcaacgacatacagttggtcgctgtacatttgagccaaataaaccaaggtgcgccgactcacatcctgcttacgaagagttccgtatgctctcgttcataaacactataaaagttcaaggaccgtatgatacagaattaagagtattgaatacagaagaacgagactctataacaaaattattctgtcgaaaatcaaaacctaacttcgactttgaagacatagccaaagaattagcaggtagaaataattattgttatataggagatgtagtagacaaagcgtataaattcaactatagaatgagccaaggagtatcaggatgcccaactactacatatcttatcaacgttttcgggcaagactggcagacaggcatagccgaatcatatcaagcgatagacacgaaactaggacaaaaatccgtggacgccatgattgatgatgtatggaatgtgttatattcctttagctctaaagataaattgagggacttcggtagaaagaaattacaactaggagacaaagaagcagatacttttgccaacataaaacttacacacaaattcgccagcttatctttaaaagcaataagaaaaatcaatatattcctaagaatggggctagtatacagccacgcagtaactttagcaaacattccaacaattgtaggaacagatatatggcaacggaaaagaaattttatattagcagaactattaccactaatagaaaactttaatcccaaagaaacaaaattacaagaaacgttagatttctgcgtcaaagactttttacagaataacttcgaacttaaaaacggagccgtagacaaattatatcatccaagcatgatagaagcatatccagatgcaggcttaaattctaatgggattctacaattaggtagcccacgtactaacgccattcgcaatccaatggcaatgagaagtctacacgaaataagaaaagtcataaaccagctattaaaagataaaataatcaaccaagacactgaaatacatgtcgaatatgccagagaattaaatgacgcaaataaaagaaaagccatctcaatatggcaaaaatcacaagagaaattacataagaaatacgtagaagaaataacaaatttatacaaagaagaaacaggaaaagccatagtacccaccgataccgatattttaaaattcaaattatgggaagaacaaaatcacatatgtctatatactggtcaacaaataggaatagcggaatttctaggagctactcccaaatacgatatagaacataccataccacaaagtgtcggaggcgattcaacagacatgaacttgaccctttgcgactcgagattcaatcgtgaaataaagaaagcacaactaccgacacaacttggaaaccacgcagacatcctcgtaagaatagcaggatggaaaaattcgtacgaaaaattaagtaaagatatagacaggataagaacacatagcggtatggctaaagatatcaaagacagactgattcagaaaaggcacttactcaaacttgaacgagattactggagaggaaaatatgagaggtttacgatgaatgaaatccccgagggtttttccagaaggcaaggggtgggcattggactcatttcaaaatatgctggtttatacttaaaaagcctatttcacgataaaaacgaacgaaataaaggacacgtcttcgtagtcaaaggaacaacaacagctgaatttagaaaaatgtggggactacaaaacgaatatgaaaagaaaagccgaaataaccacgttcaccactgcatcgatgccataacaatagcatgtatcggtaaacacgaatatgcacaaatggcacaatactaccatgacgaagccgaatacttatatcaccacggaatcaaaccaatattcccaaaaccatggaaaactttcaccgaagatctattagacttagaacacagcctctttgtcgtacaccactctcctaataatatggcgaaacaagcgaggaaaaggatcataacttctactggtcagcactgggctcaaggtgattcggcccatggctcgttacacaatgatacgtattatggcgcaatcgaacgggatggagaaataaaatatgtagtaaggagagcagtatccagtttcgaacaaatgtcagatgtagacagtatcgtcgacgatgtagtaaaagaaactgtaagaaaagcattagaaggcaaaaattttaaagaagcggtaaatgcaccaatatacatgaataaagaaaaaggagtacttatcaagaaagttagatgctatgccaaaagcataaagaaaccaatagatatacgcacgcacagagactcatcctcaaaagaatataaacgaaaatttcacgtctcaaacgatataaactatttaattgcaatttacgaaggaacagttaaaggcaaagtcaaaagagatttcgaagttgtgaaaaacatagaagcagctaacttctttaaaagatcacaagatagaagagactatcccaccatcgtaccggagaaaagcattaaacacggatttccattaaaaacaaccctgactaacggaacgatggtgatcctatatgaagaaaataaggaagagatagattttaccaagaaagaagacatatgccgacgactttacaagctagtaggcatgtcatccatgatagtcagcggatgcgaatacggagtgctaagccttagacaccaccaagaggcaagaccaagtaaagatataaaaagcaaaaatggagcattcaaaaatggagaagcgctacgaccagcaattacgatgctacatacacaattcaacgctttggtagaaaatattgattttaacatagatgtgacaggcaacatagagttaatatga

SEQ ID NO: 5214 - RNA, 3678 nt, synthetic construct
  misc_feature 1..3678: note = Cas9 variant
  source 1..3678: mol_type = other RNA
atgagcaaacgaatactcggaatcgacgttggaacaaactcacttggctgggcagtcgtagatagaacagactgtgataactacactctagtgaaaagaggtgatgtaatatttcaagaaggcgtaaacattgaaaaaggcaacatagaaaaatccagagctagcgaacgaactggtcatcgatcaacaaggaaacactatttccggcgtagaatgctaaaaatcaaagttctagaaattttagtagaacatcagctttgcccttatttatcacacgaggaactgcatcaatggatgacccgcaaagtatacccgactaatgaggacttcagactatggctaagaactaacgatgccaatgatcaaaatccatatcatgatagacatgtatgcctacacgaaagattggacctaagattacaagaaaataggtaccgattaggacgcgcactatatcatttagcacaaagaagaggctttttatctaatagactagaacaaaattcaaaaactgatgaaacaggagcagtcaaatcagatattagtcaacttaatgaagaaatgaagaaagcaggatcacaatacttaggtgactacttttattggctctatcaggaatacgggaatcaggtgactttacgaataagatacacagataggaaacaacactaccagaaagagtttgaagcgatttgtcagagacaacagttgagcgacgatcttgttgataaacttagacgagctatatactttcaaagatcccttaaatcacaaagagccggggttggaaaatgtacctttgaaccggataaaccacgatgcgctttaagtcatccaagatatgaagaatttagaatgttgagctttttaaataacgtgaaggttaaaggaccatcagatgattccttgagaccactttcaccaagtgaaaaagagaaaataaaacccctcttcttacgaaaaagtaaagccaatttcgactttgaagacatagctaaggcaattgccggaaaaggaaaatatgcttgtataagagacaaagaaggtgctcaaaagccgtaccaatttaactacgcgttatcacaaggagtaagtgggtgccctgtcactgccaaactaatcgccgtatttggtgaatcatgggaacgaaatttagtaaatgcgtatagatccaggaacgatatgcgcaaatctgatgaagaaatagtcaatgaagtttggaatgtactatatagcttctcgtcgaaagaaaagttaagagcatggggaatggaaaaactcggattagatgaagcctgcgcaggagagttcgctgatataacactaccaacagcatttgcagccttatcactcaaagcagttaataaaattctaccatttctacgacaaggattcatatactcgcatgcagtaatgttagcaaatataccatatataataggaatggatagatggaacgaaccgcgacaaagacagttcataatggataatttacaggaactattggacaacttcacggctagcgataaagcattacaacaaaccttggacttttgcataaaagactttttattaaacaattatgaacttgcacctgggaaagccgatagactataccacccttctatgattgaaacttatccagatgcaaaagcagacggtcaaggcatctaccaactaggaagccctgctacgaacgccataagaaatcctatggctatgagaagtctgcacatactacgaagagttgtaaatcaactattaaaagaaaagactattgatagtgaaacagaagtacatattgaatacgctagagaactaaacgatgcgaataggagatgggcaataaatcaatggcaaagaaaacaggaaacacaaagaaaagattatgcagaaaagattagaaaagtctacgcagatgagttcgaaaaagtaatagaaccaacacaagaagaactcttaaaataccaactctgggaggaacaacaacatttgtgtctatatacaggagaacagatcggattaacagacttcatcgggccaaatcccagatatgatatagaacataccatcccacaatctatgggcggagatagcacacgaatgaatttaacactgtgtgagagaacatacaatagaaccgtaaaaggaaaccgaatgccgtcgcaactcgcagaacacgagtcgatattaacacgaatcaaaccctggaaagacaaatacgaagaactaacagtcaaaataaataaattaagaacacatccaggcatggataaagcatcaaaagataatattataagaaaaagacatttattagaattagagagggattactggtttcaaaaatatcaaagattcacaatgaccgaagtacctgaaggtttctccctacgtcaaggcacaggaataggactgattggaaaatatgctggattgtttttaaaatctctattccatcatgttaaagaacgaaatcgaaaacaagtatatgttattaaaggtcctataacagcggagttcagaagattatggggattacaaaatctctatgaacagaaaagcagagacaatcatgctcaccattgtattgacgctatcgtaatcgcatgcataaacccagctgaatatgccagaatggcaagttattatcgacaagaagaagacttcagactaaacaaaggaaataaacccgtattcccaaaaccatggactacattcacacaagatttacaagctctcgaagccgaattgctagtagtacatgaaacgagaaataatctaactaagaaagcaagaaaacgggtccgaacgaaaggcggaaacgtactatcagaaagtgactcggcacgcgggtcactacataacgacacatattatggagccatacagaaagacggtgtaataagatacgtagtacgaaaagcattgtcatcattgtcagaaaaagacgtcaaagatatagtagacaaaacagtgagagaaaaagtacaggcggcgatacaagagaaaggagcaaaagaagcactagctggtaccatatatatgaatgaagaaaaaggaattaccataaagaaagttagatgtttcacaaaaatcgctagcccattggcgataagaagacaccgagatgcttctgccaaagaatacaaacgaccatattatgtaacaaacgaaagtaattatgtgatgggtatttatgagggatgcattaaagagaaaacaaaaagagagttcattctcgtgaataatctagaagcggtgagacaattaaaagctgcacgaaaacaaggcgttgtctcaagcattctgcccccagtttctgcaaaaagtcaatttcccttgaaatatagactttatacaggcacattggtactcttatatgaaaattcacccgaagaaatagattttactaatcaagttgacatatgcaaaagattatataaagttacaggattaagcagcatgaccgttacaggtaaccaatacggaacaatacaattacgatatcaccaagaagcacggcaagcaaaagacctaaaagcacaaaacggagcatacaaagaaggggaagaacatcgacccgcaattatgatgttacatacccaattcaaagccttagtagaaggaaccgatttccgaatgaatattcttggtgaaatcgaaccattaaggaaatga

SEQ ID NO: 5215 - RNA, 3690 nt, synthetic construct
  misc_feature 1..3690: note = Cas9 variant
  source 1..3690: mol_type = other RNA
atgggagaccgcaaatacaacttaggattagatatcggaacatcgtcaatcggattcgcagctgtagatgaaaacaaccaacccatacgagttaaaggaaaaacggctatcggtgtaaggctattcgaagaaggcaaaaccgcagcagatagacgcggattcagaacaaccagaagacgcctgtcaagacgaagatggcgaatcaaccttcttaatgaaatctttgatgctcacctggcagaagtggaccctacattcctagcaagactcaaagaatctaaccgtagtaatctcgatcctaagaaatcttttcaaggcagcctactattccctgaaaggaaagattaccaattttacgaagaatacccaaccatatatcacctacgaaaagcactaatggaaaaagatagaaaattcgacattagagaaatatatctagcagtacaccatataataaaataccgaggtaatttcctaaatgggactcccatgagatcatttaaagttgaaaacatagagctaaacacactatttgatcaacttaatcaactttacgcggaaatcgtacccgacaatgagttagcattcgatctagctcaagttgctgacgtaaaagacgttctaagttcaaccacaatctacaaaatggacaagaagaaacaacttgtaaaaatgatgctactacccgcttcaaacaaagccctacaatcagaaaacaaaaagattgtaacacaattcgtcaacgcaatactaaattacaaattcaaattagacgtattactccaagtagaaacagatgcagattggagtcttaaattaaacgacgaaggtgctgacgataaacttgaagaatttaccggagatctagacgaaaatcgattagagataattgacttattacaaagactacataactggttttcgctaaatgaaataaccaaagacggaaactcactaagtgccgcaatggtcgaaaagtacgaaaatcaccatcatcacttgggattacttaagaaagtaatagaaaaccatcctgatgcaaagaaagcaaaagctcttaaagaaacctatacagcctacgtaggaaaaacagacgataaaacgcaaaatcaagatgacttctacaaagcagtagagaaaaacttagatgacagtcctgacgcgaaaggaataaaaagactcatacaactagatcagttcatgcctaaacaaagaactggtcaaaatggagccattccccaccaacttcaccaacaagaattagatcaaataatcgaaaaacagtcaaaatactatccatttctcgcagaaccgaatccaaacgttaaaagaagaaaagacgccccatacaaactagatgaacttattgccttcaaaattccttattacgttggacctttagttacgcccgaagaacaagcccaaaataaagaaaatgtttttgcctggatgaaaagaaaagctgccggtccaattaccccatggaactttgacgaaaaagtagaccgaatggagagcgcaaaccgatttattcgaaggatgacaactaaagatacatacttattcggcgaagacgtcctgcccgctgaaagtatgatatatcaaaaatttgtagtgttaaatgaactaaacaatctaaaaatcaacgggcgacatctgtcattaaaagataaacaagatgtatataatgacctttttaaacaacagaaaacagtaagcatcaaagctctacaaaactactatgtaaccaaaaagaaagcagctacagcaccaacagtaggaggattagcagatcccaagaaattcttatcatcattaagtacatacatagactttaaaaacatgtttggcgaacgggtaaatgatccccaattccaagaagacctagaacaaattgtagaatggagtacaatattcgaagacagaggtatattcaaagcaaaactacaagccttaggttggttatctgaaaaacaaatacaacagctagtagccaaaagatacaaaggatggggtagactctctaagaaactattaacaggactgaaaaacgctgagggttatagcatcttggacgaaatgtggcgatccacagaaaatttcatgcaaatacaaagcagaccagagttcgcagccctgatacaacaagcaaacgaaaaacaatttgaaggaaatgatccagataacgtatgggaaaatatcgaaaatatattaggcgacgcatacacatcaccacaaaacaagaaagcgatacgccaagtggttaaagtagtacaagatatcgaaaaagcagtaggaaaccctcctgagaaaatagcgatagagttcacaagagaagctgcagcaaacccccaaagaacgcaatcacgtctccggaccttagaaaaactctatgaaagcgccgaagaagtcgtagacgccggcctaaccgcagaactagcagagttcaaagaaaacaaacacgtattatccgacaaatactacttatacttcacgcaactaggaagagatgtatacacaggagatacaatatcattagataaactaaacgactacgacgttgatcatatactccctcagagctttataaaagacgattctctagacaacagagtactaacgatacgagcagtaaataacggtaaaagtgataacgtacccgctaaaatgtttggcaagaaaatggggtccttttggagacacctcttggacaatggaatgataagtaaaaggaaatacaataatctcatcacagatcccgataacatatcaaaatatgcccaaaaaggtttcataaatagacaattagtagaaacgagtcaagttatcaaactcacagctaacatattaaacggaatctacgataaagacaccgaaatcatagaagtccctgcgaaaatgaatagtcaaatgagaaaaatgtttgacttagtcaaagtaagagaagtaaacgactaccaccatgcattcgacgcatacctaacaatatttataggcaattatttatacaaatgctatccaaaacttcgcccctactttgtatacgacaactttaagaaattcggcaataaagaagatatcggacataaaaggtttaactttctaggtaaaatagaaagggaaaagaaagtcgtagctccagaaactggcgaaatattgtggtcaaatgtagcaccaaatgaaaccatcaaacaaattaagaaagtctataactataaattcatgatcgtttcaagagaaatcacaacacgaagggcagaactatttaaccaaacagtctatccgaaaaactaccgtggaaaactcataccaatcaaagaagaccgtccgacagacctatatggaggatacagtggaaacaccgatgcttatctagccattgtagcattagaagataaaaagaaagggaaatatttcaaagtagttggtatcccaacacgagcagctgcaaaactggaaaaactaaaacaacaagactctcaacaatacctccaggccctccatgaagttatagcaccacaatttactaaatcaacgaagaaaggaatcaagaaaacagaatttgaaatcgtactagataaagtgcactatagacagcttgtccaagatggtccagttaaaatgatgctaggcagctcgacatacaaatacaatgcaaaacagctagtattatcagaaaaagcactgtga

SEQ ID NO: 5216 - RNA, 3696 nt, synthetic construct
  misc_feature 1..3696: note = Cas9 variant
  source 1..3696: mol_type = other RNA
atgataacgcgtattttaggtctcgacacaggaacaaactcactagcctgggctgtagtagatcgcgatgctaacggaaattacaccctcgtaaaaagaggtgacgtaatctttacagaaggggtaaaaatagagaaaggtatcgaaagtagtaaagcagctgagagaacagcacataaagcactaagagtccattattcacgcagaagattacacaaaatcgacactttaaaagtactcgtagaactcgacctatgtccatacttaagtaacgaacaactgaacctctggaaagcaaagaaaacatatccattaacagatgatttcatgttatggcaaagatcaggaagtgcggaagaaaataatccatattactgcagacacagatgcttaacccaaaaattagatttaacagatcaatcacaaagatttcttctagggcgagccttctatcacttagcacaaagacgaggattcctatcgaatagactcgatacgtcagcagactcagatgagtcaggcaaagtcaaaagtggaatagctgaattatcagtagagatggaaaaagcagggtgcgaatttttaggagaatacttttaccaactctacaaacaacatggaaacacaataaaactaagatcaaggtatacagatagagaggaacattacaagaaagagttcctggcaatatgtgaaaaacaggaattagatcccaaatgggttgaagccttacaacgtgcaatctatttccagagaccactaaaaagtcaacgaaaaggggttggcaaatgtactttcgaaccaaagaaacctaggtgcgcagaatcccatccagattatgaagcatttagaatgttgtgtttcttaaataatgtcaaaattcaaacaccaaacgatacttcccttagaccattgaacgaagatgaaagagagaaaatatggcccctctttttcagaaaaagcaaaccaaacttcgactttgaagatatagcaaaagcattggctggtaaaaacaattacgcatggtacaaagatgcaggcgaaaagccatttaaatttaactacagaatgcaacaaggagtatctggatgcccagtaaccgcgcaactaattgacatatttggaagtgattggcaaaccgcgatagccgaaacgtacacagcagtagaaaagaaaaacggcacaaaaacaattgatgaaatggccgatgatgtatggaacgtcctgtacagttttagtagtaaagataaattaaaagcattcgcaactgaaaaattacaacttgacgaagcatcagctacaaaattcgccaacgcaaaattaccacatggatttgcctccctaagcctaaaggctatcagaaatatattaccatttctaagacaaggcttcatttacgctcacgcagtacatttagcgaagataccagacatcgtcacaaaggcggtttggaacgacgcagacaaacgagaaatgatactatctgggttaatggaaattatagaaaactataatccaaaagaccgaggggtcgaaggaaccattgacttctgtatcaaatcccatctacaggacgttattgatttaagaccaggcgcagcagacgccctatatcatccctcaatgatcgaaacatacccagatgctaaattgaacaaaatgggagtcttccaactaggatcaccaagaacaaatgcgatacgtaacccaatggcaatgagatcattacacatactacggtcagtcgtcaatcagttactaagggatggtataatagatagaaacacagaagttcatgtagaatacgcaagagaattaaatgacgcaaacaaaagaaaagcaatagcagattaccaaagagaacaggaaaagaaaagaaaacaatacagagacgatataatcgctctatataaaagcgaatgtcataaagaaatagaaccaacagacaccgacatattaaaatttcaattatgggaagaacaagatcacctatgcctatacacgggtactcagataggaatatgcgactttttaggcgataatccaaaattcgatatcgagcacactgtaccaagatcagtaggtggagactccacacaaatgaatcttacactatgtgacgccacattcaatagacaagtcaaaggtgctcaactaccttcgcaactgagtaatcacgcagacatcctagtcagaattgatcactggaaaagtaaatgtgaagaccttagaaaacaattagataaaattagaacatatggaggcatggaaaaagcaatgaaagatagacttatacagaaaaggcatcgactaaaaatggacttagattactggcaaggaaaatactcaagatttactatgacagaagtaccagaaggattcagtagacgtcaaggggcaggtataggcctagtgtccaaatacgcaggactattccttaaaagtctgttccacaatgaacaaaacccgaataagagtaacgtatatgtcgtaaaaggagtaacaacagccgagttccgaagaatgtggggactacagggagaatatgaaaagaaatcacgcctaaaccactgccaccactgtatagacgccatcactatagcatgtataggaaaagctgaatacgataaaatggcacaatactatcatgacgaagaacttttccaatggaggggtaccaccactaaaccgcacttcaacaaaccatggccaacattcaccgaagacgtacttgctatcgaacaatccctattagttaagcacctaacgaaagataatatgccaaaacaagctaagaaaagagtacgtacagcaacgggaaaatacctcgctcaaggagacacagcacggggatctttgcataaagatacatactatggagccatagaacaagacggagaaattaggtatgtactgaggaaaccgttaaataaatttgaaaatgaagcagaattagagaaaatagtcgatcaagcggtaaaagagaaaatcaaagaagcaattgcaggtaaaaattttaaaaccgccataactgaacctatattcatgaacaaagaaaaaggaatacgcataaataaagtacggtactacgtcaaagcacaagaaagattaaagattaggcaacaacgagaccttagctctaaagaatataaacaatttttctgcgtagaaaatgaatcaaactatttgctcgcgatctatgaaggagaacttaagggaaagaaagaaagagacttttgtgtcgtcaataatttagaatcggcagcttgcctaaaacgatcaaataaagggaaagcagcacctctagtcccagaaagatcagaagaaagaaatcttccattattagcagtattgaaaagaggaacacaagttctattttatgaaaacagcccagaagaaatactattcgacaacccacaagacttggtgcgaagattatacaaagttacaggcataaatacaaagaaagacgtcaaaaatggtaaaacatacctatacggtaacattgaactacgcttccaccaaaatgcacaaaagaaagacgatgtaaaaatgcaatcaggagtatataaaaacaatgaagttcttcgccaaggaatcgttctaagtcacaaacagttcaaagccctagtagaaggggtagacttcgaatttaatgtgctaggagaaattaaaaagaaagaaagacacgcttga

SEQ ID NO: 5217 - RNA, 3699 nt, synthetic construct
  misc_feature 1..3699: note = Cas9 variant
  source 1..3699: mol_type = other RNA
atgactaaaacacgaatactaggactagatactggaacaaacagtctaggatgggcaatagttgaccgagacgaagtaagcggacaatatgaattagttgaccgtggagatctaatctttactgaaggagtgaaaatagagaaaggcatagaatcaagtaaagcatctgaacgaacgcaacacagagctttaagaaaacaatattttagaagacgactcagaaaaattgaagtactaagagttcttaccttttatcacctatgcccacccgttagtgaagaagaattacatctctggcacgtcaagaaaatatatccggtcgaaaaccacgagttcatgatctggcaaagaaccaatgacaatgaaggcaaaaacccatactactatcgacatatatgtctacacacaaaactaaatctaacactaatgaaagacagatatattctagggcgcgcactatatcacctatcgcaacgcagaggctttctgagtaatcgattagatcaatcacaagacgaagatgacaaaggaacagtcaaaaccggaataagctcattatcaaaagacatgaacgatgctggatgcacgtatttaggagactatttttacaaactatattcagaaaacggaaatagagtaagaatacgaaaccactacaccgccagaaacgaacactacttagctgaatttgaggcaatctgccaagttcaaaaattagaaccagaattagtagaagctctccggagagcaattttctttcaaagaccactaaaaagtcaacgcaaaggagtaggaaaatgtacatttgaaccacgaaaaccgagatgcgcagacagccacccagattacgaagaatttagaaaattatgtttcattaataacatcaaaatacaaacgagcgatgacgacacaatgagaccattaaacaaagaagaacgacaaagaatcaattctttattctacagagttagcaaagcaaatttttacttcgaagaaattgctaagttgctaggaggtcgaaacaactattgctattttaaagacgaagtacaaaaagactttaaattcaattaccgtatgtcgcaaagcgtgagtggatgtcctactacagcacaactaagaaacatattcggagaagactggaaaaccgggatcgcggaaacatatcagcattccgcaaagaaagatggatcattaaaaacagtggacgaaatggcagatgatatatggaacgtgttatatagcttctcgagtaaagactgcttatacaattttgcagtaaacaaactacaactagaagaggataaagctaagaaattttcaaaaattaaactctctcatggattcgctagcatatccctcaacgccattcataaaatactacctttccttcgaatgggaatgatatatagccacgccgtactattcgcaaacataccgacaatcgtaggaatggatgtctggaacgacgaatcaaaacgacaacacattatgacggaattaagcgatttagtattcaattatgatcccaaaaaccgagaagtcgaaggaacaatagaaatgtgtataaaagatttcctattaaataattatgacttaccagccggtgcagtgtgtaggctctatcatccttctatgatcgacacatacccagacgcaaaagcaaataaatacggagtactacaattaggttcaccagccacaaacgcaataaggaaccctatggctatgcgatctctacatgagctcagacatgttgtcaatttactactcagaaaagggaaaattgatcaaaatactgaagtacatgtggagtatgcgcgagaactaaatgatgcaaacaaacgaaaagccattgcagatagacaaagggagctagataaattacataagaaataccatgacgacataataacattatacaaagaagaaacaggaaaagatataaacccaacacaagcagatattttaaaattccagctatgggaagaacaagaacatgtatgtctatatacaggaaggcaaataggaataagtaaattcctcggacccgacccagagttcgatatcgaacatacagtgccaagatcagtaggcggtgactcaacccaaatgaacatgaccctctgcgacagacgttttaatagggatgtaaagaaagctatgctaccatctcaactgccaaattatcaagaaatactaccacgaattgaaaaatggaagaagaaatacgaaaaactaacaaaagatatagaccattgcattacccactcaggaatgacaaaagaagccaaagactcaattatccagaaaagacaccggctaacactagaacacgactattggcggaataaatactcgagatttacaatgacagaagtccctgaaggcttctctcgacgccaaggagcaggaataggattagtctcaaaatacgcaggcctattcctaaaaagtctgttccatgatcccacagatcgacgacgatcacatgtatatgtggtaaaaggaacaacaactgcagaatttaggaaaatgtggggattacaaagcgaatatgaaaagaaaagtcgagataaccatgtacatcactgcgtagatgcaatcactatcgcgtgtatagggaaaaacgagtacaacaagatggcttcattttatcatgacgaagaagcgtttgaaagaggagagtgtgaaaaaccacatttcgataaaccatggccaacattcacacaagatgtcttaggactagagaaaagacttatcgtagtacacagcacgcaagacaacatgcccaaacatgcgaagaaatatgtaagaactcctagaggaaaattcattgcaaaaggggattgtgctagaggctcattacatctcgacacatactatggagcaatcaaacataaagatgatacagaacccagatacgtattaagaagagaactttctagttttgacagcgtaaatgatctagatataatagttgacgacgcagtccgagagaaaattaaagaagcagtaaaaggtaaaagtggcaaagcctttaaagaggctttagctaatgtttatatgaacaaagaaaaagatatcagaataaagaaagttagatgttacgttccctcggtaaaaagaccgattgacatcagacatcaaagagatatgtcccgctttgactacaaaagacaattccacgtagctaacgacggtaactatatgatggctatatatgaaggggtcgtaaaaggaaaattaaaacgagactttgaactcgtgaaaaatatagaagcagcaagttacttcaaagtaagtcaagacaacgaaagtttttcctctattgtacccgaaaaatcatcaaatggcttccccttaaaagcagttctgaaaataggaacacacgtattattatatgaaaatacagcatccgaaatagacttctcagatccagttgacttaacaaggagactctataaagtcgtaggattaagctcagcaataataaataattgctcatatggatttattactttaagattccatcaagaagcccgacaagccaaaaatttaaaactgaccaaaggagtattcaaaaacgtcgataattacagaggagctattatcctatatcacacacaactgaaagcacttgtagaaggatacgactttgatataaacattttgggtgaaataacatcgaaacagtga

SEQ ID NO: 5218 - RNA, 3705 nt, synthetic construct
  misc_feature 1..3705: note = Cas9 variant
  source 1..3705: mol_type = other RNA
atgcccaacttctggtcgatattcaccgaaaatttacaaacatatctaatgaaaacgcggattctaggcctggacaccggtactaattctcttggatgggcagtcgtagaccgtgacgaaaacaaccaatacacaccaatatgtcgaggtgatttaatattcacggaaggcgtaaaacaagaaaaaggtatcgagttcagcctagcagcagaaaggacatcgtatagagcttcaagacgtcactacttcagacgaaggctaagaaaagtagaagtattaaaagttttagtcaaacataaactatgtccacccctttcagatgaggctttaaacagatggcataccaagaaagaataccccctagatgaagattttattctatggcaaagaaccaatgaagcagataacaaaaacccctaccacgaccgccatatatgcctacatagaaaactgaacttaaaagattcccaaaccgatcggtacacattaggccgtgcactataccacttaacacagcggagaggcttcttatcaaacagactagatcaaaatgaagaagccgaagaaacaggtaaagtaaaatccgcaatatcggaactaagcaaagaaatgaaagaagccggatgcgaatttctaggagattatttttatttattatataggacagaaggaaacagagtacgcatcagatctagatataccgacagagaaaaacattacctacaagaatttaaagaaatatgcagggtccaagaattagatgaagacctagcaaaggccctagagaaaacgatattcttccaacgcccacttaaatcacaacgacaaggagtaggaaaatgcactatggaaaaaggacattcgaggtgtgcagtgtcacacccactgtacgaagaatataggcttctctgctacttaaataatatacgaattaaaacaccctcagatgacagattaagacccctaaatgcagaagaaagagagaaaataacaccgctattctataaagagaaaaattttgattttgagaaaatagctaagaaactcgcaggaaaaacacctttcggttggatcagagacgccgaagattggccatatcaatttaactaccgaatgacccaagaagcaccagcgtgcccaacaacagctcaactaataaaagtattcggggaagactggaaagctgctctagctgaaacgtacacaatgtccgctaaacaggatggtacccttaaaacagaagacgaaatctgcactgacatctggaacgtattatacagcttttcatcaaaagaaaaacttaaagagttcgggttaaagaaattacaactagatgaagttcaggcaaaggctttttctgaaataagactgactcgagacttcgcaagcctgtcattaaaagccataaggaaaatactgttctttctccgaaccggcgaagactattccaaagcgatatttttagcaaatattcccacaatagtcggagaagaaatatggaatgacatagaaagaaggtcaagactcctctacaaagtagatctcgcacttcgacctcaggaagaacgagatgctgaggagcacaggaccatagcagaacggattaaagccgctgtagcagcagaagtccccgacgcccccatagacttgttataccatccctccatgatagaggcatatccagatgccaagcgaaacgaaaggtttgattgttaccaattaggaagtccaaaaacaaatgcagtgagaaatccaatggctatgcgaagtttacatatggtcagaaaagtaataaatcatttactaagaaaacatataatagatgagaaaacagaaatccacatcgaatatgcgagagaattaaatgacgccaacaaaagacaagcaatcgcagattggcaacgagaattaagcaaaagacacacagcatatgctcaaaatataagacaactatataaagctgaaactgggctagtaattgagccaacaaaggctgatatattaaaatatcaactttgggaagaacagcagcacgtctgtctgtatacaggaaagaaaatcggaatagccgactttttgggagccaatccaaaatttgacatagaacacacaataccgcgttctagaggaggcgactctactcaagaaaacttaacattatgtgaatcaaaatttaatcgagacataaaacgggataaattaccaacagagcttgccaactatgaagagatactcgccagaatagaacactggaagaaacaatgctatgcactcaaattaaaaagagatggcatacgaacacacagtggacttgagaaaagcataaaagacagtagaatacgacgtagacaccttgtaggattagaatatggatacctaaaaggtaaatacgatagatttaccatgaaagaagtaccagaaggattttcacgacgacaaggagccgggattggcctaatctctaaatacgcaggtctcttcctaaaaagcctattcaaggatcctaaaaacccaaaccgaagcaatgtctacgtagtaaaaggtgccataacagcagagttcagaaaactatggggtctccaacaagcagacgaagcaaaaagccgagaaaatcacacacaccactgtatcgatgcttacacaatagcatgtatagggccctgtgaatatgccgctctcgcagcctattataggagtgacgaagagttcaaatacggaagaagacgtgaaaaaccacaatttgaaaaaccttggccaactttcaccgaagacctcctaaaattacaagaagaattactaatagtacatcaaacaaccgataaattagggaagagagatcgaagaaaagtaaaaacgccccgaggaaaattcctaacaggaggtgacagcgcaaggggtcgcctacatcaagaaacatactatggtgcgataaactacgacggaaacattaaatacgtagtaagaaaaccgctagattccttaacagaaaaagacctagataaaatagtagacgaaacagtaatgggaattgttaaaggtgcagtagaagctaaaggatcacttaaagaagcactcgctgacggcatatatatgaataaagaaaaaggaatattaataaagagagtaagaattttctcagacgtctcggaaccaataaacctaaagcaattgcgagatgttagcacaaaagaatataaacgacatatacatctgagaaaagatgaaaactacctgtttgcaatctatgaaggaatagacaagaagaaaaataagaaacaaacagaaaccgccacagtggattacctagacgcagcaaaattttataaagatagcaaacgtagagacaaagcgaatagtttagtaggagattactcaaagaaaaataaattaccgttgaaatgtattttaaagaaacgacaaatggtgctcttttacgaacactctcccgaagaaattagattcaaagataagaaagatttgtcgcgaagactatacatagtaactagcatagccaaagacggtagagtcaaatttctccatcaccaagcagcgacagcgaccggtatccaatcatcgccatcaccgtttacaaacgacggcgaacatcaaccttattatcgacttagtgcatccaatataaaagtacttgtggctggaattgacttcgacataaacattctaggagaaataacacccaaattatga

SEQ ID NO: 5219 - RNA, 3711 nt, synthetic construct
  misc_feature 1..3711: note = Cas9 variant
  source 1..3711: mol_type = other RNA
atgtatttctacaaaaacaaagaaaataaattaaacaagaaagtcgtactgggtctagatctaggtatagcatcagtcggatggtgcttaactgacatatcacaaaaagaagataacaaatttcccataatattacatggagtgagactgtttgaaacagtagacgactccgacgacaaacttttaaacgaaacacgaagaaagaaaagaggccaaagacgccggaacagacgattatttacccgtaaaagggactttattaaatacctaatagataacaacataatagaactagaatttgataaaaatccaaaaatcctagtgagaaactttatagaaaaatacataaacccattcagcaaaaacctagaactaaaatacaaatcagtaaccaatctacctataggtttccacaacttacgtaaagcagcgatcaacgaaaaatacaaactagacaaaagtgaactcatagtactactatacttctacctatccctaagaggcgccttctttgataacccagaagacaccaaatcaaaagaaatgaacaaaaacgaaatagaaattttcgacaaaaacgaatcaatcaaaaacgcagagttcccaatcgacaaaatcatcgaattttacaaaatatcaggaaaaattagatcaacaatcaacttaaaattcggtcaccaagactacttaaaagaaatcaaacaagtcttcgaaaaacaaaacatagatttcatgaactacgaaaaattcgctatggaagaaaaatcattcttcagccggataagaaactattcagaaggcccgggcaacgaaaaatccttctccaaatacggactctatgctaacgaaaacggaaatccagaattaatcatcaacgaaaaaggacagaaaatatacacgaaaattttcaaaaccctttgggaatcaaaaatcggaaaatgctcatatgataagaaactctaccgagcacctaaaaactccttttcagccaaagtattcgacatcacaaacaaattaacagactggaaacacaaaaatgaatatatcagcgaacgcctgaaaagaaaaattcttctatcacgatttctaaacaaagattcaaaaagtgccgtcgagaaaatactaaaagaagagaacataaaattcgaaaatctaagcgaaatagcatacaacaaagacgataacaaaataaacctgccaatcataaatgcttatcatagcttaaccacaatcttcaagaaacacctcataaacttcgaaaattatttaatatcaaacgaaaacgacctatcaaaactcatgagtttctacaaacaacaatctgaaaaattattcgtccctaatgaaaaaggctcctacgagattaatcaaaataataatgttttgcatatattcgacgcaattagtaacatcctaaacaaattttcaacaatacaagaccgcattagaatactagaaggatacttcgaattttcgaacctcaagaaagacgtaaaaagcagcgaaatttactcagaaatcgccaaactccgcgaatttagcggcaccagctcccttagtttcggagcatattataaattcattccgaacctcatatcagaaggcagcaaaaattactcgacaatatcatatgaagaaaaagcattacaaaatcagaaaaataacttttcccattcaaatctcttcgaaaagacttgggtcgaagacctaatcgcctcacccacagtcaaaagatcgttacggcaaacaatgaatctattgaaagaaatatttaaatactcagagaaaaacaacctcgaaatagagaaaatagttgtagaagtcacccgatcatcaaataataaacatgaaaggaagaaaatagaaggtatcaacaaatatagaaaagaaaaatatgaagaactcaagaaagtatatgacctacccaatgaaaacacaacccttctaaagaaattatggctactcagacaacaacaaggctacgatgcatactcattaagaaaaatcgaagcaaatgacgtaataaataaaccatggaactatgacattgatcacatagttccaagatccatcagcttcgacgactccttctccaatctagtaatagtaaacaaacttgacaatgccaagaaatcaaacgacctctcagcaaaacaattcatcgaaaagatatatggaatagaaaaactaaaagaagctaaagaaaactggggaaactggtatctacgcaacgcaaacggaaaagcattcaatgacaaaggtaaatttatcaaattatataccatcgataacttagacgaatttgataacagcgactttattaatcgtaacttatccgacacctcatacataacaaacgccctcgtaaatcacctcaccttctcaaattcaaaatacaaatactccgtcgtttcggttaacggaaaacaaacatccaacttaagaaaccaaatcgcctttgtaggcatcaaaaacaacaaagaaaccgaaagagaatggaaaagaccggaaggatttaaatctattaattccaatgacttcttaataagagaagaaggcaaaaacgatgttaaagatgatgtgcttatcaaagaccgaagtttcaatggacaccatgcagaagatgcttactttatcaccatcatatcacaatattttcgaagtttcaaaagaatagaaagattaaatgtaaattacagaaaagaaactagagaattagacgatctagagaaaaacaacattaaatttaaggaaaaggcttcctttgacaacttcctactgatcaacgcgcttgacgaactcaatgagaaactcaatcaaatgagattctctagaatggtcataacaaagaaaaatacccaactattcaatgaaacattgtattcaggtaaatatgacaaagggaaaaacaccatcaagaaagtcgaaaaactcaacctactcgataatagaacagataaaatcaagaaaatagaagaatttttcgatgaagacaaactaaaagaaaacgaactaacaaaactacacattttcaatcacgacaaaaatctatacgaaactttaaaaataatatggaatgaagtgaaaatagaaatcaaaaataaaaatttaaatgaaaagaattatttcaaatactttgtcaataagaaacttcaagaaggaaagatctcgtttaacgaatgggtaccaattcttgataatgactttaaaataataagaaaaattagatacataaaattcagctctgaagaaaaagaaacggatgaaataatattctcccaaagtaacttcttaaaaatagaccaacgtcagaatttctcattccacaataccctctactgggtacaaatatgggtttacaaaaaccaaaaagatcaatactgcttcatctctatcgacgcaagaaactcaaagttcgagaaggatgaaataaaaattaattacgaaaaattaaagacacaaaaagaaaaattacaaatcatcaacgaagaaccgatactgaagataaataaaggcgaccttttcgaaaacgaagaaaaagaactattctacatagtaggacgggacgaaaaaccccaaaaattagaaattaaatacatactgggcaagaaaataaaggaccaaaaacaaatacaaaaacccgtcaagaaatatttcccaaattggaagaaagttaacttaacatatatgggagaaatttttaagaaatga

SEQ ID NO: 5220 - RNA, 3717 nt, synthetic construct
  misc_feature 1..3717: note = Cas9 variant
  source 1..3717: mol_type = other RNA
atgacgaaagtattaggacttgacctaggcgctgcttctgtcggatgggccatgatagaagaagaggaaaaatcacacaaaatactaggtctcggttcaagaataattccgtatgaaggaacagaaggaaacgacttcgccaaagggactggcgagagccgaaatgcacttagaacaaaagcacgcaccgctagaaaaggatacgatagataccaattaaggagaaaatatttagtggatacgttagtcaaaaacgaaatgatgccagatgaatacttaagaaaattacccaaaatgcagttatgggaactaagatctaaagctgttacaaccgaaataacaaaacaagagctcggaagactatttctatggctaaatcagaaaagaggttacaagtcaagccgatctgacgcaaacctcgacaagaaagacacagaatacgtcgtcgaagtcaaatcaaggcatgaaaaaataaaagaatctggctttacaatcggtcaatatttttattcagaattgaaaagtaatgaatacttcagagtaaaagaaaatatctttcctcgagaagcatacatagaagaattcgacgccatatgcaaacaacaaaaacgacaccttaccgacaaattaataagtagaatacgaaatgaaatcatctattaccaaagaccccttaagagtcaaaaaggattggtatccgtatgtcgatttgaaggtttctttaaaaaaggaataaatggaaaagaatacttcgttggaccaaaggtcgcaccaaaatcaagcccactatttcagaccgtaaaaatatgggaaaatattaactctatccgtctctctgaccgaaatgggaaggagattatgctatcactagaacaaaagaaatgtatcttcaaccatctagataacaatgaaaaactaacaccaaaagacttatttataatcataggagttaaaaaagagaattgcttcgtaaacaaacaactagaaaaaggaattcaaggcaatgttactaaaagcacgatactaaagtgttttggagaaaataacgactatgataaatggttaaaattagacctcaacattatcgtaaaaaaagacacttttggctatctttatgacaaaaaaactggggaaattataggcgaaaaactaataaaacacgtagactcggcagtagaaagagaaccattatatcaactatggcacacaatctactcaataaacaataccgacgaatgttccgctgcgctacaaaacaaattcggcttcgactcagaaacggccgacaaattatcaaacatcgatttcggcaaagcaggattcggaaataaatcagctaaggtaataagaaaaatacttccataccttatggaaggtgacgactactcacaatcaatgagctatgcaggtttcaaccactcagattcactaactaaagatgaaaacttaaaacgaaaattattagataaactaagaccaatcgaaaaaaattccctacgtcaacctatagtggaaaaaattttaaatcaaatggtgaatgtggtaaacgcaattatagataaatacggaaaaccagacgaaatacgaatcgaactagcaagagaactaaaacaaaacaaagaagaaaggaacaaaacagacaaagatatgtcaaaaagacaacgagaaaatggagaaatatcaaagaggttagcagaatatggccttcgcgccacacgtaacaacatcatcaaatggagattatatgaagaaatagacaatcaagataaaaaattaaacgctatttgtgtctattgtggacaacctataagtttaacagaagcaattaaaggcaacgaagttgacgtggaacatataatacctaaatcaaaactatttgacgatagccaaagcaacaaaacacttgcacaccggcgatgtaatagtacaaaaggagacatgacagcatacgattttatggaaaataaacccgcacaagtatttaacgcttacattgaaagggtaaacatgctatacgacaataaaataattagaaaagtcaagcgagacaagctacttatgccagagtccaaaattcctgataacttcatagatagacaacttagagaaagccaatatatcgcctcaaaagccagagaaatattacaaacaatctgttataatgtatggagcacatcaggaacagtgaccgcccgtctgagacacttatggggctgggacgacgcaacaatgtcactccaattaccaaaatatcgggaattaggtttaacagaaatggtagaatgggaaagtgaacatggcaaacagaaacatagcaaagaagtcatctccgactggtctaaaagagatgatcacaggcaccatgcagtagacgcactaacgatagcatgtaccaaacaaggctttatacaacgattcaacacgcttaacagttctaaaacgaaagaagacatggagtttgagatcgcaaagtgttcaatagaatatagagaaaacctatcaaaattagaaaaatacattatcgcattaagacctattccggtttcggaagttgaagacgcagttgctaacatactaataagttttaaatccggcaaaaaagttgccgttaaaggaaaaagaaaaataggaaaacgaggtaataagaaaataatacaaaccgacatcataattccacacggttcactatcggaggagagtgtgtatggaaaaataaaaacaatagaacgtgaaaaaccgctaaaatacctattccaaaatagtcaactaatattcaacaataaaattaaaattttagtagaagaaagactagcaacatttgaaaacgacacaaaaaaagcgctagcatccttaaaaaaagtaccagtttatctagacgaagaaaaaacaattgtactcgaatacgcgacctgttttaaagaggaatacgtaaaaaaatatgacgtagatacaaactttagtaaaacagataaggttatagacgacaaaatcaaagaaattctacaacaccgactaggaaaatttggtggtaaagcaaaagaaaaagaggcatttaaagacgttcaacaaggtgataaaacaataaaatggtacgaggacgaaggactagaaagaccaatacattctgtacggtgcttcacaggcctctctgccattgtaccagtaaaaaaagacgaaaacggcatcgatatcgggttcgtaaagccaggtaacaatcatcacattgcaatatattcagacaaagacgggaaccgctatgaacatatatgtacattctggcacgcagtcgaaagaaaaaaatacgacattccagtagttattaaagactcaaacgaaatatggaacaaaatctggtcaaaaccagaaggatcttacccgcaaagttttctagacaaattaccacaggaaaacctcactctggacctttcaatgcaacaaaacgaaatgttaatattagggatgagctatgaagacattaaaacggctatcgacaactcagactataaacaattaagctcaaatctatacagattacaaaaacttgcaaacgcaaactatatgttccgacatcaccttgagacacaaatcattgatgataataattcaaaagcaagcaggagatttataaacattcactcattaaaagcattattcgcttggaacccctacaaagttaacataaactgtctaggagacatacaaacaaactctagatga

SEQ ID NO: 5221 - RNA, 3720 nt, synthetic construct
  misc_feature 1..3720: note = Cas9 variant
  source 1..3720: mol_type = other RNA
atgacagaaaaacgaaaatttgatattagggaagtctacctcgcaatacatcatatcgtaaagtatagaggaaacttcctaaatagcgcaacagttgatagcttcaaaacatccaatatagactttacatcacaattcgacagattaaacgaactatacagacaagtcattttagaagaaccttttcaaataaacatgaatcaagtcgacaaaatgactaacaaattactagataatgacgcgttaaaactcgatacacaaaaacaagtagccaaactcctacctgtaatatacaatgacaaacccgtcgacaaacaatacacaaggttagctacagagttttccaaagccatacttggatacaaaacaaaactagatgttattttaaacttagacacccaaaatgcaaaagattgggcaatccgattagatgatgaagacatcgatgacaagttaccagccctagtagaaaatttagacgaatctagacaagagatagtcacaataattagagacctatacgcacaaataaccctgaatgctattgttccaaaaggcaaaagcttatcagagtcaatggtagacaagtataacgaccacaaagatcacctagatttattaatggggctcattcacgaactaggagatgattccgcaaaaggaatcaaactaagagaagcatatacacaatacgtaggaaaaagcggagataaaacattaaaccaagatgatttctacgccgccattaaaaaaaaccttgatgaagacagtaaaagatcaccaaaaatacaacgattaattgaacaagcaagttttatgcctaaacaacgaacctcagctaatggcgttataccacaccaactgcatcaattagaactcgacagaataattgaaaaccaaggccgatactatccatttctaaaagaacctaacagtaatacacataaaccaaacggaggtaaatataagctcgacgaactagtcgcattcaggattccatattacgtcggcccactaataacaaagcaagatcaagaaaaaacatctggagctgatttcgcctggatgataagaaaaccgggacaaggaggagagattacaccttggaatttcgatcaagaagtagacagaatggcctcagcaaacacttttataagaagaatgacgactaaagattcatatctagtagctgaagacgtactaccagattcatcgctcatatatgaaaaattcaaagtactaaacgaactcaatatgttaaaagtcaatgaccgaagattgtcaatatcacaaaaacaagacctattcaataatcttttcaaaaaacaaaagacaataagaactaaaaaattacaaacatatataagaactaaatgggaactaccatccgtaatgatatccggtctatcggatcccgacaaattcaattcttccttagcaacctacatcgactttcgagacgtctttggagaaaaagttgacgaccccaatcgtcaagcagactacgaaaaaataatagaatggtcgaccgtattcgaagacagaaaaatataccaagccaagctaaaccaactagactggttaaccgaaagccaaagcaaggcattattaacgaaacattataccggctggggaaggcttagcaaaaaactattaaccggacttaaagatcaaaacggagatagtatactagatcaactatggaaaaccaacgacaacttcatgcaaatacaatctagagatgaatttgcaaaacaaattcatgatgagaatgccaaacagtttcacgaagccaataacgtagatgacatcttagacgacgcctttacttcaccacaaaataaaaaagcaattagacaagtagataaagtcgtacaggacgtagtaaaggcagtaggatatgcacccgataaaatagccatagagtttacccgtagtccacaagatagaccacaaagaacattcagtagacaacgacaattacaaagcacctacctaaacgtcgcaaaagcattaatgaaatcaaatctaaaccaagaactcaagtcagtaatagattcacagcagactctaactgataaactatacctatactttacacaactcggtcaagacatgtatactggaaaagagataaatttcgatgaattagtaaattaccaaatagatcacattttacctcaagcattcataaaagatgattctttagataatagagtattagtttcagcccccataaataatgcaaaaagtgataatgtaccagttaaaaaatttggagccaaaatgggttacttctggaaacaactagcagagaaccatcttatctcaaaaagaaaactcaataatttaaccacagatccagacaagataggaaaattcaccgctcaaggatttatacaccgacaactagtggaaacgtcacaagtaataagactagttgcaaatattctcggaaatgaatatggacatgacggaacgacaataatcgaagttacagcaaaaatgaaccatcaaatgcgaaaagactttgacttgataaaaataagggatgtcaatgactatcatcacgccatggatgcttatttaacagcctacgtcggcgattacctctacctaagatatccgaaattaagaagctattttgtatatggagactttaaaaaactaaaagatcaaagtctaaaaatcagaaattttaactttttacacgatttaactaacgatgaagccggagataaaatagtagaccaagaaacaggtgaaattatatgggacaaacatgaatccgtaaaacaattaaaaaaagtatatcactacaagttcatgttagtgtctcaagaagtatatacccgacaagacgccctattcaatcaaacaatctatcccgcttcagacgctgataaaagaaaactcatcccgatcaagaacaacaaaccagtcgatgtatacggaggctattcaggtaatgtcgacgcttacatggccatcgtcagaatacatggaaagaaagaagataaatacaaagtagtaggagtaccaatgcgcgctgttgccgatttaaaaaaagccgaatcaaaaggacgagataactatctgaatgcagtacatgaagtcttaaaaccacagtttacaaaaaaaaaaaaagatcgaaaaacaggtgaaattactgaaatgatggacgacttcgacgttttattaggtaaagtatactatagacaactgattgtagatggaaacaaaaaatttatgctaggatcctcaacataccaatataacgcaaaacaattagttctatcagacaaagccatgcaagtcctaagtaaagacgataaattaaagaaccaagacgaaaatcaaaatttaatagacgtttatgatgaaatactagaaaaagtagaccaatattttgaattgtacgatataaacaagttcaggcaaaaactacacgacggccgaaaaaaatttatagaacttccagtagacaatgattttaacggaaagaaattaatctcatatggaaaacgagccaccattatttcaatactaaatggtctacacgcaaacgcgaccatgtcaaacttgaagtacctcggaatttcatcgcctttcggaatgctccaagtacctaacggtataatactttctccagcctcacgaatctgctaccaatccccaacaggactattcgagagaaaagtaaaactatcagatctatga

SEQ ID NO: 5222 - RNA, 3738 nt, synthetic construct
  misc_feature 1..3738: note = Cas9 variant
  source 1..3738: mol_type = other RNA
atgataatttacttcattttcgagaaaattgtaaatactattctagtaatgaagaaaatagtgggactagacctaggaaccaattcaataggctgggcattaataaatgcctacatagatgaatataacaaagaacacctatacggtatagaagcatgcggaagcagaattataccaatggacgccgcaatactaggaaactttgacaaaggaaactcaatatcacaaaccgcagaccgaacttcgtacaggggcatccgaagactacgagaaagacatttattaagaagagaacgactacatagaatactagacttacttggctttctcccaaaacactactctgactcccttaacaggtatggtaaattcctaaacgacatcgaatgcaaactcccctgggtaaaagacgaaacgggaagttacaaatttatctttcaagaatctttcaaagaaatgctagcagacttcaccgaacatcatcctaaattaatcgcaaacaacaagaaagttccatatgattggacaatatactaccttagaaagaaagcactaactcagaaaatatcaaaagaagaacttgcatggatacttttaaacttcaaccagaaaaggggctattatcaattaagaggcgaagaagaagaaacgccgaataaattggttgaatattactctctaaaagtcgaaaaagtcgaagatagtggagaaagaaaaggaaaagacacatggtataacgtccatttagaaaatggaatgatttatcggcgaaccagcaatattccgctcgattgggaagggaaaacaaaagagttcatcgttacaacagacctagaagcagacggcagtcctaagaaagataaagaaggaaatatcaaaagatcttttagggcaccaaaagatgacgactggaccttaatcaaaaagaaaacagaagccgacatagacaaaattaaaatgactgtaggcgcgtacatttatgacacattgctacaaaaacctgaccagaaaataagaggcaaattagtccgaaccatagaaagaaaatactacaaaaatgaactatatcaaatactaaaaacacaatcagagttccatgaagaactcagagataaacaattatacattgcatgtttaaacgaactctaccccaacaatgaaccacgccgcaacagtatctcaacgcgagatttctgtcatttattcattgaagacataatcttttaccaaagaccattaaaaagcaagaaaagcctaatagacaactgtccatacgaagaaaacagatatatagataaagaatcaggcgaaataaaacatgcctcaatcaaatgcatagcgaaaagccacccactatatcaagaatttagattatggcaattcatagtgaatctcagaatctacagaaaagaaacagatgtcgacgtcacacaagaactcttgccaacggaagcagattatgtaaccctctttgaatggctaaatgagaagaaagaaatagaccaaaaagcattctttaaatacccaccatttggattcaagaaaaccacatcaaattaccgctggaattacgtcgaagacaaaccatatccatgcaatgaaacccatgcacaaattataacaagactaggaaaagctcacatcccaaaagcatttctctcaaaagaaaaggaagaaacactatggcatatcctatacagcattgaagacaaacaagaaattgaaaaagcattacattcttttgctaataaaaacaacctatcagaagagttcatagaacaatttaaaaacttcccaccattcaagaaagaatacggctcttattcagctaaagccataaagaaattattgcccttaatgcgaatgggcaaatattggagtattgaaaacatagacaatggcacacgaattagaataaacaaaattatcgacggcgaatatgacgaaaatataagagagcgagtccgccaaaaagcaataaacctcaccgatataacccacttcagagctctaccactatggctagcttgttatctggtgtatgacagacattcagaagtaaaagatatcgtgaaatggaaaacacctaaagatatcgatttatacctaaaaagttttaaacaacactcacttcgcaacccaatagtagaacaagtcataacagaaacattaagaacggtccgagacatatggcaacaagtgggacatatcgacgaaatacacatagaactcggccgtgaaatgaaaaacccagctgacaaacgagctagaatgagtcaacaaatgatcaaaaacgaaaatacaaatctgcgaataaaagctctactcaccgagttccttaacccagagttcggcatagaaaacgtacgaccatactccccaagccaacaagatctacttcgtatatacgaggaaggagtacttaactcaattttagaactcccagaggatatcggtataatcttaggcaaattcaaccaaacagatactttgaaacgtccaactcgctctgaaattctcagatacaaactgtggctcgaacaaaaatatcgtagtccctacacaggagaaatgatacccctatctaaactatttaccccagcgtacgaaatagaacatattataccacaaagtagatatttcgatgactcactatcaaacaaagtcatttgtgaatcagaaataaacaaactaaaagatagatcactcggatacgagttcatcaaaaaccatcacggagaaaaagtcgaattagccttcgataaacccgtagaagtattatcagttgaagcatacgaaaaacttgtacatgaatcctattcacataaccgttccaaaatgaagaaactattaatggaagatatacccgaccaattcatagaacggcaacttaatgactcaagatatataagcaaagtcgtcaaatccttgctcagtaacatagtcagagaagaaaatgaacaagaggcaatctccaaaaatgtaataccctgtaccgggggaataacagatagactgaaaaaggactggggaatcaacgacgtttggaataaaatagttctccccagatttataaggttaaatgaattaactgaatcaactcgattcacaagcatcaacaccaataataccatgatcccaagcatgcctcttgaactacaaaaaggattcaacaagaaaagaatagatcatagacatcacgcaatggacgcaataataattgcctgcgcaaaccgaaatatcgtaaactatctaaacaacgtatccgcctccaaaaacactaaaattacaagaagagatctccaaactcttttatgtcataaagataaaacagacaacaatggcaactacaaatgggtcatagataaaccatgggagacctttacacaagacacactaactgcactacagaaaataacagttagttttaaacaaaatctacgagtcataaataaaacaaccaaccactatcaacactatgaaaacggaaagaaaattgtatcaaaccaatcaaaaggagattcttgggcaatccgaaaaagcatgcacaaagagaccgtacatggagaagttaatctaagaatgataaaaacagtctctttaaatgaagccctcaagaaacctcaagccatagttgaaatggacctcaaaaagaaaatactagctatgttagaactcggatacgataccaaaagaattaaaaattattttgaagaaaataaagacacctggcaatga

SEQ ID NO: 5223 - RNA, 3741 nt, synthetic construct
  misc_feature 1..3741: note = Cas9 variant
  source 1..3741: mol_type = other RNA
atgcgcctagtatatttggcgctcgcccacatgataaagtttagaggacactttctatatgaaggagacttaaaagcagaaaatacagacgtacaggctctattcaaggatttcgtggaggaatacgataaaacgatcgaagaatcacatttatcagaaatcaccgtagacgcactatccatcttaaccgagaaagtaagcaagtcctcaaggttagaaaatctaatagctcattatccgacagaaaaaaaaaacacattattcggaaatttaatagcattatcactcggtttacaagccaattttaaaactaacttccaattaagcgaagacgcaaaactacaattcagcaaagacacatacgaagaggacttagaaggtcttctgggtgaagtgggcgatgaatacgcagatttatttgtctccgcgaagaatctctacgatgcaatattattaagcggaatactgaccgtagacgacaatagtacaaaagctccattatcagcatcaatggtaaaaagatacaaagaacataaagaggaactagcagcttttaagcgattcataaaagaaaaattaccaaaaaaatacgaagaaatatttaaagacgacacaaaaaacggatacgcaggctacgtaggcgcagacaaaaaacttcgaaagagatcaggaaaactcgcaacggaagaagaattctacaaatatgtaaaaggaatactaaataaagtggagggcgctgattattttctagataaaatagacagagaagatttcctcaggaaacaacgaacatttgacaatgggagtataccccatcaaatccatctccaagaaatgcacgcgattctccgcaggcaaggcgaacactacccatttttaaaagaaaaccaagataaaattgaaaagatactaacattccgaattccatattacgttggaccgttagccagaaaaggctcgagatttgcatgggccgaatacaaagcagacgagaaaataacaccctggaacttcgatgacatcttagataaagagaagtcagcagaaaaattcataacgagaatgacattaaacgacctttaccttccagaagaaaaagtacttccaaaacacagtccactatacgaaacattcacagtatacaatgaactaacaaaagttaaatatgttaacgaacaaggggaggcaaaatttttcgatacaaatatgaaacaagaaatatttgatcatgtatttaaagaaaatagaaaagttacaaaggacaaattacttaactacttaaacaaagaatttgaagaattcagaatcgtaaacttaacaggattagacaaagaaaataaagcattcaacgcgtctcttggaacttaccatgacttaagaaaaatcctcgacaaatcattcctagatgacaaagtcaacgaaaaaataatagaagatataatccaaaccctaacactattcgaagatagagaaatgattcgccaacgcctacaaaaatactctgacatcttcaccacacaacaactgaaagaactagagaggagacattacacaggatggggtagattgtcctataaattgataaacggaataagaaataaagaaaataaaaaaaccatcttagactatttaatcgatgacggatacgcaaacagaaattttatgcagttaatcaacgacgatgccttatcatttaaagaagaaatcgcacgcgcacaaataataggtgacgttgacgacatagccaatgtcgtacatgatctacccggctcaccagccataaagaaagggatactccagtccgtcaaaatagtcgacgaactagttaaagttatgggacacaacccaacaaacattataatagaaatggctcgcgaaaatcaaactactgataaaggacgaagaaactcacaacaaagactaaaattactccaagattcattaaaaaatctagacaatccagtaaacatcaaaaacgttgaaaaccaacaattacagaatgacagattattcttatattacatccaaaatgggaaagacatgtacacaggagaaacactagatataaataatttatcacaatatgacatagaccatataataccccaagctttcataaaagacaattctctagataatagagtcttaacaagatcagacaaaaaccgcggaaaatccgacgatgtaccatcaatcgaagttgtacatgaaatgaagagtttctggagcaaattactctccgtaaaattaatcacccaaagaaaattcgacaatctaacaaaagctgaaagaggaggacttacagaaaatgataaagcgggctttatcaaacggcaattagttgaaacgagacaaattacaaaacacgtcgcacaagtcctagatgcaagattcaatgcgaaacacgacgaaaacaaaaaagtaatacgagatgtcaaaataatcacattaaaatcaaacctagtaagtcaattcaggaaagatttcaagttctacaaagtacgtgaaatcaacgactaccaccatgcacatgatgcctatcttaacgcggtcatcggcactgcgctcctaaaaaagtacccgaaacttgcaagtgaattcgtgtatggagaattcaaaaaatacgacgtaagaaagtttatcgcaaaatcagacaaagaaatcgggaaagcaacagcaaaatacttcttttattccaatcttatgaactttttcaaaaaagaggtaaaatttgccgatggaacagttgtggaaaggcccgacatagaaacatctgaagacggagaaatagcatggaacaaacaaacagattttaaaatcgtaagaaaagtattatcatatccccaagtaaatatagtcaaaaaaacagaagtccaaactcacggcttagataggggaaagccaagggggctctttaacgcgaaccccagtccgaaacctaaacctgatagctctgaaaacttagtaggaataaaacgtaacttagatccaaaaaaatacggaggttatgcaggcatttcaaactcatatgcggtattggtcaaagctataatcgaaaaaggcgtaaaaaaaaaagaaaccatggttttagaattccaaggcatctcaatcttagacagaataacatttgaaaaagataaacgagcatttttacttggaaaaggctataaagacataaagaaaatcatagaactgccaaaatatagcctattcgaactaaaagacggcagcagacggatgctagcttcaatccttagtacaaataataagagaggagaaatacacaaaggaaacgaactatttgttcctcaaaaattcaccacgctactataccatgcaaaacgcataaataaccctataaacaaagaccacatagaatacgtaaaaaagcatagagacgattttaaagaattgctcaactacgttttagaattcaacgagaagtacgtcggcgcaacaaaaaacggtgaaagactaaaggaagctgtcgcggacttcgattcaaaaagtaacgaagaaatatgcacctcatttttaggcgcagtcaatagcaaaaatgcaggactattcgaacttacatcattaggatccgcttcagacttcgaattcctcggagtaaaaataccgcgttatcgagactacaccccaagttcactgctaaaagatagcatactaattcatcaatcaatcacaggattatatgagacaagaatagacctctcaaaactaggagaagactga

SEQ ID NO: 5224 - RNA, 3747 nt, synthetic construct
  misc_feature 1..3747: note = Cas9 variant
  source 1..3747: mol_type = other RNA
atgaagaaaatcctaggcctagacctaggtagtgccagtattggatgggcagtgataacagagaatgtggaaaacggcataacaaaatgcgacatcttaggcatgggcagtcgaatcatcccatatgagggaactgaaggaaaagattttaccaaaggtacaggcgaatctcgtaatagccttcggacaaaagccaaaaccgcaagaaaaggctatgatcgataccaactaagaagaaaatatttagtagatacactaataaaaaaccaaatgtacccagacgaagcaacccgcaacctcccaaaaatgaaattatgggaattaagagataaggccgtccactctccagtctcgttaatggaattaggaagattactactctggttaaaccaaaaacgaggttataaatcaagccgatcagacgcaaatctagggaaaaaggatacagaatatgtagccaccgtaaaatcacgacatgaaaaaatgaaagagctagacgtgaccatcggacaatacttttatcgagaactatcagcaaacgaattttttaaagtaaaagaaaatatattccctagggaagcttacatagaagaatttgatgccatctgtaaaacacaacaaatagctcatccaatgatcctacgatcagagttaattgacaaaattagaaacgaagttatatattaccaacgacccttaaaatcacaaaaaggactagtatcagtttgcgaattcgaaggcttttggcgaataggaaaggacggaaaggaatacttcgtaggtcccaaagtggcaccgaaatccagtcctctattccaattagcaaaaatgtgggaaaatataaataatataaaaatcggctcgaggacaggagaagacttaaaattaacaacggagcaaaaatgggcaatatttcaacatctagacaacaatgagaaattaacaccaacagatctactcaaaatactaaatctaaaaaaggaaaattgctatgtaaacaaacaaatgggcaaaggactcaatggaaatataacaaaacatgcaatcctacaatgtttaggaggatctgacaaatatgaaaacttactaaaactcgagcttaaaatggtggacggtgataaagagggatatctttacgacagaaaaacaggcgaagtattaaattccaaaatgatcaaattcatagaccccatggtagagcaagaaccattctaccaactatggcacataatctacagtatacatgatcaagaagaatgctcaagggtattacaagcaaaattcgacatagaacaaccaatcgctgataaattagccgcaatcgattttagcaaacacgcattcggatccaaatcagctaaagtaattagaaaaatactaccctacctaatggatggagacggatatagtgaagcaatgagctatgctggttacgaccattcaaattcccaaactaaggaggaaaatttacaacgaaaattactagacctattgaaacctatccctaaaaactcacttagacaacccatagtcgagaaaatattaaatcaaatggtaaacgtagtcaatgcaattatcgaaaaatacggcaaccccgacgaaatcagagtagaactagccagagaactaaagcaaagtaaagaagaaagaaatgatgcggataaagcaatgtcaaaaagacaaagagaaaacgatgcaataaccaaaagactagaagaattcggattaagggccactaggaacaatataataaaatggcgactgtatgaagaaatagacaaccaagaaaaaaaactaaacgcaatgtgcgtttactgcggacaaccaatatccctcacagaagcgcttagaggaaatgatgtagatatagaacacataattcccaaaagcaaactcttcgacgattcacaaagtaataaaaccttagctcatcggcactgtaataagaataaaaatgacctaacggcctatgacttcatgaagggaaaaccagaggcggtattcaacgaatacgtagagagggtcaacttgctctatgataatcacataatcagaaaagcaaaacgagataaactactaatgactgaaagcaagataccagacaacttcattgacagacaattaagagaaagccaatacattgcaaaaaaggctcgagagatacttcaaacaatatgccatgatgtatggtccacttcaggtacagtgactgcggaattacgacacttgtggggatgggatgatgtaactatgaacttgcaaatggcaaaatatagagaattaggactaactcaccaagtagaatgggaatcagaacacggcaaaaacaaacatgaaaaagaagtaatcacggactggaccaaacgagatgaccatcgacatcatgccgtcgacgccttaacaatagcctgtacaaaacaaggattcattcaaagattcaatacattaagcgcagctaaaaccagagaagacatgatgttcgacatagaacaacgctcccatgaattcaaggaaaaaagaagtttattggaaaaatacataatatcagaacaaccacttaaagttgacgaagtggaaaaggctgtctccaatatactaatcagtttcaagagcggaaaaaaagtcgcagtatggggaacaagaaaaatcggtaaacgggggagtaaaaaggtaattcaaaaaaaaataattgtaccaagagggtctcttagcgaagaatcagtatatggaaaaatcaaaaaacaagaagagaaagactataagtacctattcgaaaacccgcaactaattttcaatccaacaatcaaagcgaaggtagaggaaagacttttaatgtttgacggagacgttaaaaaagcaataacttctcttaaaaaaatacccatatacttagacaacaacaaaacagttgtattagaaaaagcgatatgcttaaaagacgaattcgtaataaaatattccgtagacattaatttcaacaaagtggataaagttgtagatccaaaaataaaagaaatcttacaaaacaggctaaaaaaatttggaggaaaagaaaaagaagcattcaaagacgtccaattagaggacaaaatgataattaaatggtacgaagatgaaggtctagagagaccaataaagagcgtacgttgcttcacgggactaagtgccgtagtacctgtcaaaaaagatgaaaacggaaacgacatcggttttgtcaaaccaggaaataaccatcacatagcaatttatacagacaccgaagaaaataagcaacaacatgtatgcacgttctggcatgcagtcgaaagaaaaaaatatgacatacctgtcataataaaaaataccaatgaagtgtgggataaaattcaaagccaacccgacggtacatatcccgatagttttctcgaaatgctaccaccgccaaacttaaacctattggtaaatatgcaacaaaatgaaatgtttatattaggtaccacaacagaagatattaaactagccatagacaagagggactacaaaataataggagataaactatatagactacaaaaaatgagcatcaaaccatcttctggacagatagacatagtatttagacatcaccttgaaacacaattaatagatgatgaaaatagcaaaaaaagcaaaagattttacaatgtgcagagtttaggggctcttttcgcactgaacccatttaaagttagaatagacaatttaggaaatctggtaaaggaaaaatga

SEQ ID NO: 5225 - RNA, 3762 nt, synthetic construct
  misc_feature 1..3762: note = Cas9 variant
  source 1..3762: mol_type = other RNA
atgaaagcaagaggaaattttctacatcaagacacacctggactaacagcagcaaatgcaaacatgggcgatgcagttgaaaaattatgtgtagccttagaagattggtgcaccttacgcaaccttgaatgtaatatccgtaaaaaccagaaaaacatacaaaatcttttagaaggaaaaaccgttgaagtctcagcagaaaatgctttaaaagagtcgttcgactcaagccgagccagtagaaaagacaaagcaacaatattatcaacatggatagccatacaaccaggcgagtacttagacgctaagcaagctaaggatgcttcaaaagagatagccaatgtattgtttggactacaaggcaatatgaagaagatattcattgagttcgaagaagaccaaaagattcgtttagataacgacgaacaagtggaagcattttactcattatgtcccgacgatggtgttgcattatttgagtcattccaatcgatatatagtgcatatattttaatgggtatcctgaaaaacgcaaatggtggttcaatatcatcatgcaaagtagcagcctatgaccagtataaagaagatctaaaattactaaaagacttagtaagagaatttgcctctgaaaaatacgatgagttctttcgtggagatatatttgacagttccaaaggattcagggcaagaaattataatccagcaacagcaaaaggatacaccaaatacaatagtgttcgcggcgcatcctatgacgatttcaaaaaggaagtcgagaaaatctttaaaggtacagttgccgaagaagatatccgatatgttgatatgatgcagagattcgcagaaggtacgtttttgcgacgtttaaaaacctctgataacgggagcataccataccaattacatctagaagaaatggatgcaattgtagaaaatcaaaaacaattctatccgtttttagaaagtgaaaaggaaaaactagaatcattagtaacattcaggatttcatattacgtcgggccactaacacagaaaaatgcaagattagacaaccacaataatgcaagatttgcctggagccaaagaaaggaaggcaaggaacatgcaagagtttacccatggaattgggaagaagtcatagacagaaaacaatcagcagcaaaattcatggaaagattgacaggtacatgcacctatatattagatgaacccgtactacccagatgtagcttattatacgaagaatactgccttcttaatgaactaaatggatccaaatggagagacatgggaggagattggcataggtttgactacgaaacaagaatggaaattatagaaaatctttttaaaaagaagaaaggatctgtaaaatatgcagcagtagaggactggctgaaatgcgaaaaacacaaatcatgcgcagaagtaaaaggaggtcaaggtgaaacaggattcgagagcaaactctcatcttatgttttctttaaagaagtccttcacgtcgatgaaatagacgaggcagatattccaatgatagaagaactaatatggtggaacacactgtttgaagacaggtcaatcctcaaagaatctatcgaagataagtatggagacagacttacggatgaccaaataaaggccatatgcaagaaacgttttactggatgggggagactaagcaaagaattattatgcggaataaaaacgcacacagataatggaccctacagtataatggacgtattacgagaaggaaatcctaataataacgcacgatcagagactatggtatttatggagatactaagagatgacaaatttggattcgataaattaatcgaagaagaaaacatgaggagagtttcagaagtagacaattttgacgttaacgatttacccggaagtccagcagtaagaagaaccgtgaaccaagcaaaacgaatcgtggacgagatagtgggcatagcaggatgtgaaccacaaaatatttttatagaagtaacacgcgatgaggatggaagaaacaaaggtcgacgaactaaaagaagatatgacaatatcaagaacgcaatagcagcattgaagaaagaacaaaaagagtattttaacaaagatgtatcagacagcttaaataaaactaatcctagtgacctagataatgaaagattagcactatattttatgcaaaatggtaaatgtatgtactgtggaaaagatttagatattaaacaacttgacaaataccaagtcgatcacattttaccacaatcatacgtaaaagacgactcatttgaaaacaaggctttagtacatatggaagacaaccaaagaaaatcggcaagcatgctattagatgatagtataataagaaaaatgaaaccctactgggaggcactaagagctgcaggcttaataggagaaaagaaattcaaaaatctaacccgagttagagtgtcagataaagaacttggaggttttatagcacgacaaatggtagaaacatcccaaagcatgaaactaacttcgttagtactggagaaaacttacccaaatacaaacgtacgacctgttaaagcaggtttctcaagtgacctaagaaaacgattagatttaattaaatgccgagaaataaatgattaccaccatgcacacgacgcgtatttagcctgtgaaataggacaattcataacgatgagacataataaactttatgaaaacccaatatcttactcacatgcagtaaaagattttatagcgaaaagagcaaaatatgcaaatgaccatggtactcccatgtccacatacggaatgccaggatcctcctcattcgttatctcatcatttctcacaagtggttttgacgaagaaacaggagaaatatttaaagacgcctggagtgccgaagtagcagcagttagaattagagaatccctgaaccgaaaggactgttatattagcagaatgcccgaagaaacaagtggtgcattttggaaagaaactttaatttcaccacgcgaccctagtctagggaaaaacctcagccttcctataaagaaaggactagacccacggaaatatggaggatataatgaacaaaaatttgcctatttctttgtctatgaagcagtgaaaattaaaaagaaaggagaagtaaaagaatacgtatttgcagcagtcccagtacaagttgcagccatagtagcaagagaccccaatgcactaacaggattcgcaaagaaagacgccgaagcacgaaaaataaaattcttacgaataatcagagaaaaagtttacaaataccagctgatagaggtaaatggagagcgattatatattacaggcttaaaaagtgtaagaaacgcaagacagatcgcgttatcgcaagatatgacgacagtattcctaaaagcaattaacgataaagatgtcgcagaagacgaattaaaaagccttttcgaagaaattgttcaaagatatagattatgtgcaaatagactgggaaaccaactaaaaatattttcattatcagattcattcaactctgcaaactccgaaagcaagaaaagagcattagtctcattagttgcaataatagacgcaaaaacaaacaaaatagatttatcaggtattggatcaggtaaagcagtaggcaacatgagattatctttttccaaagaaatgagcaactcgaaaaatcattttgcctttatagaccaatctgtaacaggaatgtttgagagaaaaacctacctatga

SEQ ID NO: 5226 - RNA, 3777 nt, synthetic construct
  misc_feature 1..3777: note = Cas9 variant
  source 1..3777: mol_type = other RNA
atgaccgaggaaaatccagacatacgcaaagtttttcttgcgatccaccacatactaaaaaacagaggacatttcctgctccaagggcaatctttcaaagaaggaaacctgaataacttaataaaagaattactgaacctagacatcttgcacatctcaatagaaatcacagaagaaaatataaataaaataaccgaaatagccctagagaagaaaacattaacagacaaagttaacgacctaaaaaaaatctatcctaaagaaaagcaattactagaagcatttagactaattttcggaggcaaaacaagtctggacaaactattcgccattgatgaatacaaggaattggacgcaagtgtaaaaagtgtaagtttcaaagaaaaaatttacgaagaagtaagacatgattatgaacaagtgcttagtaattacattgagctactagacctagctaaattggtatacgattccattatactatctgacattaaaaaggaaggaaaaactctcagcgagtcaaaagtagaactataccacaaacacagagaagaccttacaaaattgaagaccttagtaaaaaacgacagcaagctaagtgaagataagaaagtagaattatatagtgcaattttcaaagaagacaaagacaaaggaacaaactatgtgaattacattcgaaaatcggaagagggaaaaggatgcaactacgaagacttcaaaaaatttctagtaaaagagctagccaaactagaagaaagctcagcaaaagaagaaatactcagagacttagaattagagttatttcttcccctacaaagaaccaaagataatagtgtagtaccataccaaatacacaaagaagaactagtaaaaatattagacaatgccgctaaataccacaaattcttaaacgaaaaagacgatagcggatattcaataatagaaaaagtcatccagctcttagaatttcggataccctactacgtaggcccacttaattcctccaaaaaagctaaggtagacggatttgcatggtcagtaagaaacaaaggatacgaaaacacccccgtaacaccttggaactatgaaaaagtcatcgatgaatctgcatcagcagaaaaatttatcaccaacctgactaacaaatgcacatatctaaaaggtgaagacgtactaccaaaaagctcactactatactcagaatttgcactcttaaatgaattaaatgcactaaagtacgacggaaaccgaatttctctagaagcaagaaatgtaataatagaaaaattatttaaagaacaaggtaaaaaagttactaaaactagtataaaaaatctcttaaaagcagaaggatacatagatggtaaaggagaaatcactggaattgatatcactgttaaaaacgatctcaagtcctatcgagacttcaagaaaattctaggtgacaagttcaacacagaacacgtggaaaatattattctatggataaccctatacggcgaatcacgaaaactgatcaaggcaaaaatagaagcagtatatggcgacatctactccaaagaagaaatagccaaaatgagtagattagtatacaaagactggggtagattcagcagaaaactgctcactgaacttgtatctaaaaagttatacaatgaagaaacaggagagtgtctcaacatcatcggtgctatgcgacaaaacaatatcctattcatggagctactagccgaccgttttgactattcacaacaaatcattgattataacaaagaacttcaaaaagaggttacagaaataacacctgaaatcttagacgacctatatgtaagtccgtccgttaaacgttcaatatggcaaacagtaagaatagtcgaagaactaaaaaaaatcatcggatgcgcaccagcaaaaatcttcgtagaaactacaagatcgaatcaagacaaaaaaaaaccaactgatagtcgaaaaaaacaattagaattgttttataaggcagtaaaaaaagatgtaaaggatctcgaaaaagaaattggaagtttaaactttgacaaactaaacgaacgattaagttcagtagaaccatcaaaattaaaagcaaaaaaactatacttatattacacacaactaggaagatgcatgtacagcggtgaaacaatcgatataacacaactaaataccactgcttacgacatagatcacatctacccgcaatcaaaggtaaaagacgacagctttaccaacactgtactagttaaaagagaatacaatgctgctaaaactgacagatacccattaggatcagatatacaaaccccatcaaacagacgattctggaaatttcttaaagaaaaagggctgattacagatgaaaagtataataggctagtgaggacagaagaattcagcgatgaagaactaacaggatttatagcaagacagcttgtagaaacttcacagtcagtcaaggccgtagcggggatcctaggtgaactaaacccaaaaacaagcatatgttacagtaaggcagagaatgtatcctcatttagacagaatttcggaaaaataaaagagggaaatcgaaagtcagataatacggaacaattaatcaaagtcagagaaatcaacgactatcaccacgcaaaagacgcatacttaaatgttgtagttggtaatgtatatgatactaaattcactcgaaatgtatttaatttcatcaaagataaaaaagacggaaggaaatacagcctaaacaacgtcttctacgaaaacgtaagtaactcaaataacgtggcatgggaattaaataaaactgtgcaccaagttgaaaaggtaatgaataacaataatattttagtgaccagaagaactagtgagcaaaaaggaggcctattcgatgcaacagtatacaaagcaaaagtagcagcaaaagcaaaggaaggagtttactatccactaaaaactagtgatccagtagtaaatgacgtgactaaatatgggggttttacaaaggttaagattgcctattactcgatatttgaatatacactggtaaataaaaaaggtgaagaaaaaatcacaagaatcatacctatcccaatatacgtatcacaaaacattaaagacgatagcactttattagaattcggcaaaacacaaataaacataaaatcaggggaagaagtaaaagattttaaactgaaatataggaaactatgcataggcgatttagtaaaaataaacaatttttttaattttattggtggaaaaacaaatgactcattcgtctatgacggagcagtccaagtaactttagacaccgagtccgaaagatacattaaaactttatcgaaataccaaaactggaagaaagaaaataaagatggcgaattatgggagtcaataactaaagagaaaaacacagaattatacaacctattagtagaaaaaatgaattcgggaatcttcataaaaaaaaaaccaaacaagttcaacgaattaaattcagaagagataaggaataacttttccagcatcagcctagaggaacaagcaaaagttctcctagaggtactaaacctcctcactaacaagaaatcaatatttgatttgaaatcgataaatatcaccgcggcaagaggaaaaataagctttaatttatcaaatttaagtcaattcagcattatagaacaaagcgtagcgggcttttatgaaaaagaaataacgattattggagacaaagaaaacgacatggaaaacaataactgttga

SEQ ID NO: 5227 - RNA, 3780 nt, synthetic construct
  misc_feature 1..3780: note = Cas9 variant
  source 1..3780: mol_type = other RNA
atgaaatacattcttggtctagatctaggggtagcgtctatcggatgggcagtgacggagataaacgaaaaaggagagccggtaggactcattgacgcaaattccgtaatcttcaaacccctcgataacgataaaggaaaactatataatgtcgaaagaagagacaagagaggttcaagaagaatactacgaagaaagaaacatagagttgaaagaacaaaaatgttactcgtgaactcatctttcttaactaacgaagaaatagataatctatatgtcggaaaattagacaacatctatgaagtacgattaaaaggactcaaagaacaactaagtaaaaatgagatcgcaagacttatgatatattattgcaaaaatcgtggatttaaatcaaatagaaaaacagaagacttagaaatattaaaatcactaggcgagaaaatatcggaaaaagactcagacgaaaagaaactaaaacccataatagccaaaaacacagaactaatagaaagcaaaggactaacacccatcgaagtcatatacatgattagagaaaatgacaactccatactgggatttaaaaacaaagaaggcaattataaattcggcttcaaaagaaatcaagtaatagatgaagtgagaaaaattttaggaactcagcaaatcctaagcaaagaaatagtagacgaatacatagacatattatcaagccagcgagacttctcagatgggccagggggagactcaaagtacaagatagactacacaaagttagcaggaaaatgtaagtacacaggtgaagtacgcgcagtaaaaagcgctccatcttatgaaatatttacgatgctacaaaagctaaacgacataagatatgtaaaatttacaagcgaagacaaaattgaaaagaagaaacttagcaaagaagtaattcataaactttatgacttagtagtagagaaaaacaaaaccctaacatacgacctaatagaaaaatcaatagatgaagaaaacattaaactactgaacatacccaaattatcaaaaagcaaatacgtagaactaaggaaatcttatttcaaagaacgcaacgataacgaaaatttaaccgaagaagaaataaatgcatttaatgaaaaattaaacaatgaaagaatgaaacaagaactaatccgaaacaatctaaaagcatacaaagaactaaaaagtaaatttaagaaaaataatatagacgagaacaggataaaagaactaggaggcatttatttcctggatttagtagcggaactccttacgtacagtaaaacggacgaaaagctagaatacttcgtggaaaatgtagaacgatatagcctctttaaagaacaacgtgacattgttgaaataataaaaactttccccaattatacaaagaacggcaacctatcactgtctttagtacgagaactaaacaaacttttaatggagggacacgattatgagtctagcttaagtagcctcaactattacatcgacactgatgtagactgggaaaaattcccaacaataagtgaaattgaagactccctatccacaaaaataacaaatcccaatgttaaacatatcttagtaatattaagaaaattatacaacactctcttatttaaatatggaagacccgaaaaggtacacctagaattatcaagagactttagtaacgactttagcacaagaaacaaaattcaaaaagagcagctggagaataaagtaagaagagaagtggccgcgttcgaaatgtatggcgcaaataaagacatcgttgcaggaaaagacaggctatcgaacgacgattttgtacgcataaaactatgggaagaacaaaacaaggtgtgcatgtattcaggaagaacaattgaaaaataccagttaacctcagctgaggtgcaaattgatcatatcctaccctacagcaagagcttcgacaacagctacagcaacaaagttttagtttttagcaatgaaaaccaagataagaaagaaaggacgccatatcagtggttaaaagggactgaaaaatggaatgagttcaaacaaagggtccggctaaacctgaacatatcgaacaaaaagaaagaaaacttgctattcgaagatgaagtagtaaataatgagttcctagaacgagaactacatgctacatcatacagttcaagactagccctaaatatttttcaaagactcataccagtctccgacgaagacaaatacgacgaacatggcaacgaaaaagtcaaatatctgtataacaggaacgtcatcgcatttcaaggcaaaatgacatcgatgttgagaaacctttactcacttaacaaatatactcactcgttcgaatcggatacactagacatcgataataaagcatttatacttaaagagttcgaaataaataaagataatcttaaaatgacagcttacaacgtgaataccgggcttgaaataacttcagaaacaaaagtagagaaaaataaatcaggagagttcaaaacaatcaaagatgaactactaaagaaagaattagataagaaagaaaatttaatagaaatatcagattacttcaaagataaagtcctcttcgatctaaaaatagtagattttgaagaaatagacacagtagaaccagaaatcatctcgatcctatacaaaatgataacggcgctcaaagaagaagtatacagcaaaaacagagaaaaccatcttcatcattcactagatgcattcttactaaccataatgaacagatcaatgcaaatgaaattaatcaaatacaatcaactaataagcgtattaaagaacaaagaaatagagatatttaacgaagaaaaaggtgaatatatagatagtaaagaatttgcagaagaactacaaaaacagaaaataatagacatagacggaaacgaaaggggaatcaaattcaacgtaaacggtaaaacacaccgacttaacttagtaaaaccttacgagaacttcttagacgacattaaaaacaaaatatttgacaaacgcgaaaataacaaacttccgtaccacgtagtaaaatcgaaagtcagcggggcattacacgctgaaacaatactaggtgaatctaaaggagaaataacaaagagaatatcagtcttcgacataaactacaaaaacctaggtaaaatatttgacaaagatggctcccaaaaagaaatatacgaaacattagtaaaatggctagaagctaaaagtaaggactaccccaagttaaagaacggaaacataatcaagaaagtaaaaatagttgacggaaataaagacaaactaatcaaactaggaaacaaacgatatgtggaaatgggcagaacaacggtaaaaatcttggtacttaaaaaggaagcagaagaaggactaaagtttgcaagcataggtagatacaaatataacctactaaaaagcgaaaaagacgttaatataagtatatggaaagacgccattcacttttgcaaagtacgatataacaaactaaaggaaaacggctacaggttaatccacgaacttataccgggagaaacgatagagttagaactaaataaaggaaacatatcaaaatgtcttgtcgtaggatttagtggaggaaaaatagaaatatcatcagtcataggagacgcactagatctgataaacgataaaatatccaccagaataaaagaaagatattatatcacagtctcaacaataaagtccatcaagaaaatcaacaaaaacatattaggagattga

SEQ ID NO: 5228 - RNA, 3792 nt, synthetic construct
  misc_feature 1..3792: note = Cas9 variant
  source 1..3792: mol_type = other RNA
atgcataaaaacaatcccgacatcagagaattgttcttagcaatacaccatatattaaaatatagaggacacttcctattcgcagggcaacaatttaaaggttcagaaattaaagataatatcagagaattattacaatataacagcctaaatataaaaatagatattacagacgaattgataaataacatagcagaaatactcctcaaaaagaaaaactccacggacaaaataatagaatttaagaaacttttcgcagacgaaaaacaactaatagaagcactacgtctcgcactaggcaacaaaacacaacttgcaaaactattcgacatagaagcatataaagaattagatatttcaattaaaacaattagctttaaagagaaaatatacgaagacgtaagaagcaactatgaagaaattttgggagaatacatcatagtgctagatactgccaaactaatttacgacgccatcatactatcagaaataaaaatcaaaaatatgacaatatcagaatcgaaagtaataagctatgaaaaacatggaaaagacttaaaacaattaaaacaactaataaaagaagactcaaaactatcaaagaaagagaaaagacagttatttgaaaacatattcgtcaaagaagatgaaaaagaagcaaactacgtaaactacataggcaaaaataatgtcggaagcagcaaaagctcctgttcatatgaagactttaagaaaagcctaataaaagaactcaaatactgtgaagaatcaaaactcaaacaagatatacttgcagaacttgaactagaaacatttttaccacgccaaagaactaaagacaatagtgtaatcccataccaaatacataaagaagaactggagaaaatactgaataacgcagttcaataccatccatttcttaacaataccgacgaatacggcatctcaataaaagagaaaattattcaattactagaatttagaatcccctattatgtcggttctttaaatacatcacataaagtaggcaacggaggattctcatggtccgtacgaaacaaaggctacgaacgtacagcagtcacaccttggaatttcaataaagtcataaataaagaagaatcggcgaaaaacttcatagaaaatttaactaaccaatgcacctacctcctatatgaagatgtcctacctaaacattcactgctctattccgagttcactctattaaacgaactaaattctataaactacggaggcaaaagactaactgtcgaacacagaaatctaattatagaaagattcttcaaacaatccgcaccgaaagccaccggaaaagaactgaagaaattcctaatgagtgaaggagtcatcgacgggaaagatgaattaagcggtttcgacatctcaattaaaaatgatttaaaatcatatagagattttaagaaaatattaggagaaaaattcgacagcgaaaaagtcgagaaaatgataagatggataacactattcggcgaaagtaaacaacttcttgtggacaaaataacgaaagaatacggcgacatctatagctcagaggaaatcaagaaaatatcagggcttacctacaaagattggggacgtctatccgaaaaactcctgactgaaatcgtttcatcacagctttacgatgaaagcaccggagaatgttttaatatcattaacgcaatgagaaacaacacactactattcatagaattgctcggtacaaattacgattacttcgagaaaataaacacctacaatggaaaattaaggaaagaaataacagaaatcacaccgcatatacttgatgacctttacgtatcaccagcagtaaaaagatctatctggcaggtagtaaggatcgtagaagaactaaagaaagtgattggcagcgaaccaaaaagaattttcgtagaaactacacgcagcaataaagaaaagaaaggtgatgacggaagaaaagactcaaggaagaaagcactactggaactatacaagaaaataaaaacaagtgatatagcggaattagaaaaagccctcggtcacacagttgacttcgataagaagaaacaagatctaaccgacatagacaacaataaattaaaagccagaaaactatacctctattacacacaactgggacgctgcttatatacaggcaaagctatagatttaaataatctattcggctcaaacagtgagtacgatatagaccatatttacccacaatctaaaacaaaagatggatcctggaataacctagtacttgttaataaaacagaaaattctaagaaaagtaacggcttaataagtgaaagcatacaaaggaaaaacaagcatttctggcgatttctaaaagccaaaaacctaatctcagaagaaaaatacaaacgattaacacgaaccgaagactttactgatggagaactctccggatttatagctaggcaacttatagaaacatcacaatcagtcaaagtggttagcaaaatcttacaaaacctcaacccaactacagaattatgtttttcaaaagccgaaaatgtatcagacttcagacaagagttcggtaaaatcaaagtagggaaacgtaaaaacctaaccgaagaagaacagaagaaagcgaaagagggacaattaataaaagtaagagatttaaatgacttgcaccacgcaaaagatgcatacctcaatatagtagtaggcaacgtataccacatcaaattcacgagaaaccccaaaaattttataaggaaaaacttcaaaaaccgcgaatataccttaaacacattattctattcagacaaagttgaaagaaatggtgaagtagcatgggaaaaaggaaaaaccgaagaaatcgtttcatcagtaatgtgcaacaacctaatcaacgtaacacggagaacaagtgaacaaaaaggagccctatacgaagctactatatataaagccaacgcagcaaaagaaggttcatattaccccgtcaaaaccaacaataagaacctcaaaaatgtaacacgatacggaggttttacctctattaaaatcgcatactattcaatatttaagtatgacatcagaaacaaggataaagttaaggagaatataaaaattataccaataccgatttatatctcccaaaacataaaaacagatttagatctaataaatttcgcagaaaagcaaataaaattaaagaaaggtgaaaatatcgaaaacttacaactaatttacaagaaactgaacatcggagcgctagtcaaaatagatcattacccatattatatcggcggaaaaacagacgacaacttctacgtcgatggggcagtacaagtactactgtcttcagacatagaacgttatttaaaagaagtggtgaaattcgtcaactttcaaagagaaaacaaagaagcaaaagtatcgaaagaacatataagcctcgaagaaaacataaaactatataacactttagtatgtaagatggcaacaaaaatatttacccataagaaaaataataaatataacgacctaacacaagacaaagccaaaaacacattcaataaactttcattagaagaacaatgcaaagttttattagaaatcttaaacctattaacaaataagaaaaccacattcgatctctccctaattaatgagaaaacatcacgcgttaaatgcggattcaatctattaaatcaaaaacagtttagcatcatagaacaaagtgtaacgggattatacgagaaagagatcaaaataatcgaagactga

SEQ ID NO: 5229 - RNA, 3795 nt, synthetic construct
  misc_feature 1..3795: note = Cas9 variant
  source 1..3795: mol_type = other RNA
atgaaaaatgtactaggattagatctagggacaaactctataggatgggcattaatagaagttgatgaaaacaatctaccaattagaattatagcaatgggttcaagaataataccactatctacaagtgataaagaagagttccaacgcggactatctattactaaaaaccaatcaagaactgtaagtagaacgcaaaggaaaggatacgacagaaaacagcttaagaaatcagatcttaagaaaatactaaataaatataatatctttccttcagaagaactactaagattaccaatgttagatctatggaaactaagatcagacagcgcaaacccagacgaaaacatatctgctgaacagttaggaaggatactctatatgctaaatcaaaaacgaggatacaagagcgcgaggtctgaagcaaatgcagataagaaagattcagactatgttcaagctgttaaaggcagatatgaccaattaaaagatcgcaaacagacaataggacaatatttttacgatgaactttataatgcaaacgcaaacaacagttattttcggattaaagaagaagtatacccaagagaagcatacattgaagagttcgacacaataataagtgctcaacgagaaaaacatgatttcctcacagatgaagtagtccatcaactaaggaatgaaataatctacttccagagaaagttaaagagccagaaggggctagtctcaatttgcgaatttgaaggctttgagaaaacagtatttgataaagagaaaaacaaaaataaagtagtattcgtgggccctaaagtagctcctaaaacatcaccactttttcaactgtgcagaatatgggaagttgtaaatacaatcacactaaaaatcaaaaacccagaaggaagcaaatacaaatggggagagaaaatacccgacataaaagaaaaagaaatcctcgctgactatttatttaaaaacgaaagtttatcattctcaaaacttctagaaatattggaactgaagaaagaaaatgtctacgtgaataaacaaatcttaaaaggcataaaaggtaatgaaacatacagcgcactacactcgatactaggcgacaatgaattactaaacttcgacgtatccatcatgacatcaaatcagacggctttactcgtagacagaaaaactggagaaatactagaagaaagagcgggactggaacttgatgcatcactagaaaaagaaccactgtaccaactatggcatacaatttattccttaaaagatcttgacgaatgcaaaaacgcactcataaaaagatttgattttgacgatgaaacagccgaaaaacttagccgaatagacttcaacaaacaagcctttggaaacaaaagcaacaaatcaatgcgaaaaatcctcccattcctaatggaaggatacgattattcccaatcatcgagcctcgccgggtataatcatagcaattcattaaccaaaaatgaaagggaacagcagatcactctagaccgactcgaattactacccaaaaactccttacgacaacccatagttgagaaaatcttaaatcaaatgattaatgttgtgaacgccatcctagacgaatatggaaaaccttcagaaatacgtgtagaattggcaagagaactaaaacagtctaaagacgaaaggaacgaaacagacctacaaaacagcaaaaataagaaattaaatgacgaaataggtaaacgacttgaagaattaggccttccagtaacaaaaaggtacatacaaaaatataaattcatctttccttctctaagtaaaaatctcaaagaagcaaaagtcaataaccaatgcatatattgcggagaaacattcaatttaacagaagcactaagcggagatgcttatgatgttgaccacatagtaccaaaagcattacttttcgacgatagtcaaactaacaaagtacttgtacacagaaaatgtaactcaacaaaaacgaaccagacagcttacgattatattgccacgaaaggagacgaacatctaaaactatatagcgaaagattagacgattggttcgaaagaggaataataagttacagtaaaatgcaacgactaaaagtatcccacaaagaatatttagaaagaaagaaactcggcaaagaaacagaaaccgacaagaaactatgggaaaatttcatagatagacagctcagagatacacaatacatttctagaaaatccagagaaatattacagaaaatatgcaacgacgtaaaaacaaccgaaggaggagttacagccaagctaagaaacctttggggatgggacgatgtccttatgaatttacaaatgccaaaatacaaagaattaggacaaaccataactaaagaatggacgtcagagcatggcaaaagaaaacatcaaaaagaagaaatagacaattggactaaaagagatgatcacagacaccatgcaatagatgccctagtaatagcatgtactaaacaaggtttcatacaacgaatcaacacactaaactcttcagacaccaaagacctaatgatcaaagaagtcgaagaggcaaaaattgagttcaacgagaaaacaacattgttggaaaaatacctaaaaacccaaaaaccatttagcactcaagaagtaatgaaagaagctgataaaatcctagtatcattcaaagccggcaagaaagtcgctacaatcacaaaatttaaagcgaccggcaaaaataaagagacaggtgtcatagtaccaagaggtgcattacatgagcaaagcgtttacggaaaaataaaagttatcgaaaaagacaaaccactaaaatacctactcgaaaacagcgacaaaatagtaaatccaagaatcaaaaatttaatagaaataaaactaagcgaaaacaaaaacgaccccaagaaagcattactagcactcaagaaaatcccaatcttcttagatgaagaacaaagtatcacattagaaaaagcaagctgctataacgacgcaactgtactaaagtataaattgcaaaacctaaaagccgctcaagtagacgatatagtcgacgaaaaagtcaagaaaatagtgagggaaagattatcccaatttggcaataaagaaaaagaagcattcaaagacactctctggttcaatgaagagaagaaaataccaattataacagtgagactcttcgctagaccggacgcaaacaatttacaaacgatcaagaaagatgaaaatggaaacggaataggattcgtcgttacaggtaacaaccatcatatagctatatatgaagataaagataataaaccagtacaacactcatgcacattttggcacgctgtagaacgaaagaaatacaatattccagctgtgattagagattcatcagaagtatggaacgatctactaagaaaagagctacccgaatcattcttaaataaactcccagccgacaacctaaacttaaaatttagtatgcaacaaaatgaaatgttcatactagggctatcccaagatgagttcgtaaaagcaatagcaaacaatgataaatccctcctttcaaaacacttatacctagtctggtctatctcagaaaataactactggtttcgccatcacctcgaaaccaaaaacagcgatctaaagaaaactgacggcgtgaaggaatccaaacgactatataatatacggtcattaggtagcctcttttcactaaatccaataaaagtgcggctcaactatctcggagagataaccaaaataggcgaatga

SEQ ID NO: 5230 - RNA, 3801 nt, synthetic construct
  misc_feature 1..3801: note = Cas9 variant
  source 1..3801: mol_type = other RNA
atggcaaaatacatactaggtttagatttaggtacaaactcaattggctgggccttaatagaagtagatgagaacaatataccaatacgcataatcgtgatgggctcaagaataatacccctgagctcaaacgatagagaagaattccaaagaggcctctcaatcactaaaaaccagaacagaaccatttccagaacgcaacgaaaaggttacgacagaaaacaactcaaaaggaacgacctaaataaagtattaaacaaatacaacatatttccatcaaaaatgttactgaatcttccaatgttagacctatggaaactccgaagtgacagtgcgaattctaacaaagatatcagtgcagaacaactcggaagaatactctacatgctcaaccaaaaaagaggatacaaaagtgtcagaagcgaagcaaattcagacaaaaaggatactgactacgtacaagccgtaaaaggaagatacgcacaattaaaagaccgaaaccaaacaataggacaatacttctacgaagagctttacaacgcaaacgtaaacaacagttactttaagatcaaagaagaggtttacccaagagaagcctatatagaagaatttgatacaataatcaattcgcaaaaaactaaacacgagtttctaacagatcaattcgtacaccaactacgaaacgaaatcatatacttccagcgaaaactgaaatcacaaaagggactaatatcaatttgtgaatttgaaggttttgaaaagacagtattcgacaaagaaaaaaataaacataaaatcgtttttgtaggcccgaaagtagccccaagatccgctcctctctttcaactatgcagggtctgggaagtcataaatacaataagcataaaagtaaaaaatccggaaggttctaaatataaatggggagaacgcataccaagcataaaggagaaagaaattctagctgactacttattcaaaaatgaagtattatcatttaccaaacttttagaaatattaggattaaataagaacgacgtctacgttaacaaacaaatattaaaaggaatcaagggaaacgagacttatgcaactctatacaatattctaggcgagaatgaattcctcaatttcgacgtgagcataataccctcaaaccacacttcaatgttagtagataaaaaaacaggagaaatcctagaggaacgagcaggactagaattagacgtatcacttgaaaaacaaccattctatcaattatggcatacaatctactcactaaaggatctagacgaatgcaagaacgcgttaattaaacgattcgacttcgacgacgaaaccgcagaaaatcttagtagaatagacttcaataaacaagccttcggtaataaaagtaacaaaagtatgcgaaaaatattaccttttctaatggaaggatacgattactcacaaagttgttcattagcaggatacaaccacagcaacagtctaacaaaagatgagcgagaacaacaagtcacgctggacagactagaactactgccaaaaaatagcctaagacaaccaatagtagaaaaaatactaaatcaaatgataaatttagtaaacgccattttagatcaatatggcgaactctcagaaataagagttgaactagcaagggaacttaaacagagtaaagacgaaagaaacgatgccgatctacaaaataccaaaaacaaaaaactaaacgacgaaataggtaaacgattagcagaattaggattaccaataacaaaacgatatattcaaaaatacaaattcatatttccatccctctcgaaaaatctcaaagatgcccatgttaacaatcaatgcatctactgcggagaaacatttaaccttagcgaagctctgtcaggagacgcgtacgatgtcgaccatattgtaccgaaggccctactatttgatgatagtcagacaaacaaagtgttagtacaccgaaaatgcaattcaacaaaaactaaccaaacagcatatgactacatctcaacaaagggcgacgaacaagttcgaatttatttcgaaagggttgacgattggtttaaatcaggaataataagttattccaaaatgcaaagactaaaagtcagtcacaaagaatacttagaaagaaaaaaaataggcaaagaaaccgaaacagataaaaaactctgggaaaatttcatagacaggcaacttcgcgacacacaatacatatcaagaaaatcccgagaaatactacaaaaagtatgtaataacgtcacaacgaccgaaggtggggtaacagcaaaacttcgaaacctctggggctgggacgacgttctgatgaaccttcagatgcccaagtacagagaattagggcaaactgtaataaaagaatggaccagtgagcatggaaaacgaaaacatcaaaaagaagaagtagaaaactggacaaaaagagacgaccaccgacaccatgccatagatgctttagtcatagcatgcacaaagcaaggatttatacaaagaataaacacactaaactcctccgacaccaaagatttaatgcttaaagaagtcgaggaagcaaaagtcaaattttccgaaaagacaacactcttggaaaaatacttaagaacacaagaaccctttagcacacaggaggtaatgagggaagcagacaaagtgctagtctcattcaaggcaggaaaaaaagttgccacaataacaaaattcaaagctataggaaaaaataaggattcaggagtaattgtccccagaggcgccctgcatgaacaatcagtttatggaaaaattaaagtcatagaaaaagacaagccgcttaaatacctctttgaaaatagcgacaggatagtggaccccaaagtaaagaaattagttgaagtaagactatcagagaacgaaaataactcaaaaactgcaatatcaacccttaaaaaagccccaatctttctaaatgaagaaaaaacagaagtactcgaaaaagcatcatgctacaatgacgctactgtactaaaatataaactacaaagtataaaagcatctcaagccgatgacatagtagatgaacgagtaaaattcctagtaaaagagcgactcgcacaatttggtaacaaagagaaagaagcatttaaagacatcctatggtttaatgaagaaaagcaaatccctataatatcggtccgcctttttgcaagaccagatgctaacaacctacaggttatcaaaaaagacgaaaatggaaagtcaattggtttcgtattaacaggaaacaaccatcacatagccatatacgaagataaagacaacaaacttatacaacactcatgtacattctggcacgcagtagaaagaaaaaaatacaatattccagtagtaatcaaaaactcgtcggatgtatggtcacaactactagacaaacaactaccagaaagcttactaaacaaactaccaacagacaaacttaatttaaaattttctatgcaacaaaacgaaatgttcatcctaggcctgtcacaaaaagaattcgacgaagcaatcaaaaataaccacaaatcttttctatccaaatacttatacctggtatggagcatcagtaataatgattactattttcggcaccatttagaaaccaaaaatacagagctaaaaaatatatctactgcaaaagaatctaaaagatacttcagattcaagtcagtaggcgcattagttggaacaaaccctattaaaataagactaaaccaccttggagaaatcaacaaagtaggtgaatattga

SEQ ID NO: 5231 - RNA, 3807 nt, synthetic construct
  misc_feature 1..3807: note = Cas9 variant
  source 1..3807: mol_type = other RNA
atgacaaaaaatatcttagggctagacttaggaacaaatagcataggatgggcccttatcgaggtagatgaaaacaatacaccaattagaatcatagcaatgggtagccggataataccactaagcacctccgacaaggaagagtttcaaaggggcttatcgataacaaaaaaccaaagcagaacagtaagcagaacacaacgtaaaggttacgacagaaaacaactaaaaaaatcagacctgaaaaaaatcctaaataagtataatatctttcccagtgaagagttgctgaagctgccaatgctagatttatggaaattacgatccgacagtgcaaaccccaatgaaaacatcagcgctgagcaactaggcagaatactgtacatgctcaatcagaaaaggggctataaatcagccagaagtgaagcaaacgcagataaaaaagataccgactacgtacaagcagtaaaaggaagatacgcacaacttaaggaaagaaatcagacaattggacaatatttctacgaagaattatataacgcaaacacaaacaactcatattttaggataaaagaggaagtctacccaagagaggcatatacagaagagtttgacaccattataaatgctcaaaaaaataaacatgattttttaacagatgaagtggtacaccagctgagaaatgaaatcatatattttcaaagaaaacttaaatcacaaaaaggactcgtaagcatctgcgaatttgaaggcttcgaaaaaactgtttttgataaagaaaaaaataaagataaagtagtattcgtaggaccaaaagtagcacctaaaacttcaccattattccagctatgcagaatatgggaagtagttaatactatatcactaaaaataaagaatccggaaggatcaaagtacaaatggggggaaaagataccaaacctaaaagaaaaacaaatcttagcagattacttattcaaaaatgatagcctttcctttacaaaactactagaaatcctagatctcaacaaaaacgacgtctatgtgaacaaacaaatcctaaaaggcatcaaaggaaacgaaacattctcaacattacatacagtactaggagacaacgaattactgaactttgacgtatcaataattccaagcaaccatacatcgatgctagttgacaaaaaaacaggagaaatactagaagaaagagcaggtttggagttagacgcatcactagaaaaagaacccttataccaactatggcatacaatatactcattaaaagatctagacgaatgcaaaaatgcactcataaagcgatttgggtttgatgacgagacagcggagaaactaagccatattgactttaacaaacaagccttcggaaacaaatcaaataaatctatgagaaaaatcttaccattcctaatggaaggctacgattattctcaatcatgctccctagcaggatacaatcactccaatagtttaaccaaggatgagagagaacaacaaataactttagacagactagaattattatcaaaaaactccctaagacaacccattgtagagaaaatactaaatcagatgattaatgtcgtaaacgcaatcttagaacaatacggaaaattaagtgaaatacgcgtagaactagcaagagagctaaaacaaagcaaagacgaaagaaatgacgcagacctacaaaattcgaaaaacaaaaaactaaacgaagaaataggaaaaagactagctgaactgggattacccgtcacaaaaagatacatacaaaaatacaaattcattttcccctctctctctaaaaacctaaaagatgcacacgtaaacaatcaatgcatatactgcggagaaacgttcaatctaacggaagcactctccggagacgctttcgacgttgatcatattgtacctaaagcattactcttcgatgatagccaaacaaacaaagtactagtacatagaaaatgcaatagcacaaagaccaaccaaacagcatacgattacattgggacgaaaggcgaagaacaagttagagtgtactctgaacgtatagacgactggtttaaacgaggaataatatcctacagtaagatgcaaagactaaaagtatctcacaaagagtatctagaaaggaaaaagctaggaaaagaaacggaaacagataaaaaattatgggaaaatttcattgacagacaattacgagacacacaatatataagccggaaagcaagggagatcctacaaaaagtatgtaacaacgtcactacaaccgaaggtggggtaacggccaaattgagaaacttatggggctgggacgacgtcttaatgaatctacaaatgcccaaatacaaagaactaggacaaactgtcataaaagagtggaccagtgaacacggaaaaagaaaacaccaaaaagaagaaattgaaaattggacaaaaagagacgatcacagacatcatgcaatagacgcactagtagtagcttgcacaaagcaaggtttcatacaaagaataaacacgcttaatagctcagatacaaaagacttaatgcaacgggaaataaaggaagcaaaaaaactactaggagaaaactacaatgaaaaagaattcgaaaacgacaacgaattcgtcaaaaatcacaaagaacgactatcccaactagacgactacctaagactacaaaagcctgtcaaatttgatacgaaatatgtagaacaagaagccgacaaagtccttgtttcattcaaagcaggaaaaaaagtagcaacaatcactaaattcaaagcaacagggaaaaataaagacactggcgtaatagttccaagaggagcattacatgaagcaggactttatggtataagaacaatatactcaaaggggggcatagctgaaaaacatataataaaaaaatataaagtcggagtaagcgcacaggaccatatattcacaggaaaggagacatactcagtcaaaaaagacaaaaatggcaatgaaaaagtcgatgataaaataaaaatagtgttagattcaatagtagacaataaagtaaaagaagtcgtactaaacagattaaatcgaggcttcaataacgaagaagactatcgtatcgacgtgaaaaaggcattaaataacttcaaaaacttagacgaagacccattgtggtataatgaatcaaaaggaatcaaaatactatccataaaactaaaaacaggcctaaaggactcagtagtaccactacgattaaacgaaaagaatgaagtaataaccctagtcaaaacaggtaacaaccaccatatagcaatctatgaagacaacgatggaaaactaatacaatatagttgcacgttttggcatgcggtagaacgaaaaaaatataatatccccaccgtaataaagaacagctcagaagtttggaatcaagtactagacaaaaaacttccagaaagcttcctaaatcggttaccagcagataaactaaaccttaaattcagcatgcaacaaaacgaaatgttcatccttggactactagaagaagaatttgataaggcaataaaagacaatgataaaagcctacttagcaaatacctgtacttagtatggtcaattgcagaaggagattactggtttcgacatcatctggagaccaaaaatacagaattaaaaaaaacaaatggagcgaaggaatcaaaacgatactttcgactatcaacaaaaggactaatagatttaaacccagttaaagtaagattaaatcatttaggcgagatcacaaagatcggagaatactga

SEQ ID NO: 5232 - RNA, 3810 nt, synthetic construct
  misc_feature 1..3810: note = Cas9 variant
  source 1..3810: mol_type = other RNA
atgaacaactccataaaatcaaaaccggaagttacaataggtctcgacctaggagtgggaagtgtcggatgggccatagtagataatgaaacaaacataattcatcacttaggatcacgattattttcacaagccaaaacagcagaagaccgacggtcattcagaggagcaagaagactcatacgtagacgcaaatacaaacttaaacgattcataaacctcatatggaaatacaattcctacttcggattcaaaaataaagaagacatccttaacaactaccaagaacaacaaaaactgcataacacggtcttgaacttaaaactagaagcattaaatgctaaaatagacccaaaagcattaagctggatcctccatgactacctgaaaaaccgaggtcacttttacgaagataaccgagactttaacgtgtacccaacagaagaactagcaaactacttcggggaatacggatactacaaaggcataatagatagcaaagaagataacgacgataaactcgaagaaggactaaccaaatataaattctctaaccaacattggttagaagaaatcaagaaagtattatcaaaccaaacaggtctaccagaaaaattcaaagaagaatacgaatcactcttctcgtacgtccgaaattactcagaaggaccaggatccataaattcagtctcaccatatggaatatatcatctagacgaaaaagaaggaaaagtagtccaaaaatacaataatatatgggacaaaacaataggtaaatgtagtatctttccggacgaataccgcgcgcccaaaaactctccgatagccatgatattcaacgaaataaacgaattatcaacaatcagatcctacagtatatacctgacaggatggttcattaatcaagaatttaaaaaggcttacctaaacaaactacttgacttactcataaaaacaaattcagaaaaaccaatagatgcaaggcaattcaagaaattaagagaagaaacgatagccgaatcaataggaaaagaaactttaaaagacgtagaaagagaagaaaaactagaaaaagaagaccataaatggaaactaaaaggactaaaactaaatacaaacggaaaaatccaatacaacgatctctcctcattagcaaaattcgtccataaactaaaacaacacctaaaactagacttcttactcgaagatcaatataccacattagacaaaatcaatttcctacaatctctctttgtgtatcttggaaaacacttaagatacagcaaccgcgtagatagtgccaatttgaaagagttctcagattcaaacaaactctttgaacgtgttctacaagaacaaaaagatgacctgtttaaactatttgaacaaacagacaaagacgatgagaaaatattggcacaaacacactcactttctacaaaagctatgttactagcaatcacaagaatgaccaatttggacaatgacgaagacaatcagaaaaataatgataaaggctggaacttcgaggccatcaaaaactttgatcaaaaattcattgatatcacaaagaaaaataacaacctgagtcttaaacaagacaaacgatatttagatgatagattcataaacgatgctattctaagtccaggagtaaaacgaatccttagagaagccactaaagtattcaatgctattctaaaacaattcagcgaagaatatgacgtgacaaaagtagtaatagaattggcccgagaacttagcgaagaaaaagagttagaaaatactaaaaattacgaaaaattaataaagaaaaattcagacaaaatatcagagcgcctcgaagccctagacatagcagaagacaaaatcgaagatatccttaaatccccaacaaaatcctacaaagtcctcttgtggctacaacaagatcatattgatccatactcacaaaaagaaatagcattcgaagacatactcacgaaaacagagaaaaccgaaattgatcacataataccatactccatctcatttgacgatagttcatcaaacaaactcctagtactagcagagagcaatcaagcaaaaagtaaccaaactccatacgagttcataacaagcggaaacgcaggtataaaatgggaagattatgaagcatactgcaggaaattcaaagacggagacacgtctttactagattccacacaaagaagtaagaaattcgcaaaaatgatgaaaacagacacatcctccaaatacgatataggcttcctagcacgcaacctaaatgatacccgatatgccacaatagtatttagagatgcattgaaggattacgccaataaccacttagtagaagacaaacctatgtttaaagtagtctgtatcaacggaggagttactagcttcctaagaaagaacttcgacaaaagctggtacgccaagaaagatcgagacaaaaacatacaccacgccgtcgatgcaagcataatcagcatattctcaaacgaaactaaaacactattcaatcaactcacccaatttgctgactataaattattcaaaaatactgacggatcatggaagaaaatagaccctaaaacgggagtcgtaactgaagtaacagacgaaaactggaaacaaatccgcgtaagaaaccaagttagtgaaatagccaaagtaataaacaaatgcatacaagatagcaatatcgaacgtaaagcgagatatagcagaaaaatagagaataaaaccaacatatcactatttaatgacacagtgtattctgcaaagaaagtaggctatgaagaccaaatcaaaaggaaaaatttaaaaaccttagacatacacgaatcagctgaagaaaacaaaaattccaaagtaaagaaacaattcgtctatagaaaattagtaaatgtatcactactcaacaatgacaaactagccgacctattcgcagaaaaagaagacatacttatgtatcgagcaaacccctgggtaataaatttagcagaacaaatctttaatgaatataccgaaaataagaaaatcaaatcacaaaacgtatttgaaaaatacatgcttgacttaactaaagagttcccagaaaaattcagtgaagcgttcgttaaatcaatgctccgaaacaaaaccgcaatcatctataatgtcgaaaagaaagtagtacacaggataaaaagactcaaaattttgtcaagtgaattgaaagaaaataaactgagtaacgtaataataagaagtaaaaacgaaagtggcacaaaattatcctaccaagacacaataaactcaatcgctctaatgataatgcgaagcatagatccaacagccaagaaacaatacatacgcgtacccttaaacactttaaacttgcacttaggagaccaagatttcgatctacataatatagatgcatacctgaagaaacctaaattcgtaaaatatctcaaagcgaacgaaatcggagacgaatacaaaccctggagagtattaacaagtgggaccttacttattcacaaaaaggacaagaaactaatgtacatatccagtttccaaaatctaaaagatgtcattgaaatcaagaatctaatagaaacggaatacaaagagaacgacgattcagaccccaagaagaagaagaaagccaatagattcctgatgacgctatcaacgatccttaacgattacatattgcttgatgcaaaagataactttgatattctaggcttaagcaaaaatcgcatagacgaaatattaaattcaaaacttggattagacaaaataactaaatga

SEQ ID NO: 5233 - RNA, 3810 nt, synthetic construct
  misc_feature 1..3810: note = Cas9 variant
  source 1..3810: mol_type = other RNA
atgaacaatagcataaagtcgaaacccgaagttacaatcggattagacttaggtgtaggatcagtaggatgggcaatagtagataatgaaacaaatatcattcaccatctcggatcgaggctattttcgcaagcaaaaaccgcagaagacagacgcagttttcgaggtgtcagaagattaattcgacgccgcaaatacaaattaaaaagattcgtcaatttaatatggaaatacaattcatattttggattcaaaaataaagaagatatactcaacaactaccaagaacagcaaaaactacacaatactgtattaaatttaaaaagtgaagcattaaacgctaaaattgatccaaaagctctatcctggatactacatgattatctgaaaaaccgcggacacttctacgaagacaatagagactttaacgtttatcccacgaaagaactagcaaaatatttcgataaatatgggtactataaaggaataattgactcaaaagaagataatgacaataaactagaagaagaactaacaaagtataagtttagtaataaacactggttagaagaagtcaaaaaggtcctatcaaatcagacagggctaccagaaaaattcaaagaagagtatgaatcattattctcatacgtacgaaactacagtgaaggcccaggatcaataaactcagtaagcccttacggaatctatcatctcgacgaaaaagaaggtaaagtagtacaaaaatacaacaacatctgggacaaaactatcggaaaatgcaatatattcccagacgagtacagagcaccaaaaaattcaccaatagcaatgattttcaatgagataaacgaattaagtacaataagatcctatagtatctacctaacaggatggttcatcaatcaagagtttaaaaaagcatacctaaataaactactagaccttctcattaaaacgaatggcgaaaaacccatagacgcacgccaattcaaaaaactacgtgaagaaacaatcgccgaatcaattggcaaagaaactttaaaagacgtagaaaacgaagagaaacttgaaaaagaagatcacaaatggaaactcaaaggacttaaactcaacacaaatggtaaaatacaatacaacgacctaagcagcctcgccaagtttgtgcataaactgaaacagcatctgaaattagacttcctattagaagaccaatacgcaacactagacaaaataaatttcctccagagcctgttcgtatacctaggcaaacatttaagatacaataacagagttgacagtgctaacctaaaagaattttcagatagtaaccgcctattcgaacgcgtcttacaagaacaaaaagatggactattcaaactttttgaacaaacagataaagatgatgaaaaaatactagctcaaacacattcactgtcaacaaaggcaatgttactagcgataacacgaatgacaaacctagacaacgacgaagacaatcaaaaaaacaatgacaagggctggaactttgaagcaataaaaaacttcgatcaaaaattcatagatataactaaaaccaacaacaatctatcactcaaacaagataaaaggtatctagatgacagattcattaatgacgccatactctcaccaggtgtaaaacggatcctcagagaagccacaaaagtttttaacgcaatactaaaacaattctcacaagagtacgatgtcaccaaagtcgttattgagctcgcacgagaattgtcagaagaaaaggaactagaaaataacaaaaactataagaaactcatcaaaaaaaactccgacaaaataagtgaagggctcaaagcgctcgacattgcagaagataaaatagaagacatattaaaaagcccaacgaaatcgtataaagtactattatggctccaacaagaccacatagatccatacagccaaaaagagatagcattcgaagacattcttaccaaaacagaaaaaacagagatagaccacataattccctactcaattagctttgacgactcaagttccaataaactactagttctagccgaatccaatcaagcaaagtctaaccaaacaccatatgaatttattacatccggaaacgcaggaataaaatgggaagattacgaagcctattgcagaaagttcaaagacggagacacatcccttttagactccacacaaagaagcaaaaaattcgctaaaatgatgaaaacagatacttcctctaagtatgatattggattcctcgcaaggaacttaaatgatactagatacgctacgatagtattcagagatgcactaaaagactatgctaataaccacctagtagaagataaaccaatgttcaaggtagtatgtatcaacggtggtgtaacaagcttcttgagaaaaaattttgacaaatcatggtatgcaaaaaaagatcgagacaaaaacatccatcacgcagtcgacgcatcaatcataagtatattcagtaacaaaacaaaaactctattcgatcaactaacacaattcgctgactacaaactatttaaaaatacagatggatcatggaaaaaaattgacccgaaaaccggagtagtaaccgaggtaaccgacgaaaactggaaacagatcagagtcaggaatcaagtcagtaaaattgcagaagagattgataaatgcattcaagacagcaacatcgagagaaaggctagatactccagaaaaatagaaaacaaaacaaacataagtttattcaacgacactgtgtactccgccaaaaaagttggatacgacgatcaaataaaaaggaagaacttaaaaacattagatatagacgaatcagttgaagaaaataagaatagtaaagtaaaaaaacaatttgtataccgtaagctagtaaacgtaagcttactaaataacgataaactcgcagacctcttcgcagaaaaagaagacatacttatgtatagagcaaatccatgggtaataaatctagcagaacaaatattcaacgaatacacagaaaatagaaaaataaaatcgcagaacgtattcggaaaatatatgttggacctcaccaaagaatttccggaaaaatttagtgaagcgtttgtaaaatcgatgctacgaaacaaaacagccataatatacaacgtagaaaaaaaagtcgttcacagaatcaaacgtctaaaaattctatcatcagaacttaaagaaaacaaactatccaatgtaatcataagaagcaaaaacgaaagcggcacaaaactatcgtaccaagatacaatcaacagcgttgccctaatgatcatgcgaagtatagatccaaccgctaaaaagcaatacatacgagtacccttaaacacactcaatcttcacctcggcgaccatgactttgacctacacaatatcgatgcatacctaaaaaagccaaagttcgtcaagtacctaaaagccaatgaaataggcgacgaatacaaaccctggagagtcctcataagtggctcactattaatacacaaaagagacaagaaactcatgtatatatcatcgttccaaaacctaaacgatctaatagaaataaaaaatctcatagagaccgaatacaaagaaaatgtagactctgatccaaaaaaaaaaaagaaagcaagccaaatccttagaagtttatctacaatattaaacgactatatactcttagacgcaaaagacaactttgacattttaggtctttctaagaatagaattgacgaaatactaaacagcaaactagatctcgacaaaatcgcaaaatga

SEQ ID NO: 5234 - RNA, 3822 nt, synthetic construct
  misc_feature 1..3822: note = Cas9 variant
  source 1..3822: mol_type = other RNA
atgaagaaaatcctcggtttggatctaggaactaattccataggatgggcacttatagaagtagatgaaaacaattttcccatacgcataatagcaatggggtcgcgaattatacccttaagcagtaatgacaaagacgaatttcaaagaggactatcaataactaaaaaccaaagtagaacagtatcacggacacaaaggaaaggatatgacaggaaacaactaaagaaaagtgatgactttaaatacagtctcagacgaatactgaataaatacaacatctttccgtcagaagaactactaaaacttccaatgctcgatttatggaaacttaggtccgatgcggtaaacccgaatgaaaacatatctgcagaacaattaggtcgaatactatacatgttaaatcagaaaagagggtataaaagtgctagatcagaggccaatgcagataagaaagacacagactacgtactagcagttaaaggtagatatgctcaattaaaagacagaaatcaaaccataggacaatacttttacgaagaattacataacgccaaaaccactaattcatacttcaggacaaaagaagaagtttatccaagagaagcctacatagaagagttcgacacaataatcaatgcacaaaaatcaaaacacgactttctgactgatgaagtagtacaccaattaagaaacgaaatcatatacttccaaagaaaactgaaatcacaaaaaggacttgtatcaatttgcgaatttgaaggattcgagaaaacaatcttcgacaaagaaaaagacaaaaacaaagtagtatttgtgggacccaaagtggcaccgaaaacaagccccttgtttcaactatgcagaatatgggaagtcgtaaacacaatcactctaaaaatcaaaaaccccgaaggctccaaatacaaatggggagagaaaataccaaatataaaagaaaaagaagcactagcggactatttattcaagaatgaaacactatcatttaacaaacttctcgatatacttgaattaaagaaagaaaacgtatacgttaacaaacaaataataaaaggcataaaaggaaatgaaacatacagtgcactccatagaatactgggagacaacgaattattaaaattcgatgtaagcattataccgagcaaccatacatctatgttagttgacaaaaagaccggtgaaatactagaagaacgagcagggctagaactagacgtctctttagaaaaagaacccctataccaattatggcacactatctattccataaaagatctggatgaatgcaaaaatgcgctcattaaaagattcggattcgacgacgaaatagcagaaaaactatcacacctagatttcaacaaacaagccttcggaaataaatcaaacaagtcaatgcgaaaaatactgccttttcttatggaaggatataattacagccaatcatgcacactggcaggatataaccattcaaactcactaactaaagatgaaagagaacaacaagtaaccttagacaaacttgaactactaccaaagaacagcctaagacagcccatcgtagagaaaatactaaaccaaatgataaatgtggtgaacgcaatactagaagaatacggcaaaccctcagaaataagaatcgaacttgcccgagaattaaaacagtccaaagacgaacgacacgacgcagaccttcaaaacagtaaaaataagaaattgaacgaagaaataggcaaaaggctgacagaactcggactgccagtcaccaaaagatacatacaaaaatacaaatttatattcccaagcctcagtaaatctcttaaagatgctcaagtcaataaccaatgtatatactgtggtgaaacctttaacctaactgaagcgttatccggagatgcatatgatgttgaccatatagtcccgaaaagcctcttattcgacgacagtcagacgaacaaagtactggtgcacaggaaatgcaattctacgaagacaaatcaaacggcctacgactacatagcatcaaaaggtgaagaagaagtacaaatatactcagccagagtcgacgattggttcaaaagaggaataataagttattcgaaaatgcaaagattaaaagtaagtcacaaagaatacctcgaaagaaaatccttaaacaaagagactgaaacagacaagaaattatgggaaaacttcatagaccgtcaattaagagatacgcagtacatcagtcgtaaaagtaaagaaatattgcaaaaagtttgtaacaacgtaaccaccaccgaaggaggagtaacggctaaactaagagacttatggggttgggatgacatattaatgaatttacaaatgccaaaatataaagaactaagacaaaccgttataaaagaatggaccagtgaacacggcaaacgaaaacaccaaaaagaagagattgaaaattggacaaaaagggatgatcataggcatcatgccatagacgcgcttgtaattgcatgtactaaacaaggcttcatacagagaatcaatacacttaacagtagcgagaccaaagacctaatgcaacaagaaattaacgaagcaaagaaactactaggagaaaattataaagacaaagaatttgaaaactcaaacgaattagtcaaaaatcacaaaggaaggctctcaaagctagacgactatctaagactacaaaaaccaataaaatttaacaccaaatacgtcgaaaaagaagcagacaaaattctaatatcattcaaagcaggaaagaaagttgccaccataaccaaattcaaagcaactgggaaaaataaagacacaggagtcatagttccccgaggagctctacacgaagcaggactctacggagtaagaacaatatatagcaaaggcggaatagcagaaaaacatattattaaaaagtacaaagtgggagtcagtgcacaagatcacatattcactggaaaagaaagttacagcgtaaagaaagataaaaacggaaacgaaaaagttgacgataaaataaaagtagtcctagacagtatagtagacagtaaagtcaaagaaatcgtcttaaacagactaaatttcggcttttcagacggagaagactacaaaaacaacgtaaagaaagcactcaacaatttcaaaaacctagacgaatatcctctatggtacaacgaaaacaaaggaataaaaattctatccatcaaactaaagacaggattaaaagattccgtagtaccattaagattaaacgaaagtaatgaagtaataacattagtaaaaacaggtaacaaccaccacatagcaatttacgaagataaaaactccaaacctgtccaacactcatgcacattctggcatgcagtagaaagaaagaaatacaacatacccgctgtaatcaagaaatcaagcgatgtatggaaccaactcctagacaaagaactacctgaatcttttctaaacaacttaccagaagacaatttgaatttaaaattcagtatgcaacaaaacgaaatgtttgtactagggttatcacaagaagagttcaaagaagccatagaaaataatgacaaatcattattatccaaatacctgtatctcgtatggtctgttagcgaaaataattattggtttagacaccatttagaaaccaaaaattctgatttaaagaaaacagaaggggcaaaagaaagtaaacgactatacaacattaggtcagtttcatcattgttcagtctaaacccagttaaagttaggttaaaccacctgggagaaataacaaaaattggggaatattga

SEQ ID NO: 5235 - RNA, 3825 nt, synthetic construct
  misc_feature 1..3825: note = Cas9 variant
  source 1..3825: mol_type = other RNA
atgacgaaacacattttaggcttagacctaggaacaaattcgatcggatgggccatcatacaagtagataacaacaacaatgtccccatacaaattatagcaatgggcagccgaattatacctttagactccaacgacagagaccaattccaaaaaggacaagcaatatcaaaaaataaagacagaacaaccgcacggacacaaagaaaaggatatgacagaaaacaacttaaaaaatcagacgacttcaaatactcacttaaaaaaatcttagagaaactcgacatctttccaacagaagaattaatgaaacttccaaccctagacctctggaaactccgatcagacgctgtctcgaacatagaagatataacacccaaacaattaggaagaatcctttacatgttaaaccaaaaaagaggatacaagagtgcgcgctcagaggcaaatgctgataaaaaggataccgattacgtcgcagaagtaaaaggaaggtatacacaactaaaagacaaaggccaaacgcttggtcaatacttctacaaagaactcagcgacgctaaccaaaacaatacgtattatagagtaaaagagaaagtatacccaagagaagcatatatcgaggaattcgacgctattatcaacgtacaaaaaagtaaacacagcttcctaacagatgaagtaatccactcattacgaaacgagataatttactatcaacggaaactcaaatcgcagaaaggtctcgtttccatatgtgagttcgaaggatttgaaactacgtactttgacaaaaaaacacaacaagataaaacaatcttcaccggccccaaagttgctccaagaacaagcccactcttccagttttgtaaaatatgggaagttgtcaacaatataagtttaaaaacgaaaaatccagaaggttcaaaatacaaatggagcgacagaataccaaccatagaagaaaaacagacaattgccaactacttacaagaaaatgaaaatctgagtttcattgaactcttaaaaattctgcagctcaaaaaagaacaagtttacgccaataagcaaatactgaaaggaatacaaggaaacacaacctttagcgccatacacaaaatcataggaaacagtgaacacttaaaatttgatatcgaaacaataccatcaaagcactttgcagtccttgttgacaaaaaaaccggggaaattttagacgagagagacagtttagagctcaattcagcactggaacaggaaccattctatcaactttggcatacaatctactctataaaagacctagacgaatgtaaaaaagccctaataaaaagatttaacttcgaagaagagatagctgagaagttaagtaagattgatttcaataagcaagcttttggcaataaatctaataaagccatgagaaaaatgctaccatatttaatgctaggctataaccaatcagaagctgaaagctttgcaggttacaaccgtcgactaactaaagaagaaaaatccaaaaacgtatcggatgaaccactacaacttctcgccaaaaactccttaagacaaccagtggttgaaaagattctaaaccagatgataaacgtagtcaacgcgatcattgaaaaatatggcaaaccagaagaaattagagtagaactagcacgagaacttaaacaatccaaagacgagcgcgaagatgcagataaacaaaacggttttaacaaaaaactaaatgaattagtagctacaaaactaacggaattaggtttaccaacaactaaacattacatccagaaatacaaattcatatttccagcgaaagacaaaaattggaaagaggcacaggtcgccaatcaatgcatatactgcggcgatacattcaaccttacagaagcactctcaggagacaacttcgatgtagaccacatcgtaccaaaagcacttctattcgacgacagccaagcgaacaaagtcttagttcaccgaagctgtaacagcacaaagaccaacaacacagcatatgactacataacaaaaaaaggcagccaagccttgaacgattatgtagctagggtggacgactggtttaaacggggtattataagttacgggaaaatgcaaagattaaaagtatcatttgaagaataccaagaacgtaagaaaatcgggaaagaaacagaagctgataaacggatatgggaaaacttcatcgacagacaactaagagaaaccgcatatatagctaaaaaagcgaaagaaatactggaaaaagtatgtcataacgttacatctacagagggtaacgtcacagcaaaattgagacaactatggggatgggacaacgttctaatgaacctccaattaccaaaatataaggaattagagaaaaaaacaaaacaaacatttacgcagctaaaagaatggacttcagaccacgggaacaggaaacaccaaaaagaagaaatcataaattggacaaaaagagatgatcacagacaccacgctatagacgccttagtaatagcttgcacgcaacagggttttatacaaagaataaacacccttagttcctcagacgtcaaagatgaaatgaaaaaagaactagaagaagacaaaacagtttataatgaacgtctgactctccttgaaaattacttactagaaaaaaaaccattttctacagaagagatcgaaaaagaggcagacaaaatactcgtgagttttaaagcaggaaaaaaagtagcaaccttatcaaaatataaagcaacaggtataaacgaaatcaaaggagtactagttccaagaggaccacttcacgaacaaagcgtttacggaaaaataaaagtaattgaaaaggacaaacctttaaaatacctatttgaaaacagtgataagatagtaaacccattaataaaacacctagtaaaaacacgattgctggaaaatgaaaataatgcccaagcagcattagtaacattaaaaaataaaccaatactattaaataacaaacaaacagaaatcctcgaaaaagccagttgctacaatgaagcgactgtactcaaatataaactccagagcctaaaagctagtcaaatagatgatatagtggacgaaaagataaaatttttaataaaagaaagactaagcaaattcggaaataaggaaaaagaagcatttaaagatatactctggttcaatgaaaaaaaacaaatacctattacatcaataagactatttgcacggcctgacgccaataatctccaagtcataaaaaaacacgaaaaaggtaaaaacataggtttcgtcttaagcggtaacaatcatcatattgccatatacgaagataaaaataacaaattaatacaacatatctgtgacttttggcacgcagtcgaaagaaaaagaaacaacataccagttttaatagaagacacaagtacaatatggaatcacctaataaacgaagattttagtgaaagttttctaaacaaattacctaacgactcactaaaacttaaattctctttacaacaaaacgaaatgttcatattaggactacctaaagaacaatccgaagaggctattaaatcaaataacaaaagcctcctatcaaagcacctatatttagtctggagtattaccgatggtgactatttctttagacatcatcttgaaacaaagaacacagaattaaaaaaaatagatggctcaaaagaatcgaaacgatatcttagactatcgacaaaatccttagtcgacctaaatccaataaaagtacggctaaaccatttaggagaaataacaaaaattggagaatga

SEQ ID NO: 5236 - RNA, 3846 nt, synthetic construct
  misc_feature 1..3846: note = Cas9 variant
  source 1..3846: mol_type = other RNA
atggaagatgacagccagcatgatattagagaaatatacttagcaatacatcatatggtaaaatatagaggaaattttctagttgaaggaacactagaaagtagtaatgcgtttaaagaagatgaattacttaaactcctagggaggataacacgttacgaaatgagcgaaggagaacaaaacagtgacatagaacaagatgacgaaaataaactggttgctcctgcaaatgggcaactcgcagacgccctatgtgcaacaagaggcagtaggagcatgagagtagacaatgcattagaggctttatcggcggtaaatgatctatcacgagaacaaagagcgatagtaaaagctattttcgctggtctggaagggaataaattagacctagcaaaaatatttgtaagtaaagaattttcgagcgaaaataagaaaatactaggaatatattttaacaaaagcgattatgaggaaaaatgtgtacaaatagtagactctggactgttagatgatgaagaaagagagttcctagatagaatgcaaggacaatacaacgccatcgcattaaaacagctattaggaagaagcacctcggtcagtgacagtaaatgtgctagttatgatgcacatagggcaaactggaatttaataaaacttcaattaaggacaaaagaaaacgaaaaagatattaatgaaaattatggaatattagtaggatggaaaattgatagtggccaacggaaatcagtaaggggtgagagtgcttacgaaaatatgagaaagaaagcgaatgtatttttcaagaaaatgattgaaacgagcgacctctcagaaactgataaaaacaggttaatacacgatatagaagaagacaaactattccctatccagagggacagcgataacggggttataccccaccagctacatcaaaatgagctcaaacaaataattaagaaacaaggaaaatattatcctttcctattagatgcattcgaaaaagatgggaaacaaatcaacaaaatagaaggactccttgcattccgagtaccgtattttgtcggaccgctagtcgttccagaagacttacaaaaatcagataattcagaaaatcattggatggttagaaagaagaaaggagaaattaccccgtggaattttgatgaaatggtcgataaagatgcttccggtcgcaaatttattgaaagattagtgggaacggattcgtatttactcggagaaccgacgctacctaaaaacagtctactgtaccaagaatatgaggtattaaatgaactaaataatgtcagactaagtgtaaggactggcaatcattggaacgataaaagaagaatgaggttgggaagggaagagaaaacgctattatgtcaaaggttatttatgaaaggacagacagttacaaaaagaacagcagaaaacttgctaagaaaagagtatggccgtacttacgaactatcagggttatctgatgagtcaaaatttacgtctagtctgtcgacatatggaaaaatgtgcagaatatttggggagaaatatgttaacgaacacagggatctaatggagaaaatagtagaattgcaaacagttttcgaagacaaagaaacgttactccaccaacttcgacaactagaaggtataagtgaagcagactgcgcactattggtaaatactcattatacaggttggggtagactgagcagaaaattattaactactaaagctggtgaatgcaaaattagtgatgattttgccccacgaaaacattcaataatagaaatcatgagagctgaagatagaaatttaatggagatcataactgataaacaattgggtttttctgactggatagaacaagaaaatttaggtgctgaaaatggaagttcactgatggaagtggtagatgacctaagagtatctccaaaagtgaaacgaggaataatacaaagtataagactaattgatgatataagcaaagcagtaggaaaaagaccttcacgtatcttcttagaattagctgacgatatacagccctcaggcaggaccatatcaaggaaaagcagattacaagacctatatcggaatgcaaacttaggaaaagaatttaaagggatagctgacgagttaaacgcatgtagtgataaagatctacaagatgacagactattcctatattacactcaattaggaaaagatatgtatactggagaggagctagatttagatagactctcaagcgcttatgatatagaccacataataccacaagctgttacccaaaacgatagtatagataatcgcgttttagtggcgcgggcagaaaatgcaaggaaaactgattcatttacgtatatgcctcaaatagcagatagaatgcgcaatttctggcaaatattattagataacggattaattagcagagtaaagttcgaaaggttaacacgtcaaaatgaattttcagagagagaaaaagaaaggtttgtacaacgatcattagtagaaacacgacaaatcatgaaaaatgtagcaacactaatgcgacagaggtatggtaatagcgcagcggttataggattgaacgctgaacttacaaaagaaatgcatcgatacttaggtttctcacacaaaaatagggatataaatgactatcatcatgcacaagatgcgctttgcgtaggaatcgcaggacaatttgcggctaatagaggattctttgcagatggcgaagtatcagatggtgcgcaaaattcgtataatcaatatctcagagattatttacgaggttatagagaaaaactgagtgcggaggataggaaacaagggagagcctttggatttatcgtgggatccatgagaagtcaagacgagcagaaaagagtaaacccaagaaccggagaagtcgtatggagcgaggaagacaaggattatttaagaaaagtgatgaattaccgaaaaatgctagtcactcagaaggttggtgatgactttggtgcactatatgatgaaacacggtacgcagcaacggatcccaaaggtataaaaggaataccgtttgacggtgcaaaacaagatacaagtttatatggaggattcagcagtgcgaaaccggcatacgctgttttaatagagagtaaaggaaaaactaggctagtaaacgtaacaatgcaagaatatagtctactaggagacagaccgagtgatgacgaattaagaaaagtgctagctaaaaagaaaagcgaatatgccaaagcaaacattctattaagacacgtaccaaaaatgcaactgattagatatggagggggattaatggtaataaaaagcgccggggagctaaataacgcacaacaactatggttgccatatgaggagtactgctactttgatgatttaagccagggcaagggctctctggaaaaggacgacttgaagaaattattagatagtatattgggatcggttcaatgcctctatccctggcatagatttacggaagaagaactagcagacttgcacgttgcatttgataaattaccggaagatgaaaagaaaaatgtcataacaggaatagtaagtgcattgcatgccgatgcaaaaacagcaaatctaagtatagtaggcatgacaggaagttggaggcggatgaacaacaaaagtggatatacattcagtgatgaagatgaatttatattccaatcaccgagcggattatttgaaaaacgagtgacagtaggagaacttaaacgaaaagcaaagaaagaagtcaattccaaatacagaacaaacgaaaaacgattacctacattaagcggtgcatcgcaaccatga

SEQ ID NO: 5237 - RNA, 3861 nt, synthetic construct
  misc_feature 1..3861: note = Cas9 variant
  source 1..3861: mol_type = other RNA
atgaccaaaaatattttaggtttagacttaggaacaaatagcataggctgggcattaattgaagttgatgaaaataatacaccaatacgaatcatcgcaatgggaagccgaataataccactaagtactagcgacaaagaagaatttcaaagaggactatctataaccaaaaaccaatctcgcacagtctctcggacacaacgaaaaggatatgacagaaaacaacttaaaaagagcgacttaaagaaaatattgaacaaatataacatcttcccatcagaggaacttcttaaactaccaatgctagatctatggaaattgaggtcagattcagctaacccaaacgaaaatataagcgccgaacaactaggaagaatcctttatatgctcaaccagaaaagaggctacaaatcagcaagatcagaagcaaatgccgacaagaaagatacagactatgtccaagcagtaaaaggaagatatgcacaattaaaagagagaaaccaaaccataggacaatacttctacgaagaattatacaacgcaaacacaaataattcttactttagaattaaagaagaagtatacccaagagaagcctacaccgaagaatttgatacgatcattaatgcccagaaaaacaaacacgatttcttaacagatgaagtggtacatcaactcagaaatgaaataatatacttccaacgaaaactcaaaagtcaaaaaggtttagtatcaatatgcgagttcgaaggttttgagaaaacagtatttgataaagagaaaaataaagacaaggttgtatttgtgggatcaaaagttgcaccaaagacaagtccactatttcaactatgcagaatatgggaagtcgtcaataccatttcgttaaaaatcaaaaatcctgaagggtcaaaatacaaatggggagagaaaacgccaaacctaaaggaaaaagaaatactagctgattatttattcaaaaatgactcactatcattcacgaaattactcgaaatcctcgacctgaacaaaaatgacgtatatgtaaataagcaaatactaaaaggcataaaaggcaatgaaacttttagtgctctgcatacagtattgggagataatgaattactaaatttcgatgtttcaataataccatccaatcacacctcaatgctcgtagacaagaaaaccggagaaattttggaagaacgagccggattagaattagacgcatcgctagaaaaagaaccactctatcaattatggcacacaatttatagcctaaaagttctagatgaatgcaaaaacgcactgataaaaagatttggcttcgatgacgaaacggccgaaaaactatctcatatagacttcaataaacaagcattcggaaacaagagtaataaatctatgaggaaaatactaccatttctgatggaaggatatgattattcgcaaagttgctcacttgcaggatataaccactcaaatagcctaacaaaagacgaacgagaacaacaaataacactagaccgactggaactactttccaaaaacagtttgagacagccaatagtagaaaagatattgaatcaaatgattaacgtagtgaacgctatcctagaacaatatggcaaactatctgaaataagggttgaactcgcacgagaactaaagcaatcaaaagatgaaaggaatgatgcagatctacaaaattctaaaaacaagaaactcaatgaagaaattggaaaacgcttagccgaactagggctaccagtaaccaaaagatatatacaaaaatacaaatttatattcccgtcattaagcaaaaacttaaaagatgcccacgttaataatcaatgtatttactgtggcgaaaccttcaacttaactgaagcactctcgggtgatgctttcgacgtagaccacatagtccctaaagcactgctatttgacgattctcaaacaaacaaggtacttgtacatcgaaagtgtaactcgactaaaactaatcagaccgcatacgactatatagggactaaaggagaagaacaagttcgaatatacagcgaaagagtagacgattggtttaagagaggcataataagttattcaaaaatgcagcgattaaaagtttcacataaagaatatctagaaagaaagaaattaggaaaagaaacagaaaccgacaagaaattatgggaaaattttatagatcgacaattgcgagatactcaatacataagtagaaaagcacgagaaattttgcaaaaagtttgcaacaacgtaacaaccacagaaggcggtatcacagcaaaactaagaaacttatggggatgggatgacgtccttatgaatctacaaatgccaaaatacaaagaacttggacaaacagtcatcaaagagtggacctcagaacacggtaaaagaaaacaccaaaaagaagaaatagagaactggacaaaacgagacgatcatagacaccatgctatcgatgccctagtagtcgcttgtacaaaacaaggattcatacaaaggatcaatactttaaactcctcagataccaaagatcttatgcaaagagaaatcaaagaagcaaagaaacttctaggtgaaaactacaacgagaaagaatttgaaaacgacaatgaatttgttaaaaaccataaagaaagactgtcccaattagatgactacttaaggttacaaaaacccgtaaaatttgacacaaaatatgtagaacaagaagcagataaagtattagtgagcttcaaagctggtaagaaagtagcgactataacaaaatttaaagcaacgggtaaaaacaaagacaccggagtaatagttttacgaggagctctacacgaacagtcagtgtacggaaaaattaaagtaatcgaaaaagataaaccgttaaaatatctttttgaaaattccaagaaaatagtaaaccccaaaataaaagttttagtggaggaacgtttagcagaaaatgaaaacaattccaaattaagtttatccaccctgaagaaaaacccaatattccttaacgaggagaaaaccgaaatactggaaaaagcctcctgctacaacgatgccacagtcctgaaatacaaactccagtcattgaaagcatcacaagcggatgatatagtagatgacagagtgaaattcctagtaaaagaaagattggcacaatttggaaacaaagaaaaagaagcattcaaagacaccctttggttaaacgaagaaaaacaaataccaattataacagtacgattatttgctagaccagacgcaaacaatttacaagccattaagaaagataaaaatggcagagacataggatttgtactaaccgggaataaccaccacatagcaatatacgaagacaaggacaataaattagtacagcatagctgcacattttggcatgctgtcgaacgcaagaaaaacaacgtaccagccgtaatcaaaaactctagtgatgtatggaaccagctattggacaaagaattaccagaatcatttttgaacaaactaccaatagacaaacttaaactcaaattctcgcttcaacaaaacgaaatgttcgtattgggattgctacaagaagattttgaagcagccatagaaaataatgataaaaccttactcagtaaacatttatacctagtttggagcataaccgacggcgactatttctttagacaccacctagaaactaaaaatacagaacttaagaaaactgaaggagcaaaagaatccaaaagatactttcgattatccacaaaaggactaatcgacctaaatccagtaaaagtaagacttaaccacctaggagaaatcacaaaaataggtgaatattga

SEQ ID NO: 5238 - RNA, 3864 nt, synthetic construct
  misc_feature 1..3864: note = Cas9 variant
  source 1..3864: mol_type = other RNA
atgaaaacagtcctaggattggatttaggtacaaactctataggctgggcattaatagaattagacgaaaataacatacctattcgaattgtagcaatgggctcacgaattataccactttcaacttcagacaaagaagagttccaaagaggacttagtataaccaaaaaccaatcccgaacggtaagccgaacacaacgaaaaggctacgacagaaaacaactaaagaaatcctacttaaagaaaatactaaacaaatacaatatattcccgtccgatgaattgctaaaactcccgatgttagacttatggaaacttagaagcgatagcgcaaacccaaatgaaaacatcagtgccgaacaactaggcagaatcctctacatgttaaaccaaaaacgaggctataaatcggccagaagcgaagccaacgccgataagaaagacacagactatatccaagcagtcaaagggcgatacgcccaattaaaagatagaaatcaaaccattggacaatacttttacggagaattaaatgacgctaacgaaaacaattcttatttccgaataaaagaagaagtctatcctagggaagcatatacagaagagttcgacacgatcataaacgcacagaaagacaaacatgactttttaaccgatgaagttatacaccaactgcgaaacgaaataatctacttccaacggaaattaaaaagccaaaaaggcctagtatcaatctgcgaatttgaaggattcgagaaaactgtattcgacaaagagaaaaacaaagacaaagtcgtttttgtcggaccaaaagtagcacctaaaacctccccattatttcagttatgtagaatctgggaagtagttaataccataacactaaaaatcaaaaaccctgaaggaagcaaatataaatggggtgagaaaataccagacgtcaaagaaaaagaaattttagcagactacctcttcaaaaatgaaagtctatcttttacaaaattactagaaatcctcaaactcaataaaaataacgtttactttaataaacagatacttaaaggaataaaaggtaacgaaacatatagcatattgcactccatacttggggattctgaactactaaatttcgacgttagcataataccatcaaatcatacatctatgttaatcgacaagaaaacaggcgaaatcttagaagaacgtgcgggattagaacttgatacatctcttgaaaaagaacctttaaatcaattatggcacacaatttactcaataaaagatctcgacgaatgcaaatcagcgctaataaaacgttttggattcgatgacgaaaccgctgacaaattgagtcgcatagattttaataaacaagcgtttggaaacaaaagtaataaatcaatgagaaaaatattaccatttctaatggaaggctatgattactcacaatcttgtagcctagccggttataaccactccaatagctttaccaaagatgaacgagaacaacaaataacattagataaattagaactactccccaaaaactcattacgccaaccaatcgtagagaaaattttaaaccagatgataaatgtcgtaaacgctatcctcgaaagatacggtaaaccaagcgaaataagagtagaactagctagagaactaaaacaatctaaagatgaacgcaacgacactgatcttcaaaattctaaaaataagaaactaaacgaagaaataggcaaaagactcgcggaacttggactaccactaaccaaaagatatatacaaaaatacaaatttatatttccatccttaagcaaaaacctaaaagacgcacatgtaaacaaccaatgcatatattgcggagaaacatttaacctaaccgaagcactttcgggagatgcatttgatgttgatcacattgttccgaaagcattactattcgacgattcacaaacaaataaagttctagtccatcgaaaatgcaacagcacaaaaacaaaccaaacagcctacgactatattgccacaaaaggagatgaacaagtcagagtatactctgaacgcgtggatgattggtttaaaagaggaatcataagttacagcaaaatgcaacgtctaaaagtctcccacaaagaatacttagaacgaaagaaactaggaaaagaaactgaaacagacaagaaactctgggaaaactttatagatagacaactaagggatacccaatacataagccgaaaatcacgagaaattttacaaaaagtctgcaacaacgtagcaacaaccgaaggcggagtaacagcaaaattaagaaatctctggggatgggacgacgtactaatgaatctacaaatgccaaagtacaaagaactaggacaaacagtagttaaagaatggacatcagaacatggcaaacgaaaacatcaaaaagaagaaatagaaaactggacaaaacgcgatgatcatcgccatcatgcgatcgacgcattagtcgttgcatgtacaaaacaaggattcatacaaagaataaatacacttaactcatcagaaacgaaagacctcatgcaacaagaaattaaagaagccaagaaactattaggagaaaactacaatgaaaaggaatttgaaaacaacaacgaatctgttaaaaaccacaaagaacgcctctcacagctcgacgactacttaaggctacaaaaaccagtaaaattcgacacaaaatatgtagaacaagaagctgataaagtattagtatcattcaaatcaggtaagaaagtagctactataactaaattcaaagccacaggtaaaaataaagatacaggcgtaatcgtaccacgcggcgccctacacgaacagaacgtatacggcaaaattaaagtgatagaaaaagataaatcacttaaatatctctttgaaaattcagagaaaatagtaaacccaaaaatcaaaaacatagtagaaattatactatctgaaaacgaaaacaacagtaaaatggcattaagcactctcaagaaaaatccaatttttctaaacgaagaaaagacagacttattagaaaaagcgtcctgctatgaatacgtaacagtgagaaaatatccactaaatacgattaaagcaagccaagcagacgatatagtcgatgaaagagtaaaattcctagtcaaagaacgtcttacacaatttggcaataaagaaaaagaggcttttaaagacacattatggttcaatgaagaaaaacaaatccccataattacagtccgactctttgctaggcctgacgcaaataacctgcaggctattaagaaagacgaaagcggaaaagaaattggtttcgtagtaatgggaaataatcaccatatagcaatttatgaagataaagacgggaagctagtacaacattcatgcacattctggcacgccgtagaaaggaagaaatacaacatatccacggtcatcaaaaactcatcagacgcatggaaccaattcttggacaatgaactgccagagccatttttaaataaattaccagcagacaatctaaatctaaaattcagtctacaacaaaatgaaatgttcatattagggctatcgcaagaggaatttgacaaagcattaaaatcgaatgataaaagcctgttatccaaacacctctacttggtatggtctatttctgaaaacaattattggttcagacaccatttggaaaccaaaaactcggacctaaagaaaacaaacggcgtaaaagaaagtaaaagactatataatatacgaagtctgggaagtttattttctctaaaccctataaagataagactcaatcacttaggagaaatcactaaaataggcgagtactcatga

SEQ ID NO: 5239 - RNA, 3867 nt, synthetic construct
  misc_feature 1..3867: note = Cas9 variant
  source 1..3867: mol_type = other RNA
atgcgtttatttgaagaaggacatacagcagaagacagacgactaaaacgaacagctcgaagaagaatatcccgccgccgtaacagattaagatacctgcaggccttctttgaagaagctatgacagacctagacgaaaatttcttcgcacgattacaagaatctttcctagtacccgaagataagaaatggcaccgtcatcccatatttgctaaactcgaagacgaagttgcataccacgaaacttatccaacaatataccacttaaggaagaaattagcggattcatcggaacaagcagacttaagactcatatacctcgcactcgcccatatagttaaatacagaggacacttcttaatagaaggcaaactgtctaccgaaaatacttcagtaaaagatcaattccaacaattcatggttatttacaaccaaacgttcgtaaatggagaaagtagattagtatcagcgcccttacctgaatctgtgttaatcgaagaagaactaacagaaaaagcatccagaacaaagaaaagcgaaaaagtactgcaacaatttccacaagaaaaagccaatggcttattcggccaatttttaaaactaatggtaggtaacaaagcagacttcaagaaagtattcggactagaagaagaagcaaaaataacgtatgcatccgaaagctatgaagaagatttagaagggatcctagcgaaagtaggcgatgaatacagcgacgtattcctagcagcgaaaaacgtatatgatgcagttgaattatcaacaattctagccgacagtgacaagaaatcacatgccaaattatctagcagtatgattgtaagattcaccgaacatcaagaagacctcaagaaattcaaaagattcataagagaaaattgcccagatgaatacgataacctatttaaaaacgaacagaaagatggttacgcaggatacatagcacacgcaggaaaagtttcccaactaaaattttatcaatacgtcaagaaaattattcaggatatagctggagccgaatacttccttgagaaaattgcacaagaaaacttcctacggaaacaaagaacttttgacaatggcgtaatccctcaccaaatccacttagcagaactacaagccataattcataggcaagcagcatattaccctttcttaaaagaaaaccaggagaaaatagaacagttagtaacatttagaataccatactatgtaggtccactatctaaaggagacgcatccacattcgcatggctaaaaagacaatcagaggaaccaattaggccctggaacttacaagaaacagtagatcttgaccaatctgcgacagcatttatcgaaagaatgactaactttgatacatacttgccatccgaaaaagtgctaccgaaacattctttattatatgaaaaattcatggtattcaacgaactcacaaaaatatcatatacagacgatagaggtatcaaagcaaatttctcagggaaagaaaaagagaaaattttcgattatctctttaaaacccgcaggaaagttaaaaagaaagacataatacagttctaccgaaacgaatataatacagaaatagttacgctatcaggattagaggaggaccaattcaacgccagcttttctacctatcaagatcttttaaaatgcgggctgacaagggcagaactcgatcacccagacaatgcagaaaaattagaagacatcataaaaatactaaccatcttcgaggatcggcaaagaataagaacacaacttagcacattcaaaggccaattttcggcagaagtactgaagaaacttgagaggaaacactataccggttggggacggttatctaagaaactaataaacggtatttatgataaagaatcaggcaaaaccatattagattacttagtaaaagacgatggcgtatcaaaacactataatcgcaattttatgcaattaattaatgattcacaactatcctttaaaaacgcaatacaaaaagcacaaagctccgaacacgaagaaacgctatcagagacagtaaatgaactcgcagggtcaccagcaatcaagaaagggatttatcaatcgctaaaaatagtagatgaattagtagcaattatggggtacgccccaaaaagaatagtagtggaaatggcaagggaaaatcaaacaacaagtaccggtaaaagaagaagcattcaaagactcaaaatagtggaaaaagctatggcagaaattggcagtaatctgttaaaagaacaaccaactactaatgaacaattaagagatacaagattattcctatattacatgcaaaacggcaaagacatgtatacaggtgacgaactctccttacatagattatcacattacgacatagaccatataattccccagtcctttatgaaagacgattctctagacaacttagtattagttggctccacagaaaacagagggaaatcagatgacgtccctagtaaagaagtagtaaaagacatgaaagcatactgggaaaaattatatgctgccggactcatatcacaaagaaaattccaacgcctaactaaaggtgaacagggaggactaactctcgaagacaaagcgcacttcatacaaaggcaacttgtcgaaacacgacaaatcaccaaaaacgtagccgggatacttgaccaaagatataatgctaaatctaaagagaagaaagttcaaattatcaccctaaaagcctctttaacttcacaattcagatccattttcggcctatataaagttcgagaagtaaatgattaccaccatgggcaagacgcttacctaaattgcgtagttgctacaacattactaaaagtctaccctaacctagcccccgagttcgtctatggtgaatatcctaaattccaaacatttaaagaaaacaaagcaacagcaaaagcaataatttatacaaacctcttacgctttttcacagaagacgaaccgagattcactaaagacggagaaatcctatggtccaattcatacctcaaaactatcaagaaagaacttaattatcaccaaatgaatatagtcaagaaagtcgaagtccagaaaggcggtttcagcaaagaatcaataaaaccaaaaggtcccagtaataaactaataccagtcaaaaacggtctagacccacaaaaatacggagggttcgacagccctgtagtagcatatactgtcctttttacacacgaaaaaggcaagaaaccactaataaaacaagaaatacttggaatcaccataatggagaaaacaagatttgaacaaaatccgatcctattcctagaggaaaaaggtttcctgagaccaagagtattaatgaaactccctaaatacacattatacgagttcccagaaggtagaagaaggttactggcatccgcaaaagaggctcaaaaaggcaatcaaatggtcttaccagaacacttactcactctattgtaccacgccaaacaatgcctcctaccaaatcagtccgagtctctagcatacgtcgaacaacatcaacccgagttccaagaaatcctcgaaagagtagtcgatttcgctgaagtgcacacactcgccaaatcaaaagtacaacaaatagttaaactatttgaagctaatcaaactgccgacgttaaagaaatcgcagcatctttcatacagctaatgcaattcaatgcaatgggtgccccaagtacttttaaattctttcaaaaagacatcgaaagagccaggtatacgtctattaaagaaatctttgatgcaacaataatataccagagccccacaggattatacgaaacaagaagaaaagtagtcgactga

SEQ ID NO: 5240 - RNA, 3903 nt, synthetic construct
  misc_feature 1..3903: note = Cas9 variant
  source 1..3903: mol_type = other RNA
atgtggggagtttcactatttgaagccgggaaaaccgccgcagaacgtaggggttatcggagcacacgaagaagacttaatcacaggaaattccgtttacgacttttagaagacatgttcgaaaaagaaatattatcaaaagatccaagtttcttcataagattgaaagaggctttccttagcccaaaagacgaacaaaaacaattcaaaggaaacatattattcaacgacaaagactataccgatgcagactactacgaacaatacaaaaccatctatcacttacgttacgatttaatatcacaacatcgccaattcgatatacgcgaagtgtacctggcgatacaccacctcataaaatacagaggccactttatatacgaggaccaaacatttactactgacggtaaccaacttcagcatcatataaaagcaataatcacaatgatcaattccacattaaaccgcatcatcataccagagactatagatataaacgtattcgagaaaatccttctagaccgaatgatgaaccgctcgagtaaagtaaaatttctaatagaactaactggagaagacaaacaagataagcccttactcaaagaactgtttaacctcatcgttggactaaaagccaagccagcatctatcttcgaacaagaaaaccttgcaacaatagtcgagaccatgaacatgtcaacagagcaagtgcaactagatctcctcactctagcagacgttcttgccgacgaggaatatgacttacttctaacagcacagaaaatatattcagcaatcatccttgacgaatcaatggatggatatgaatattttgcagaagcaaagaaagaatcatatagaaaacaccaagaagaacttgtattagtaaagaaaatgctcaaatcaaacgctataacaaacgatgagagagcaaaatttgaatacttctacacagactatatcggagcaaaatcaagcaactatgaggaatctaaaaacatcaagaaaggccttagtgccgcatacgggaaatatagcaaagaagaaaggttattcaaacatatagaattactactagctaaagaaaacgtccttacaactgtagaacatgcactcttagagaaaaatataacattcgcttccttactacctctccaacgttcgtctagaaacgccgtaataccataccaagtccacgaaaaagaattagttgctatcttagaaaaccaagcaacatactatccattcttactagaacaaaaagacaatatacacaaactgcttacgtttagaatcccatattacgtcggaccacttgcggaccaaaaagacagtgagttcgcctggatggtacgaaaacaagctggtaaaatcacaccatttaacttcgaagaaatggtcgatattgacgcaagctcagaagcatttataaagcgaatgactaataaatgtacatacttaattcacgaagacgtaataccaaaacattccttctcatacgcaaaatttgaagtcctaaatgaactaaataaaatacgacttgacggaaaaccaatagatatcccattaaagaaaaggatttttgaaggactatttctcgagaaaacaaaagtaacacaaacatcactgaagaaatggctagcagaacacgaacacatgacagtctcagttgttcaaggcacacaaaaagaaacagaatttgctacatcactccaggcgttccaccgatttgtgaaaatctttgatcgcgaaacggtatcaaacccagcaaatgaagaaatgttcgagaaaataatatattggtcaacagtttttgaagacaagaaaataatgagaagaaaactatcagaatatccacaattaaccgaacagcaacaagtacaattagcacaagtacgatttagaggctggggaagactatcgcaaagattaattaacagaatcaaaacgccagtctctggagacgaagaccataaattatcgataaacgaaatcttatggcaaacaaacgaaaacttcatgcaaataatacgaaacaaagactatctattcaagaaaataatagaagaacaattcgaaaacgaaaccgcattgctcaataaacaaagaatagacgaactagcagcgtcacccgccaacaagaaaggaatatggcaagcaataaaaatcgttaaagaactagaaaaagtcctacaacaacccgcggaaaacattttcatagagttcgctagatcagacgaagaaagtaaacgaagtaccccaagagacaaattcatagaaaaggcttatgctcaactaaagaaagaaacggatacattcaacttagaacacctaaaagaattaaaacagcgaagtaaacaactaagtagccaacgattatttctatactttatccaaaacggaaaatgtatgtattcaggcgaacaccttgatatagaacgactcgactcttatgaagtcgaccatatcctccctcaatcctacataaaagacaactccatagaaaacttggcactggtcaagaaagttgaaaaccaacgaaagaaagactctttactactcaatagttcaataattaaccagaattattccagatgggaacaacttaaaaatgcaggactaataggagagaagaaatttagaaacctaacaagaacaaaaatcacagacagagataaagaaggattcatagccagacagctagtagaaaccagacaaatcacaaaacacgtcacacaactactacaacaagaatataaagacacaacaaaagtattcgcgattaaagcaacattagtctcaggccttcgaagaaaattcgagttcatcaaaaacagaaacgtaaatgactatcatcacgcccaagacgccttcttagttgcattccttggtacaaacatcacatcaaactacccaaaaatcgaaatggaatatctttttaaaggttaccaacattacctaaacgaagtaggcaaaagtgccgctaaaccaaaatttacattcatagttgaaaacctcagtaaacaacaatacaactcaacgacaggagaagttaaatggaaccctgaagtcgacatagcaaaattaaaacgcatactcaacttcaaacagtgtaacatagtacgtaaagtagaagaacaatctggagcactctttaaagaaacaatatatccagtcgaagaatctagttctaaaaccataccactgaagaaacacctcgacacagccatatatggtggctacactgcagtaaattatgcatcttatgcactaatacaatttaagaaaggtcgaaaattaaaacgagaaatcatcggcatcccactagctgtgcaaacacgcattgataacagcgaaacatcgttacaagcatatattgcagaacaaatcaaatcagaagtagaaatattaaacggccgcatacttaaatatcaattaatcagcaataatggaaatcgactttatatagcaggaccatcagagcgacacaatgccagacaattaatagtatcagacgaagcagcaaaagtaatatggctaatctcaacaaaacaggccgacgaagcaatgttcctaaaatattatagattagagcacctcgaagccgttttcgaagaactcatacgaaaacaagccgcggattatcaaatctttgaaaaactaataaagaaaatcgaagtaaacaaagtttacttttatagctgcacatacaacgaaaaagttaaagtaatagaagaactactaaaaataacacaagccaacgcaacaaatggagacctcaaactgctcaaaatgtcaaatcgcgaaggacgactcgggtcagtttcagtagccctggactttaaaataatcaaccaatcagtaaccggattatatcagtcaatcgaagactataacaactga

SEQ ID NO: 5241 - RNA, 3930 nt, synthetic construct
  misc_feature 1..3930: note = Cas9 variant
  source 1..3930: mol_type = other RNA
atgggatctgtggggttcgctggaattgataaccaatataacttagttagaaccaaaggaaagaatgtaataggagtcaggttgtttgacgaagccgattccgcagcagaacgccgaggacatagaacaaataggagaaggctacaaagaagaagatggcgcttacgcttactcgatgacatattcgcaaaaccactacaagcagtagacccaaatttcttagcacgccttaaatattcatatgtaaataaaaaagaccagggacaacaggaccattactatggcggatatgtttttggaagtaccgccgcagatcaagcataccaccaagcctacccgaccatataccacctaaggaaaagactcatggaagatgatcaaaaacatgatttgagagaggtatacttagcaatacatcacatagtaaaatacagaggtaactttttgaatccacaaagtagcctcgacatagatcaacaatttgacgtaacagatttcgcacaagcacttgcgagatttgcagaccatcaagcactcagctgggcattagaagctccaattagatttttagaagctgaactagcaactggactatcgaactctgcccgtgtagatgccgctatcgaggcattcagctttgatacaaaagttgacagagccgccataaaagaaatgttaaaaggcttatccggaaatcaaatagacttcaccaaactattcgtaaatgttgattcagccgactgggatcaagaagaaagaaaacagtggaaaatgaaactctcagaagaagacttcgacgaacaagcgctaccaatattagaaagattatctcaagatgagactgaattttttcttgcaattaaacgagcatatgacggaattgccctgatgcgatttctaggtgatgaacaatctctttcttccgctatgataaaagcttacgaagaccatagacgagacctaactttcttaaaaacacaagtgcgtacaccacaaaatagacaagcactcagtgaaggatatacgaactatctgtctgtagatgacaaaaagcataaaaggggagccaaagaacttgcacaattaatcgaagcaagcgatgcatctgaacaagacaaagcaacaatgctagaccggatcgctaacgatcaatttgccccaaaacagagaacaaaagctaacggcttaattccttaccaactgcacttagcagaactaaaaaaaatattagcgaaacaaggtcaatattatccattcttattagataccttcgcaaaacaaggccagagcgttaacaaaatagaagaactcgtacaattcagagtaccatattacgtaggtccaatggtacctaaatctgaaaccgcaggaaatgcagaaaatcactgggttgaaaaaaatgatggacaaacaaaagtaagcgttaccccatggaattttgaccaagtttttaaccgcgatagggcagcaaaatcattcatagatagattaacaggaaccgatacatatttaataggtgaacctactttaccgagacattcactaacgtatgaaacctttacagtattaaatgagctaaataacataagaatcgatgggaaaagattaccagtcgaaacgaaacaagcaatagtagaagatctatttaaaaaatatcggctagtaacaaaaaaaagacttcaagactacttcgcatcatttggcaaaagagaagtagaactcaccggacttgcagacgaatcacgattcacctctagtttaacctcttatcacgatttgcaaggcttattaggaacagacttcataacaaacccacaaaaccattcactactggaaaaaattgtagaaattcagactgtctttgaagattccgatattgctgaacgcgagcttggcaaattaggcttagaacaaaaattaataccacgtctagcaaaaaaacactacactggttggggaaatctttcaagaaaattgttagacaccagtttcatacatgatcccgaaagaccagaagaaccggtatcaataatggatctgctatacacaacaaacaaaaacttcatggagatactacatgattcagaatacggagtagaagaatggttgaaatcccaaaatatgatcgacgatcaaaaagatatacaaatgcgaatagatgaacttactacatcacccgccaataagagaggaataaaacaagctttcaatgtattggatgatataactcaagcaatgggggaagaaccagcttacgtatacctagaatttgcaagagaaaaacaagcatcacgcagaacggtgtcacgaaagaagcgattagaaactctatataagaatgccgctctaaaaacagagtttaaagcaataaaagaagcgttagctgaagaaagcgatgaccgcatgcaagacgatcgattatatctttactatgcacaattaggaagagatatgtacaccggacaatcaatatccattgatcaacttagctctcactatgacatagatcacatcgtcccacgtgcgttcattaaagacgatagtttagaaaataaagtcctagtaaatagaaccgataacgcaagaaaaaccgacagcgcaacattcacagcagacgttaaagccaaagcattccctttatggcaacaactaaaaaaactaggactcataagtgccaaaaaatttcgtctactaacaagaacaggtgatttcacggaaatggaaagggaaaggttcatagccagacagcttgttgaaacaagacaaataataaaaaatgtagcggccctaatagaaggacatttcagtcagacccaagctgtagctataagagcggaagttactggtgaactacgacagctcacacagataaaaaaagatcgtgacattaacgattatcaccatgctcaagatgcactcctagttgcaacagctggcacttatttacatagacactttcctaagcgtgacgctcgctttatatataacgaattcgactattatacacaacactggctaaaaaaccaaggagagaatcgaagacgtcacccatactcattcgtggtaggaacaatgtctaaagggaacgaagactggacgccagataacttaaactatttacgaaaagtaatgcaatacaagacaatgttgatgaccagaaagccggtagggccagaaggtgcattatataaagaaactttaattgctgctgatcctaagaaaagacttgtaggagcttccaaagaaagacaagatccaaccatctacggcggttacacaaaagaatcatcagcttacatgtcattagtacgagctggaggtaaaaatcaattggtcaaaatacctgttagaatcgcaaacgagatacacagtggacaacgaaagttagatgattacgtccaagcaaaagtaaaaaagtttgagaggatcttacttccaaaaatctcgcttgggcaattggtcgaagatgaagggcagcgattttatctagctaccaacgaaatgaaacacaacgccaaacagctatggttagaccaaaaagtcgtcacaacatacaaacgactcacagcagaatcaccagtagaagatttcctcacggtatttgatgcactaacatcaagtgctactatacatcactttaaattctatcaacgagatttggaactattacgagacaatagagcaggattccaagacttagcaaaagctacacagcttaaagtgttaaaggacgtcctatatgaattacacgataatgctggatggcgagatccaataaaacaatactttaaagaaataggattaaaagttcgaatgtggacaaaactacaaaaagaagggggaatcaaacttactgatcaagcagaacttatataccaatcaccctcaggactcttcgaaaaacgaagaagagtacaagatttattatga

SEQ ID NO: 5242 - RNA, 3939 nt, synthetic construct
  misc_feature 1..3939: note = Cas9 variant
  source 1..3939: mol_type = other RNA
atgcaaaatggatttcttggaattacagtatcatcagaacaagtaggctgggctgtcacaaatccaaaatatgagctagaacgagccagtagaaaagatctctggggagtaagactatttgataaagctgaaaccgcagaagacagacggatgttcaggactaacagaagactaaatcaacgaaaaaaaaataggatacattacttacgagacattttccatgaagaagttaaccagaaagacccaaatttctttcaacaattagacgaatctaatttctgcgaagatgatcgaacggtagaatttaatttcgacacaaacctctacaaaaaccagtttccaactgtataccatctacgtaaatatctaatggaaaccaaagacaaaccggatatacgcctagtttatctcgccttcagtaaattcatgaagaatagaggacatttcctatataagggaaacttaggagaagtcatggacttcgaaaactctatgaaaggattctgcgaaagtctagaaaaattcaacatcgattttcctacactgtcagacgaacaagtgaaagaggtacgagacattttatgcgatcacaaaatcgccaaaacagttaagaaaaaaaatatcatcacaataactaaagtgaagagtaaaacagcgaaagcatggatcggcctattctgtggctgttcagtacctgtaaaagtgctatttcaagatatagatgaagaaatagtaaccgacccggaaaaaatcagcttcgaagacgcatcatatgatgattacatagcgaatattgaaaaaggagtaggtatatattacgaagcaatcgtaagtgcaaagatgttattcgattggtccataatgaacgaaatactaggagatcatcaattactttcagatgcaatgatagcagaatacaacaaacaccacgacgatctgaaacgacttcagaaaataataaagggaactggcagtcgagaactataccaagacatatttattaacgatgtaagtggaaactacgtctgctacgtagggcatgcaaaaactatgagttcagcagatcaaaaacaattttacacatttctaaagaaccgcctaaaaaacgttaacgggatatcaagcgaagatgcagaatggatagatacagaaattaaaaacggcacattactaccaaaacagacaaaacgagataactcagtaataccacaccaattacaacttcgtgaatttgaactaatactagacaatatgcaggaaatgtacccatttctaaaagaaaatagagaaaaactcttaaaaatttttaacttcgtaataccatattacgtaggaccgctaaagggcgtagtacgaaaaggagaatctactaattggatggtcccaaaaaaagacggagtaatccatccgtggaattttgatgaaatggtagacaaagaagccagtgcagaatgcttcatatcgagaatgacaggtaattgtagttatctcttcaacgaaaaggtactgcccaaaaactcattactatacgagacatttgaagtactaaatgaactcaacccactgaagatcaatggagaaccaatatcagtagaactaaaacagaggatatatgaacaattatttctaactggaaaaaaagtcaccaaaaaatccctcacaaaatatttgattaaaaacggttatgacgaagacatcgaattatcaggtatagataatgaatttcactcaaatttaaaatctcatatagatttcgaagactacgacaacctatcagacgaagaggtagaacgaataattcttagaatcacagtatttgaggacaagcaattattaaaagactatctcaacagagaattcgtaaaactgagtgaagacgaacgaaaacaaatctgctcgctttcatataaaggatggggaaacttatcagaaatgctcttaaatggaataaccgttactgacagtaacggcgtagaagtatcagtcatggacatgttatggaataccaatcttaacttaatgcaaatcttgtcaaaaaaatatggatacaaagcggaaatagaacgatataacaaggagcatgagaaaaacatatacaatagagaagacttaatggattaccttaatataccacctgctcaaagaagaaaagttaatcaattaattacaatagtcaaatcccttaaaaaaagatgcggtgtaccaaacaaaatatttttcaaagtatcaagagaacatcaagacgatcccaaacggactagctcacgtaaagaacagctcaagtatctatataaatcacttaaatcagaagacgaaaaacacttgatgaaagaactagatgaacttaatggtcatgaactttcaaatgataaagtatatctttattttctccagaaaggcaggtgtatctacagcggaaaaaaattaaacctaagccgtttacgaaaatcaaattaccagaacgacattgattacatctatccattaagtgcagtaaatgaccgcagcatgaataacaaagtcttaaccggtatccaagaaaaccgagccgacaaatacacatacttccctgtagacccagaaatacaaaaaaaaatgaaaggattctggatggaattagtccttcaaggctttatgagtaaagaaaaatacttccgactatccagagaaaacgatttcagtgaaaatgaattagtaagttttattgaaagagaaataagtgacaatcaacaatctggacgaatgatcgctagcgtcttacaatattactttccggaatctaaaatagtgttcgttaaggagaaactaatatcatcatttaaaagagactttcatttaatatcaagttatggacataaccacctacaagccgccaaggacgcatatattacaatagtagtagggaatgtataccacaccaagttcacaatggatcccgccatatatttcaagaatcataagcgaaaagattacgacctaaatcgattatttttggaaaacatctcgagagacggacagatagcctgggaatctggaccatacggttctatacaaacagtcagaaaagaatacgcacaaaaccacatagccgttacaaaaagggtagtagaagtaaaaggcggcctgtttaaacagatgcccttaaaaaaagggcacggagaatatccattaaaaactaacgacccaagattcggaaacattgcacaatacggcggttatacaaacgtaacgggaagctacttcgtgttagtcgaaagcatggaaaaaggaaaaaaaagaatcagtcttgaatatgtaccagtttacctacacgaacgactcgaggatgacccgggacataagctcttaaaagaataccttgttgatcatagaaaactaaatcatccgaaaatattactggctaaagtaagaaaaaacagcttattaaaaatcgacggcttctattatcgattaaatggaagatccggaaatgcgttaattctcaccaacgccgtagaattaatcatggacgattggcagactaaaactgcaaacaaaataagtggctacatgaaaagacgtgcgatagataaaaaagcgagagtataccaaaatgaattccacattcaagaactagaacaactatatgatttctacttagacaaactagaaaatggagtatataaaaacagaaaaaataaccaagcagaactcatacacaacgagaaagaacagttcatggaattaaaaacagaagatcaatgcgttttgctaacagaaattaaaaaattatttgtttgctctcccatgcaagcagatctgacactaataggaggatcaaaacacacaggaatgatagccatgagctcaaatgtaacaaaagcagatttctcaattatagctgaagaccctttaggcttaagaaataaagtgatatactcacacatgggtgagaaatga

SEQ ID NO: 5243 - RNA, 3939 nt, synthetic construct
  misc_feature 1..3939: note = Cas9 variant
  source 1..3939: mol_type = other RNA
atgcagaacggctttttgggaataacagtatcctccgaacaagtgggatgggcagtaacgaaccctaaatatgaactcgaacgagcgtcacgtaaagacctatggggagtaagactctttgacaaagcagaaacagcagaagaccgacgaatgtttaggacaaatagacgattaaatcagagaaaaaaaaacagaatacattacctcagagatatatttcatgaagaagtcaatcaaaaagacccaaatttcttccaacaactggatgaatcaaacttttgcgaagacgatcgcacggtagaattcaacttcgacaccaatttatataaaaatcagttcccaacagtctaccatctacgaaaatatctaatggaaaccaaagataaaccagacataagactagtatatctggcctttagtaaatttatgaaaaatcgaggccacttcctatacaaaggtaatctaggcgaagtaatggacttcgaaaatagcatgaaaggtttttgcgaaagtttagaaaaattcaatatcgattttccaacactctcagacgagcaagtaaaagaggtaagagatatactctgtgaccacaaaatagcaaaaaccgtaaaaaaaaaaaacataattacgattaccaaggtaaaaagcaaaacggcaaaagcttggataggactattctgtggatgttcagtacccgttaaagtactattccaggacatagatgaagaaatcgtaaccgatccagagaaaatcagcttcgaagacgcatcatatgacgactacatagctaacatagaaaagggcgtaggaatttattacgaagcaattgtcagcgcaaagatgttatttgattggagtatattaaacgaaatcttaggtgaccaccaattattatcagatgcaatgatagccgaatataataaacatcatgacgacttaaaacgactacagaaaataattaaaggaacgggatcacgagaactataccaagacatcttcataaacgacgtgtccgggaactacgtctgttatgtaggacatgcaaaaaccatgagttccgcagatcaaaaacaattttatacctttcttaaaaacagactaaaaaatgtaaatggaatatcaagcgaagacgcagagtggatagacacagaaattaagaacggcactttacttcccaaacaaacaaaaagagataatagcgtaataccacaccagcttcaacttcgagagtttgagctaattcttgataatatgcaagagatgtatccatttttaaaagaaaacagagaaaaattgctaaagatattcaatttcgtaataccatattatgtaggaccacttaaaggagtagtgagaaagggcgaatcaactaactggatggtacctaaaaaagacggagtaatccacccttggaatttcgacgagatggtagacaaggaggcaagtgcagaatgctttatatctagaatgacaggaaactgtagttacttattcaacgaaaaggtattaccaaaaaattcactattatatgaaacattcgaagttcttaacgaattaaatccattaaaaataaacggagaaagcataagtgttgagttaaaacaaagaatatacgaacaattattcctaacgggcaaaaaagtgacgaagaaatccctgacaaaatatttaataaagaacggatacgataaagacatagaactatctggcatcgacaatgaattccatagcaacctaaaatcgcacatagactttgaagattatgacaatctatcagacgaagaggtagaacaaattattttaagaataacagtcttcgaggacaaacaattactaaaagattacttaaatagagaatttgtaaaactttcagaagatgaaagaaaacaaatctgctcattaagttataaaggatggggtaacttaagcgaaatgctattaaatggaatcaccgtcactgattcaaacggggtagaagtttcagttatggatatgctttggaacacgaatttaaacctcatgcaaatattaagtaaaaaatacggatataaggcggaaatagaacattataataaggagcatgagaaaacaatatacaatagggaggacctaatggactatctcaatatcccaccagcacaaaggagaaaggttaaccaactaataacgatagttaaatccctaaaaaaaacatacggagtaccaaataaaatctttttcaaagtgtcccgagaacaccaagacgatcctaaacgtacgagtagtagaaaagaacaactaaaatacctatataaatcacttaaaagcgaagatgaaaaacacttaatgaaagaactcgacgagctaaatggtcacgaattaagtaacgataaagtctatctatactttctccaaaaagggcgatgtatatactcgggcaaaaagctaaacctaagcagattacgaaaatcaaactatcaaaacgacatagactacatatatcccctaagtgcagtcaacgatcgttcaatgaataacaaagtattaactggcatacaagaaaatagagcagataaatacacatattttccagttgatccagaaatccagaaaaaaatgaaaggtttctggatggaactagtgttacagggatttatgtcaaaagagaaatactttagactaagtcgagaaaatgatttttcagaaaatgaattagtctcattcatagaacgcgagatttccgacaatcaacaatccggacgcatgatagcatctgtactccaatactatttcccagaaagcaaaatagtattcgtaaaagaaaaactcatctcctccttcaaacgtgattttcatctaataagctcgtatggacataaccacttacaagccgcaaaagatgcatacataactatagtggttggaaatgtctatcacgctaaattcacaatggacccagctatatattttaaaaaccacaaaaggaaggattacgacctaaacagactattcttagagaacatcagcagagacggccaaatagcctgggaaagtggaccgtatggttcaatccagacagttaggaaagagtatgcacaaaaccacatagcagttactaaacgagtagttgaagtaaaagggggtttgttcaaacaaatgccattgaaaaaaggccacggagaatacccactaaaaactaacgatcctagatttggaaatattgcccagtacggcggttacactaatgtaacagggtcgtatttcgtattggtagagtcaatggaaaaaggaaaaaaaagaatatcattagaatacgtaccagtctacctccatgaaagattagaagatgacccagggcataaactcttaaaagagtatttagtagaccacaggaaattaaatcatccaaagatattattagctaaagtacgaaaaaattcactacttaagatagacgggttttactaccgactaaacggtagaagcggcaatgctttaatactaacgaacgcagtggaattaataatggacgactggcagacaaaaacagcgaacaaaatatctggttacatgaaacgaagagcaatagacaaaaaggcacgagtttatcaaaatgaatttcacatacaagaactagaacaattgtatgacttctaccttgacaaactcgaaaacggcgtctataagaacagaaagaacaatcaagccgaactaattcacaacgaaaaggaacaattcatggagttaaagacagaagaccaatgtgtcctattaacagaaataaaaaaattattcgtatgctcaccaatgcaagcagacttaacccttatagggggttcaaaacatacaggaatgatcgcaatgagctcaaacgtgacaaaagcagattttgcagtaatagcagaagatcctttaggcttaaggaacaaagtaatatactcacatatgggagaaaaatga

SEQ ID NO: 5244 - RNA, 3942 nt, synthetic construct
  misc_feature 1..3942: note = Cas9 variant
  source 1..3942: mol_type = other RNA
atgcattacttggatgagatcttcgcgccccatctacaagaagtagatgagaatttcctcaggcgactaaaacaaagcaacattcatccagaagatccagccaaaaatcaagcattcataggaaaactattatttcccgatttactaaagaaaaatgaacgaggctatccaacactaataaaaatgagagatgaactgcctgtcgagcaaagggctcactatccagtcaccaacatctacaaactaagagaagcaatgatcaacgaagaccgacaatttgacttgcgggaagtctatttagcagtacatcatattatgaaatacagaggacatttccttaacaatgcctcagtggataaattcaaagtgggaagaatagatttttataaatctttcaacgtactaaatgaagcctatgaagaacttcaaaatggcgaaggatcatttacgatcgaaccatcaaaagttgagaaaataggtcaactgttacttgatacaaaaatgagaaaattaaaccgacaaaaagctgtagcaaaattgctagaagtcaaagtagcagacaaagaagaaacaaaaagaaacaaacaaatagcaacagctatgtcgaaacttgtattaggatacaaagccgactttgcaactgtggcaatggccaatggtaatgaatggaaaatagatttgtcttcagaaacatctgaagacgaaatagaaaaatttagggaagaattgtcagacgcacaaaatgacattctaacagaaataacatctttattctcacaaataatgctaaatgaaatagtacccaacggcatgtctatatctgaaagcatgatggacagatactggactcacgagcgtcaattggcagaagtcaaggaatacctagcaacccaacccgcatctgcgagaaaagagtttgaccaggtgtacaataaatatatcggtcaagcacccaaagagcgtggcttcgacctcgaaaaaggactgaagaaaatactttccaagaaagaaaactggaaagaaatagatgagcttctaaaagcaggagattttctacccaaacaaagaacatcagcaaatggagtcattccgcaccaaatgcaccagcaagaattagacaggataatagagaaacaagcaaaatactatccatggcttgccactgaaaaccccgcaactggtgaaagagacagacaccaagcaaaatatgaactcgaccaattagtcagttttagaatcccttactacgtaggacccttagtaactccagaagttcaaaaagctacatcgggagcaaaattcgcatgggccaaaagaaaagaagatggagaaattacaccatggaatttatgggataaaatcgatcgagctgaaagcgcagaagccttcattaaacgcatgacagtcaaagacacttacttattaaatgaagacgtattaccagcaaacagcctgctataccaaaaatataacgtattaaacgaactaaacaacgttagagtaaacggaagaagactctctgtaggaataaaacaagacatttacaccgaactattcaagaaaaagaaaactgtcaaagtctcggatgtggcatcactggtgatggccaaaacacgaggagtaaacaaaccatcagtcgaaggattaagtgaccctaaaaagttcaactccaacttagcaacatacttagatctcaaatctattgttggggacaaagtcgatgacaatagatatcaaacagacctagaaaacatcatagaatggagaagtgtatttgaagacggagaaatatttgcggacaaacttacagaagtagaatggctaacggatcaacaacgatcagcattagtaaagaaaagatacaaaggatggggaaggctatcaaagaaactactaacaggaatagtcgatgaaaatggacagagaattatagatctcatgtggaacaccgaccaaaattttatgcaaatagtcaaccagccagtattcaaagagcaaatagaccaattaaaccaaaaagcaataacaaatgacggaatgactcttcgagaatgggtagaatccgtactagatggagcctacacatcaccacaaaataagaaagccatttggcaagtcgtacgagtagtagaggatatagtaaaagcagtaggtaacgcccctaagagcatatctattgaatttgcaagaaacgagggcaacaaaggtgaaataacaagaagccgcagaacacagttacaaaagttgtttgaagaccaagctcatgaactcgtcaaagacacgagcttgaccgaagaacttgaaaaggcaccagatctttcagataggtattacctatatttcactcaaggcggaaaagacatgtacacaggagatccaattaatttcgatgaaatctcaacgaaatatgatatagatcacatactacctcaaagttttgtaaaagacgactcattggataaccgagtgttagtaagtagagccgaaaataataagaaaagcgatagggtcccagcgaaactttatgcagcaaaaatgaaaccctactggaatcagttgcttaaacagggactaataacacaacgtaaatttgaaaatcttacaatggacgttgaccaaaacattaaatacagatccttagggtttgtcaagcgacagctagtagagaccagacaagtaatcaaattaacagctaatatattaggaagcatgtatcaagaagcaggaacagatataatagaaacgagagcgggactcaccaaacaactacgtgaagagttcgacctaccaaaagtaagggaagtcaacgattaccatcacgccgttgatgcatatctcacaacatttgctggacaatatttaaaccgaagataccctaagctaaggtcattctttgtatacggagaatatatgaagttcaaacatggatcagaccttaaattaagaaattttaactttttccacgaactcatggaaggtgataagtctcaaggaaaagttgtagaccaacaaactggagaacttataacaacgcgagatgaagtagctaaatcattcgaccgattactaaatatgaaatatatgttagtatcaaaagaagtacacgataggtcagatcaactttacggggcaacaattgttaccgccaaagaaagtggcaaattaacgagtccgatagaaatcaaaaagaaacgtccagtggatttatatggagcatatactaatgggacttctgcttttatgactattatcaaattcacaggcaacaaaccaaaatataaagttataggagtaccaacaacctctgccgtaggactaaaaagggtaggcaaaccagggtcagaatcttacaaccaagaactacaccgaataatcaaatctaatcctaaagtaaagaaagattttgaaatagtagtaccacacgtatcatattcacaactaatagttgatgatgattgtaaattcacattagcgagcgacacataccaacacccagccactcaattagttttgagcaaagaaagcatggagataatagccgacgatttcaaatttgtaaaagaaaatacagcaacagcagacgaacagttagtacgagtcttcgacgaaatagtaaaccagatgaatcactattttactatattcgatcaaagatcaaatagacaaaaagtcacaaaagcacgagataaattcgtttctctaccaacagagtcggaatacgaaggcgccaagaaaacacaagttggcaaaactgaagtaattacaaatttactcatgggactacatgcaaactcagcacaaggagatttaaaagttttaggactatctaccttcggattctttcaatcttcaggaggtctaaacctatcagaagatgcaatgatagtatatcaaagtccaacaggactctttgagagacgcatctgtttaaaagacatatga

SEQ ID NO: 5245 - RNA, 3942 nt, synthetic construct
  misc_feature 1..3942: note = Cas9 variant
  source 1..3942: mol_type = other RNA
atgtccttcaaagaaaactcgaaaatatattatggattagacatagggacagattctgtaggctggagcacaaccaacgaaaaatacgaattactaaggtacaaaaataacctcatgtggggtgtatcactcttcgaagcagcaagtctagcagaagaacgaagaggacataggacacaacggagaagatacgatagacgccaacaaagagtagccctcttaggagaacttttcgcgaaagaaatcctaaaaacagacccagatttctttctccgactaaaagaatcaagtctatacccagaagatcgaactagcaaaaacgttaacacttattttgatgatgctgattttaaagattcagattattttaagatgtaccccacagtacaccacctcattaaagagctaagtgaaagtaacaagcctcacgacgtaagattagtatacctagcttgcgccttcatagtagctcaccgcggacacttccttaacggagccgacgaaaataatgtacaagcagtcttagactttgatagcagttattgtgaatttacagactggtttaaaagcaatgatatagaagataatcccttctctgaatcagtcaaaaatgaattttcagtaatactcagaaagaaaataggaatcacggctaaggaaagagaaattaaaaacttacttttcggaacaacaaaaaccccagactgttataaagatgaagaatatcctatagacattgacgtattaataaaattcatatccggaggaaaaacaaacttagcaaaattatttagaaatccaagctacgatgaactagatatccaaacagtcgaagtaggcaaagcagactttgcagatacaatcgacctattagcaagctcaatggaagatactgacgtaccactactaagtgcagttaaagcaatgtacgattggtcattattaatagatgtactaaaaggacagaaaactatatccgacgcaaaagtatgtgaatacgaacaacataaatcggatcttaaagctcttaaatacatagtcagaaaatacttagatcgagcacaatatgatgaaatctttagaactgcgggtgaaaaacccaactatgtatcctattcatataatgtgacagacgtaaaactaaaacaactcccatcaaattttaaaaagaaaaactcagaagaattttgcaaatatattaaatcaaaattagagaaaattaaaccggaatcagatgatgaagccgtttacaacgaactaatcgaaaaatgtaactcaaaaacactatgtcctaaacaagtcacagacgaaaatagagttattccctatcaattatactaccatgaattgtccatgatactagacaaagcctcagcctatctagattttctaaataaaaccgaagacggcatatcagttaaacagaaaatactgacattaatgaaatttcgtattccttacttcgttggtccattagtaaaaagaaacgagacggacaacgtatggattgtaagaaaggccgaaggtagaatttatccatggaactttgaaaacatggtagactttgataaatctgaagacggcttcatcagaagaatgacctgtaagtgcacctatctcgccggagaagacgtactacccaaatattcactactctattccaaatataccgtcttaaatgaaatcaataatattaaagtcaacggcgagaaaatctccccagaactaaaacaagatatatttaacgaactttttatgaaaacgtcaagagtaacagttaagaaaataactgaactcctcaaaagaaaaggagccttttcagaagaaaaaggagattcattaagtggagtggatatcaatataaaatcatcactcaaatcataccttgactttcgacgcttactggaaaatggatctctctcagaaaatgacgtggaacgaatcatagaaaggattacagtaaccaccgataaaccacgtctagttagttggttaaaagcagaatatagcgacttaccagctgaagacataagatatataagcagactatcctacaaagactacggaagactatcagcgaaacttttaacaggatgttatgagttagatacaaacacaggggaaataggtggcagaagcataatcgattttatgtgggcagaaaacataaacttaatgcaaattctaagcgattcatatggttacaaatctttcatagaagaggaaaataaaaagtattacatgataaatcccacaggatcaatagcacaaacattacgagaaatgtatgtatcaccaagcgtatccagagcaataatacgaacaatggaaatcgtaaaagaactgagaaaaataacaaagaaagatccagacaaaatatttgttgaaatggccagagggggaaaacccgaagagaaagggaaacgaacatcttctagacgtgagcaaatagaaaaactctatgattcagcaaaagcgtttgtaagcgacgaagatatatctcatatgagatcacaattaggatcactcagcgatgaacaactaagacgagagaaatattacctatactttatccagttcggaaaatgcatgtattcgggagaagcaatagatttcagtcgattaggcgacaaccactgctacgacatagaccatatatttccccaatcaaaaataaacgacgactcgcttcataataaagtattggttaaatctcaattaaacggagagaaaagtgatgattacccaattaaagctgaaatcagaaataagatgcaccccttatggaagaatctattctacagagacccaaagaatcccgcagacaaagtaaagtacgaaagactaacgagatcaacaccatttactgaggacgaactagctggctttatagaaaggcaattagtggagacccggcaatcaaccaaggctgttgctactctcctaaaagagatgttccctgacagcaagatcgtttacgtaaaggcaggtcaagtttccgaatttaggcatgatttcgatatgctaaaatgcagagaaatcaacgacttacatcacgcaaaagacgcttacctaaacattgtaataggaaatgtacatgacgtgaaattcacaagcaaccctatgaatttcgttaaaaacgcagataaacactacacaattaaggtaaaagaaactttgaaacataaggtctcaagaaacggcgaaacagcatggaacccagaaaccgacttcgatacagtgaaaaggatgatgagtaaaaattcagtcagatacgtacgctattgttacaaaagaaaaggaggatttttcaatcaaaacccagatcgagctggaaatcccgacctcgcaagactgaagaaagatctagatccagttaaatatggaggatacaattcaaaatcaatctcatgtttttcgctaataaaatgtacaggggtaggagcagtaatcatccccgtagaattactatgcgagaaaagatatttcagcgatgattctttcgccagtgaatacgcctattcagtacttaaaaacgcgctcccggcaaagaacatagcaaaaattagtattgatgatattagtttcccgttaaagagaaggccaataaagatcaacacgctattcgaatttgacggatacagagttaacattcgtagcaaagattcatatcactactttacgatatctagcgctatggctgctatatacagtaaagatacatctgactatataaaagctgtgagcagctacattgataaatctgacaagggatcaaagttcaaacctggagaagcgttcgacgtactctctaacctaaaggtctacgatgaaatcgctaagaaatgtatatcggaaccatttagcaaaataagcaaactagcagaagcaggaaaaagatggaagaaagaagaaatatcactacaaaactgcttactctga

SEQ ID NO: 5246 - RNA, 3945 nt, synthetic construct
  misc_feature 1..3945: note = Cas9 variant
  source 1..3945: mol_type = other RNA
atgctcaaaaaggactacagcataggtctagatattggaacaaacagtgtaggacatgcagtagttaccgatgattataaagtacctactaagaaaatgaaagtattcggcgacacatcaaagaaaactatcaagaaaaacatgttaggcgtcctacttttcaatgaaggtcaaacagcagcagacacgcgcctcaaaagaggagcaagaagacgttacacaagaaggaaaaatagattaagataccttcaagaaatattcgcccctgcattagcaaaagtagacccaaacttcttttatcgcctagaagaatccagcctagtagcagaagataagaaatacgacgtctatccaatatttggaaaacgtgaagaagaactcctatatcacgatacacacaagacaatatatcacttaagaagtgaattagcaaataacgatagaccagccgacctaagactcgtatatttagcactcgctcatataataaaatataggggtaatttcctgttagaaggagaaatagatctaagaacaacagatataaataaagtctttgctgaattttcagagacactaaacgaaaactcggacgaaaatttaggcaaactcgacgtagcagatatatttaaagataatacattttcaaaaaccaagaaatctgaggaacttctaaaactttctggcgcaaagaaaaatcagctcgctcatcaactctttaaaatgatggtcggaaacatgggatcttttaagaaagtgctaggcacggacgaagaacataaactaagttttggtaaagacacatatgaagatgatctcaatgatttacttgcagaggctggagaccaatacctagacatattcgtcgcagccaagaaagtctatgatgcagcaatcctagcctccatccttgatgtaaaagatacacaaactaaaactgttttctcacaagccatgatcgagcgttacgaagaacaccaaaaggatttaattgagctaaaacgagtattcaagaaatatctacccgaaaaatgccacgacttctttagcgagcccaaaataagcggatacgctggttacatagacggaaaagtatccgaagaagatttctacaaatacaccaagaaaacattaaaagggatccctgaaaccgaagaaatcctccagaaaatagatgcaaacaattatcttcgcaaacaacgaaccttcgacaacggagcaataccacatcaagtacaccttaaagagctagttgccatagtggaaaaccaagggaaatattatcccttcctacgagaaaataaagacaaatttgagaaaatattgaactttcgtataccctactatgtaggaccactagcgagaggtaattcaaaatttgcttggctaacccgagccggtgaaggaaaaatcacaccatataactttgacgaaatgatagacaaagaaaccagtgcagaagatttcataaaaagaatgaccatcaatgacctctatctccctaccgaaccagtattacccaaacatagcctactatatgaaagatacaccatatttaacgaactggcaggagttagatacgtaaccgaaaatggagaagcaaaatactttgacgcacaaaccaaaagatcaatcttcgaattatttaaactagaccgtaaagtgtcagagaaaatggtaatcaaacatttaaaagtggtcatgcctgcaataagaatacaagcactaaaaggactcgacaatggaaaattcaacgccagttacggtacctacaaagacctagtagatatgggagtagcaccagaattactaaacgatgaagtaaacagcgaaaaatgggaagacataataaaaacgctaacaatattcgaaggtcgaaaacttataaaacgacgtcttgaaaactaccgtgattttctaggcgaagacattttaagaaaactatctcgcaagaaatatacaggatggggaagactatcagcaaaattactagatggaatatatgataagaaaacacataaaacaatactagactgtctaatgacggaagattactcacaaaactttatgcaactaataaatgacgacacttattcattcaaagaaacaatcaaaaacgcccaagtcatagaaaaagaagaaacactagctaaaaccgtacaagaactcccaggatctcctgcgataaagaaaggaatactacaaagcctcgaaatagtagatgaaatcataaaagttatggggtacaaaccaaaaagtatcgtagttgagatggcgcgcgaaacacagaaaacacatggtacacgaaaacgagaagaccgggtccaacaaatagttaaaaacttaaaagacgcaaatgaattacccaagaaattaccaagtaacgctgaactttcagatgaacgcaaatatttatactgtttacaaaatggccgcgacatgtacacaggtgcacctctcgattacgaccatctacaattctacgacgtcgaccacataataccccaatcattcctaaaagacgacagcatagaaaataaagtactcacaattaagaaagaaaatgtcagaaaaacaaacggtctccccagtgaagcagtaatacagaaaatggggagcttctggaagaaattactcgacgccggagcgatgaccaacaagaaatacgataatctcagaagaaatcttcacggaggccttaacgaaaaattgaaagaaagattcatagaaagacaacttgtcgaaacccgccaaataacgaaatacgttgctcaactattggatcaaagactaaactatgatggaaacggtgtggagttagatgagaaaatagctatagtaacactaaaagcacaactcgcatcacaatttagatccgaatttaaactaagaaaagtacgagcattaaataacttacatcatgctcacgatgcgtacctaaatgctgtcgtagcaaatctcataatggccaaatatccagaattagaaccagaatttgtttatggcaaatatcgaaaaacaaaatttaaaggactgggaaaagcaacagccaaaaatacattgtatgcaaacgtactatatttcttaaaagaaaacgaagtatatccattctgggacaaagcaagagatttacccactattaaaagatacctttaccgcgcacaagtaaacaaggtcagaaaagctgaaagacaaacaggaggattttcagacgaaatgctagtccctaaaagcgacagcggtaaattattaccccgaaaagaagggcttgacccggttaaatatggaggctacgctaaagctgtcgaaagttacgctgtattaataaccgccgacgaggtgaagaaaggaaaaactaagaaagtaaaaactctagtaaacataccaataatcgatagtaagaaatatgaagccgatccaaccgcttatctagcatcaaggggctacacaaacgtaacaaattccttcatacttcccaaatacagcttattagaggacccagagggccgaagacgatatctagcttcatttaaagagtttcaaaaagcaaacgaactaatactaccccagcacctggtagaactgttgtattgggtaaatgcaaaagacggtgaacaaaaactcgaagatcataaagcagaatttaaagaactctttgataaaataatggaatttgcagacaaatacgtagtagcgccgaaaaacagcgagaaaataagaagattatatgaagaaaaccaagatgctacgccaatggaactaggtaagaatttcgttgaattactccgatatacagccgacggtgcagccagtgacttcaaattctttggtgaaaatatacctagaaaaaggtacaactcagccggatccttgttaaatggaactctaatataccaatcgaaaacaggattatatgagactagaattgaccttggtaaactttga

SEQ ID NO: 5247 - RNA, 3948 nt, synthetic construct
  misc_feature 1..3948: note = Cas9 variant
  source 1..3948: mol_type = other RNA
atgggttactccgtaggccttgatatcggaacagggagtgtaggttgggtagtaaccaatgaagatggaaaactagctcgcgccaaaggtaaaaatctaattggagtgcgactattcaaaacagcagaaccagcagcggacagaagaacaaatagaactacccgaagaagattaagccgtcgaaaatggcgactacgactattagatgaattattcgccaatgaattaggaaaaattgattcaaacttcttaacacgactcaaatactcatatgttcatcctaaagacgacgctaaccgggcaaattactacggaggatacttatttccaacccaagaagaaacaaagaaattccacgcaaaatacccaacaatataccatcttagattagcactcatgacagaaagcagacaatttgacctacgagaaatttaccttgccatgcatcaaatagtgaaatatcgaggacacttcttaaatagccagagtaaaatgacaatagggaacacttataacccccaggatttgcaaaccgctatggaaaactatgctgaagcaaaaggcttaagcatagaactaaaacaaccagaagaaatggtagcgattctcacaggtgaagctggattcggtctatctaagaaagctaaagccgaaaaactcctcaacaacttcttctttgatactaaagaagaaaaagcaacagttcaggctatactagcaggaatcgtcgggaacacaattgattttacaaaagtattcaaccgccaactcactggagacactctaaaagcgtggaaactaaaactagactcagaaacattcgacgttgactcagaacctatactcagtgatctagatgatgacgaaaccgaacttttctttgcaataagacaggcttttgatggatttacacttatgaacttacttggagaccaaacgtcaatctccgccgcgatggtagaacggtacacacaacatcacgatgatctattaacagtaaaacaagtggcaaagaaacaaggactctcacacaaagagttctcaaatatatactcagcattccttaaagatgataccgacaaagggatgaagaaacttctcgaagaatcaaatttatccacagaagatgtaaatggcatacaattaagaatggatagccatgactttctaccccaacaaagaacaaaagcaaacagcgtaatcccacatcaactacacttagcagaattagaagccataatagaaaaccaagggcaatactacccattcttattagaaacatttgaaaaagaaggaacagcagcaaacaaaatagcagaacttttaaaattccggataccatattatgtcggacctatggtaaccaagaaagacgtagaaaatgcaggaggagatgcgacaaaccactgggtcacaagaaacgaaggatacgaaaaatcagctgtaacggcctggaactttgaccaagtattcaatagagatcaagccgcgcttgactttatacagcgtctaaccgggactgacacctatctaataggcgaacccacattaccacagaactccttaaaataccaaatgttcactgtattaaatgaattaaataatgtaaaagttaatggacgaagaatagataatcaaaccaaacatgatttaatacaagatctatttaaatctaagaaaacagtatcacttaaagcatttcaagattactaccaatcacaaggaaaaagcgacatacaggtagtgggtctagccgacaaaacgaaatttaattcaaacctatctacctatattgacctatcgaaaacctttagtgccgaagaaatggaaaatccacaaaaccaagatctcctagaacaaatagttgagatacagaccgtatttgaagacagcaaaatagcagaaagggaactaagcaaattagaactaacacctgaacaagtgacaaaactcgctaaaacacactacaccggatggggaaacctttccaataaattacttacgacccccattgtagacgtcagtggtaagaaagtctcaattttagaccaactagcaaaaacaagcaaaaacttcatgtcgataatttcaaatgaacaatatggtgtccaagattggatcaaagaacaaaatacgactgagaccactggaactttagaagataaactagccgatttaactacgagcccagccaataaacgaggtataaaacaagcattcaacgtacttttcgatatacaaaaagcaatgaaatctgaaccagatagagtctacctagagttcgcaagagaaacacagacatcagtcagaacaatgagccgttacaactacttaaaaggactctatcaatcaaaatctcttgatgcagaagctaaaaatctcaagaaagaacttgcagaaaccgaccaaaagaaatttgacaatgaccgattatacctttacttccaacaacaagggaaagatatgtatacaggtcaacccattaacatagataaactaagttcagactacgatattgaccacattatccctcaggctttcactaaagacgactcaatcgataatcgagttctagtaagtcgacccgaaaatgctagaaaatccgactcgggcacatatacaacagaagtccaagcggcggcctcaggcctgtggaaaacattagtacaatccggatttatcagcagaaagaaatacgatcggttgactcatgctggtgactactcagaaggacagaaaacgggctttatagcacgccagctagtagagacaagacaaataattaaaaatgtcgctgctctaatagaaagtgagttcgaccaaacgcaagcagtcgcaatacgagcagaaataacaggagacatgagaagacttgtagctataaagaaacatcgagaaataaactcctttcatcatgcctttgatgcacttctaataacagcggcaggacaatacatgcagaaaagataccccgatagagacagtaataacgtatataacgagttcgacaggtatacgaatgactatctcaagaaattaagagaatcatcaagcaaagacgaagtgcgtaaacttaaaccatttggattcatcgtaggaacaatggcaaaaggtaacgaagactggacaacagaacaaacggaatacttacgtcatatcatgaattttaaaaatatactgaccacatataaaaccggaccagacagaggtccactaagcaaagaaactatatacgccgtagacccaaaagcaaaattaattggaacaaacaaacatcgacaagacgtatcattatatggcgggtatacctacccctatagcgcttatatgactcttgtacgagcaaatggtaaaaaccaattagttaaagtttctagatctgccgcatcattaatgaaatcaggacaactcaaattagaagactacgtacaacaacaaccagaagttaagaaattcgagaaaatattactagaacatctacctctcggtcaactcgtagataacgacggtaaattaatgtatttaacaagctatgagttctaccacaatgcaaaacaactgtggctatcaacagaaaacgctgaccttatctcaagcctcagtatagatagcgatgatcaaaaactaatcaaggctttcgatatccttactgcagactcagtcatagaaagattcccattttacgaaatagatctgaaaaagttaatcgaattaagagacaaatttgtactcatagataacaaattagatgtactgagagtcgttttaaaagcattacaactagatagtgcacaacaaaaaccactaaaactcatagataaagcagcaacagattggaaaaactatcgacaagcaggaggcataaaacttagtgataatgcagaaatcatatatcaatcaactacaggaatattcgaaaagagaattaaaatctcagatcttctttga

SEQ ID NO: 5248 - RNA, 3951 nt, synthetic construct
  misc_feature 1..3951: note = Cas9 variant
  source 1..3951: mol_type = other RNA
atgctgcaaaaaaattatacaataggcctagacataggcactaactctgtaggatatgccgttataaacgacaactataaagttccagcaaaaaagatgaaggtattaggaaatactgacaaaaaaactataaaaaaaaacttaatgggcgtattattattcgatgctggagaaacagctgcaacaacaagattaaagagaggcactcgacggcgatatacacgacgacgaaatagattacggtatctacaagaaatactaggacctgaattagcaaaagttgatgcaaattttttacatagactagcagaatcatcactcgtaacagaagacaaagaattcagcgcctaccctatatttggagatagggaagaagaacttttataccacaaaacctacaaaacaatttatcatcttagatcagcactagcaaacaaggacgaaaaagccgatctgcgactcatttacttagctctagcccatattataaaatatagaggaaattttctcatagaaggagaaatagaactaagcgataccgatattgataaagtttatgctgatttttgtagaagcttcaatgaactattcgacactgaggtattacaagaaatagaggtagaagccattttcaaagacaaaacactaagcaaaacaaaaaaagccgaagagttagtaaaagtatcaggggtcaaaaagaatcaagtagctcatcaatttctaaaaatgatggtaggaaacactgttaatttcaaaaaagtattcaatttaacggaagaccagaaattatcttttggaacagactcatatgaagatgagttaaatgatttattagccaaatccgatgatcgatatttggacgttttcgttgctgcaaaaaaggtatatgatactgcaatattagccaatattcttaatacaaaaaacagcgtggcaacaaaaacaatattcagccaaagtatgatagaaagatttaaagatcaccaaaaggacctaaaagaacttaaacaattgtttaaaacttatctaccagaaaaatacccagatttctttggaaattctaaagaagatggctacgctggctacatagaaggaaagacaaatgaagaaaaattctatacccacacaaaaaaaattctcaaaaatatcccacaagctgcaagtgtattagctcaaattgacgtcggaaactacctacgaaaacaaaggacatttgataacggagtaataccacaccaaatacaactaaaagaacttctagcaataattgaaaatcaaggcaaatactaccctttcctgctcgaaaacaaagaaaagattgccaaaatactcacattccgtattccatactatgtaggtccactggccaggggaaattccagatttgcctggctcaaacgtgtaggaaaagaaaaaataacaccatttaatttcgaaaatgttgttgacctcgaatcaagcgcggaacgcttcatagaaagaatgactttaaatgacctatatttaccagaagaaaaagtactccccaaacatagcatgttatatgaaaaattttcaatattcaacgaattagcaggaattcgatacataacggacaatggagaaatgaaattcctggacgcacaaactaagcaatcgatattcgagctttttaaacaagagaggacagtaaaggaaaaaaaggtattagatttactaaaaacgctcatgcctagcgaacgcgtagttgcaattaaaggtatagacaacggaaaatttaacgcaagttttggaacataccacgatttatcgaagatggggttcaaaacagaaaaaatagctagcgagtctaaccaagcccgctgggaggaaatcataaagacgctaacaatctttgaagacagaaaactaattaaatcgcgactgcgaaaatatgatgatttcctgaatgaaaaagaaatcggagcattgtcaaaacgcaaatacacaggatggggacgattaagtgctaagctcatcgacggaatatatgacaaaaaaacacatcaaacaatactagactttcttatgaatgaagattacaatcagaatttcatgcaactcatatcaaacgataattattcattcaaaaaaataatcgaagattcacaagttatcaaagaagaaggatcgctcacagaagtaatacaagaattacctggatcaccagcaataaagaagggaattctacaaagcatagaaatcgtagacgagttagtcaaagtaatgggcggaaatccaaaaaaaatagttgtagaaatggcgagagaaacccaaaaaacacacgggactacacgcagagaagcaagaattaaagaaataatcaagaacctcaataaactaaagttaaacgaacttccaaaagacctcccatcaaatgaggagctatctgacgaaaaagtatatctatattgcctgcaaaatggcagagatatgtacactggagcaccacttgacctagataacctgtcacaatatgaagtcgaccacataataccccaatcatttctaaaagatgactctattgaaaacaaagtcttgacagcaaaaatagaaaatagtagaaaaacaaacggactaccaagtgtagaaatagcgaaaaaaatgggagccttctggaggagcttactaaaagtaggagcaatatctgagaaaaaatacagaaatctaagacgatctctacacggaggaatgacagaaaaattaaaggaaacatttgtaaaaagacaattagtcgaaactcggcaaatcacaaaatatgtcgcacaaatactaaattcacggttcaatgaagagaaaaacgaagacaaggttgccatcgtgacactaaaagcccaactaacatctcagttcagaaaggattttgaactgtataaagtacgcgagatcaataatctacaccacgcacacgatgcttacctaaacgccgttttagcaacattactgatgacctcattccccgagctagaaccagaatttgtatatgggaaatacagaaaaacaaaatttaaagggttgggaaaagcaacagcaaaaaataatttatacacgaatatactccaactgctaaaggaagaatctgcccaatattgggatacaaaagagcgcgatctagcaacaattaaaaaaaatgtctatcaagcccaagtaaacaaagtacggaaagtagaaagacaaacaggcagcttttatgatgaaaccgtagcaaaaaaatcagcatctcaaaaactattccctagaaagaacgggctagatccagttaaatatggagggtaccaacgtgctaatgaaggatatagtctgctgtttagagcagatatgctaaacaagcgaggtaagacaaagtcagtaaaaacgttagtgaagataccaataattgaaagtgctcaatatctggcagatcctacagaatatctggccaaacgcggctattacaatgtttcagaacattcgctcttactacctaaattctctctcttggaaaacaacaatggactcagaagatacctagctagctcaaatgaattccaaaaagcaaacgaactaatcttaccaaaacacctagtcagactattatactggtcacaatcaaagcaaagaaaggaagaactaaacaaacaccgcgcagaatttgctgaattattcacttatatcatggactttgctgataaatacgtagtagcacccaaaaacagtgaaaaaattaaaaacatctacgaaaacaataaagactcaagtgtagaagtactgggaaaaaacttcatagaactattaaaatatactgcagacggtgcagccagcgatttcaccttcttcgacacaaaaatacccagaaaaagatataattctgcaggtgacttattagatggaactctaatctatcagagcaaaacaggattatacgaaacacggatagatttgggggcaatatga

SEQ ID NO: 5249 - RNA, 3957 nt, synthetic construct
  misc_feature 1..3957: note = Cas9 variant
  source 1..3957: mol_type = other RNA
atgatgataaaacttaacaacatgaagaaaattctaggactagacttaggaaccaattcgattggatgggcagtagttgagacggaagataacaagaaatttgaactactggacaaaggagtacgcatattccaggagggcgtgaaaatagaaaaaggaatagagagcagcaaagcagcagaaagaaccggataccgaagcgcaaggagaataaaattccgcagaagacttcgaaaaatcgaaacactaaaagtattgatagaaaacaatatgtgccccctctcaatggatgaacttatcgtctggaaagaaaacaaaaacaactaccccaaaaataaaatattttacaattggctaaaaacaaaagaccccaaagaaggaactaatggtacctacataaacccttactacttcagaacagaagcaataaaacggaaattagaaaacacgaacgatgtaggtagagcactatatcacctcgcacaacgccgaggctttaaaagtaataggttggaaagcacagacgaaaaatcaagaggtatagttaagactgaaataaacaaacttagctcggaattaaacggacgatacttaggagaatacttttacgaactatacctgaagggtgaaaagatcagaaaacgacatataagtagagaggaacattatttaaatgagttcaagaaaatatgtgaagtgcaaaattttaacaaagaacttgcagaaaaattagaaagagcaatattctaccaacgaccgttaaaatcgcaaaaaggactggtagggaaatgcacgttacaaaataacaaacaccgctgtccaatatcgcgaccagagttcgaagaatttagaatgtggcaattcataaattcaataaaatataaaaactcagacggtaaattcgacttcttaaataaagaacagagagaaaacataataccagctttcgtcagtaataaaaacgccacgtttgaattttcaaaaatagagaaaatcctcaataaaggcgtccacatataccaatttaattataaatccaatcatacaataggatcgaaccaaacaatgataaattttatggatgtctttgacatagataggaaactgaccaacgcatggctcctatgcgtaaacaaaatttacgaactatataccgcgaagacaaagaaggatggaagcctaaaatccaagagtgaagtcataactgatgtatggcatgtactattcaccttcgataacgaagaaaacttaaaagagttcgcaaggaataaattactactagatgaatcaagcgcgcagaaattttcaaaaatcaatctcaaacaagactatagtcaactttccctaaaagcgattaataaaattttaccatatctacaagaaggtcttatatacagttacgccgtctttattgccaacatagaaaatgtgataggcaaatcaatatggaacattaaggaaaaccaacaaataatcagaacttccatcaaaaagataatagacaaccataaaacagaattagatataaacacgatcacaaactcattgataaacgacttcaaagtcaattacaataacgcgcacaaagaatataaagtcgacgacatagatttaaagaacatccgcgagaaaataataaaatactatgggaacaaaacttggaactgtctaccagaagacgaaaaactatatgtgaaagaaaaagtagaaaaactatatgaaaaacaactaaaaagtggtaaaagaggaatattcatagagaaaatacgattggatgatcggatagaaaatttcctgaaagacaattttgacagctcagaacttaacttaaagaaactataccatccatctgatgtatcagtatacaaaagtgtcaaaataaccgacttaggtctacgactattgggatccccaatgataccttcaattaaaaatcccatggctatgagggcaatgcaccaactaagaaaactaattaatcatctcataatagaaggtgtcatcgacgatagcactataataaatgtcgaaatgtctcgggaattaaatgacgcaaacatgagaaaggcgatagaaagataccagagacaacgggcaacagaaaatgaagaatttaagacaaaaataaaagaactctataagaaagaatgcggtactgacttcgaacccaacaacgacgacatcatgaaatacagactatgggaagaacaaaaccacaaatgtttatatacaggaaaatcaataggtatctgcgattttatcggatctaacccagctttcgaaatagaacatactattccaagaagtctaagttacgacaacagcctggaaaacaaaactctatgcgaaaaagaatttaaccaacaagtaaagaaaaatcgaatacccttcgaattaagtaattataaagaaatcataagtaggataaataattgggaaataaaagcggaagaattgttcaaacaaatacaaaaagtgaaaattcagtcacgcatggcagccactaaagaaataaaagacaacgcaatccaaaggaaacacctactacaaatggagttcaattattggaatggaaaactatcacgattcacaagagaagatgtcccggaaggattcaaaaacagtcaacttgtagatataggtatcataacaaaatacgctagggcatacttaaaaaccgtattcaacaacgtaaacacggtaaaaggaagcacggttgctgagttcaggaacatctggggtcttcaagaatatttcgagaaaaaggatagaagtaatcatatacaccactgcattgatgcaataactatcgcatgcttaactaaagataaatatgacttcttagcacacctctatcatctggacgaacagaacaaccgagacgcagtccacagagctatgatcaaatcaaaaccctgggaaaacttcgtacaggatgtgaaagaaatagaaaaccaaatcctagtcagccattacacaccggataacctaccaaaacagtcaaagaaaatacttcgaaaaagaggaaaaatccagaaaaacgaaaatggagatctaatatacgaaaaaggcgacgcagttcgagggagtttacacaaagaatcattttacggagctataaaacgtgaaataataaataagaaaggcgaaacagaagaaaaagtactgtatgtaaaaaggaaaccactcgaatttagcgacctaggattcaagacaatatcagaactcgaaaacatagtagatgacgcagtaagagataaagttttaaacgcagtaaaagacaaaggattaaaacaagcactaaacgaaccaatatggatgaatgaagaaaaacaaatacctataaagaaagttcgatgctacacaccatcagtaaccaaccccatcaatctcaagaaacatcgagacaaaagcaaacatgaatataaacaatcataccatgttacaaacgatggcaactacttaatggtgatatatgaaggaaaagacagccaagaaaaagtaaaacgagactatgaaatagtaagtaacttacaagcaggagaatattttaaacaatcagtacacggtgtcttaaaagcacaaggaataaacaatctagaaggactaataccaaaattcaaagaatcaggtaaaaatatactacctctcaaatacatactaaaaacaggaaccatggtcatattttgggaaaattatccagaagaaatatgggatattgataaaaaccaattatacaagcgactgttcaaagtaacacagtttgaatcagacgggcgtatacaagcaagatttcatcagatcgcaaaaccggacaacgaactaactaaagttagtgaattagacttttccaacatagcagaaaagataagactatcaaaaggaaatttaaacatgctggtgaatggatatgactttaagatcaacgtactagggcacatagaaaagttaagttga

SEQ ID NO: 5250 - RNA, 3957 nt, synthetic construct
  misc_feature 1..3957: note = Cas9 variant
  source 1..3957: mol_type = other RNA
atgggatctaacatgcttaaaaaagattacagcatcggccttgatatcgggactaactcggtaggacatgccgtagtcacagacgactataaagtccctactaaaaaaatgaaagtgttcggagacacgtcaaaaaaaacaataaaaaaaaacatgttaggagttttgctattcaacgaaggtcaaacagcggcagacacaaggctcaaaagaggaacacgaagaaggtataccaggcgaaaaaatagacttcgatacctccaagaaatatttgcaccagaactcgcaaaagtcgacccaaactttttatacagattagaagaatcaagcttagtagcagaagacaagaaatatgacgtatacccaattttcggtaaaagagaagaagaactattataccacgatacatacaaaacaatataccacttaagatctgcgctagcaaacaacgaccagccagctgacctaagacttgtttatctagctttagctcatattataaaatacagaggaaactttttattagaaggtgaaattgacctaagaactacagacattaataaagttttcgcagaattctcagaaactttaaacgaaaactcagacgaaaacttaggaaaattagatgtcgcggacatattcaaaaacaacactttttcaaaaacaaagaagagcgaagaactcttaaagttatcaggagctaagaaaaatcagctagcgcatcagctctttaaaatgatggtcggaaacatgggctcattcaaaaaagtactaggaacggatgaagagcacaaactatcctttggaaaagacacatacgaggacgaccttaatgacctattagcagaagcaggagaccaatatctagatattttcgtagccgcaaaaaaagtatacgacgcagcgattttagccagtatactagatgttaaagacacccaaactaagacggtatttagtcaagccatgatcgaaagatacgaagagcaccaaaaagacttgatcgagttaaaacgagtatttaaaaaatatttaccagaaaaatgccacgatttttttagcgaaccaaagataagtggctatgcagggtatatcgacggaaaagtaagcgaagaagatttctacaaatatactaaaaaaacattaaaaggcattcccgaaacagaagaaatactacaaaaaatagatgcaaataattacctaagaaagcaacgaacatttgacaatggcgctataccacatcaagttcatctaaaggaactagtagctattgtagaaaaccaaggcaagtattatccattccttcgagagaataaagataagttcgaaaagatattgaactttcgcataccgtattacgttggaccattagcccgcggaaactcaaaattcgcatggctcacccgagctggtgagggaaagataacgccatataattttgatgaaatgatagacaaagaaacttcagccgaagattttataaaacatatgaccataaacgatttatacctacccacagaacccgtactccctaaacactcacttttatacgaaagatatacaatatttaacgaactagctggcgtaaggtacgtcacagaaaacggcgaagcaaaatacttcgatgcacagactaaacgaagtatattcgagttattcaagctagatcgaaaagtaagcgagaaaatggtgataaaacatctaaaagttgtcatgccagcaatacgtatacaggccctaaaaggactggataacggaaaatttaatgcttcatacggaacatacaaagacctcgtagacatgggagtagcccctgaactattaaatgatgaagtaaattcagaaaaatgggaagatatcataaaaacgctaacaatcttcgaaggcagaaaattaataaaaagacggcttgaaaattaccgagattttctaggagaagacatcctgagaaaattgtccaggaaaaaatacaccggatggggcagactatcagctaaactattagacggaatatacgataaaaaaacccacaagacaatattagattgtctaatgacagaggactactcgcaaaacttcatgcagttaatcaacgacgataactacagcttcaaagaaactataaaaaacgcccaagtcatagaaaaagaagaaacgttagccaaaaccgtccaagaactcccaggatcacctgcaataaagaaaggaattctacaatctttagaaatcgttgatgaaataattaaggttatggggtataaaccaaaaagcatagtagtagaaatggctcgagaaacacaaaaaacccatggcacccgaaaaagggaagatagagtccaacaaatagtagagaacttaaaagatgctaatgaacttccagaaaaattaccatcaaacgccgaactaagcgatgaaagaaaatatctttactgcttgcaaaatgggagggatatgtacacaggagcaccactggactacgatcacctccaattttacgatgtagatcacataatcccgcagtcattcttaaaagacgactcgattgaaaacaaagtcctaactataaaaaaggaaaacgtgagaaaaactaatggcttaccctcagaagcggtgattcaaaaaatgggatcattctggaaaaagttactagacgctggtgcaatgacgaataaaaaatacgataacctcagaagaaacttacatggaggactaaacgaaaaattaaaagaacgctttatagaaagacaattagtagaaactcggcaaatcaccaaatacgtagcgcaattacttgaccaaagattgaactacgatggcaatggagtagaattagatgaaaaaattgcaatagtgacgctaaaagcacaactagcttcacagttcaggagtgaattcaaacttagaaaagtaagagcattaaacaacttacaccatgcacatgacgcctacctaaatgcaatcgtagcaaacctaataatggcaaaatacccagaactagaaccagaattcgtatatggaaaatacaggaaagcaaaattcaaagggctcggcaaagcaaccgcgaaaaataccctatatgcaaatgttctttactttctaaaagagaatgaagtatatccattctgggataaagcaagagatcttccaaccattaaacgatacctctatcgagcacaagtaaataaagtaagaaaagcagaaagacagatcggtggattttcagacgaaatgctagttccaaaatcagactcaggcaagttactacccagaaaagaaggattagaccctgtaaaatacggagggtacgctaaagccgttgaatcttatgcagttctcataacagcagatgaagttaaaaaaggtaaaacaaaaaaagtgaaaacgctagtaaacattccaataatcgattccaaaaaatacgaagctgacccaacagcatatctagcatcgcgagggtacactaacgtgacaaacagttttatcctaccaaaatactctctactagaggacccagaaggtagaagaaggtacctggcaagctttaaagaatttcaaaaagcaaatgagttaatactacctcaacatcttgtcgaattgctatactgggtcaacgctaaagacggtgaacaaaagctagaggatcacaaagcagaattcaaagaattatttgacaaaattatggaatttgctgacaaatacgtcgtcgcacctaaaaacagcgaaaaaattcgacgactatatgaagaaaatcaagacgcaactccaatggaattaggcaaaaacttcgtagaactcctaagatacacagctgatggggcagcatcggattttaaatttttcggagaaaatattccgagaaaaaggtacaactcagcgggtagtctacttaacggaacactaatttaccaatccaaaaccggactatacgaaacacgaattgacttaggtaaactttga

SEQ ID NO: 5251 - RNA, 3960 nt, synthetic construct
  misc_feature 1..3960: note = Cas9 variant
  source 1..3960: mol_type = other RNA
atgtttagtcaaagaaacaacccatactgcgaattattattcaaaattatagtaaccaatatagaagagaaaaatttagaagtcattatgggtataagaaactcagatatatttttcattagcaattttatgtggtaccaaaaattaataatgatgatcaaaaatatactaggactagacttagggacaaatagtatcggatgggcactaatagaagttgacgaaaacaacatacctataagaataattgctatgggatctagaataataccactatcgacaagcgacaaagaagagttccaaagggggttatccattacgaaaaaccagaacaggacagtcagcagaacacaaaggaaaggatacgacaggaaacaactacgaagatcggacctaaagaaaatattaaagaaatacaacatattcccgagtgaagaactattaaaattaccaatgttggatctctggaaactacgctcagactccgctaacccaaacgaagacataagtgctgaacaattaggacgtatcttatatatgctcaatcagaaacgaggatacaaatcagctaggtcagaagcaaacagcgacaagaaagatacagattacgtacaagcagtaaaaggtagatatgcacaacttaaagataggagacaaacaataggacaatacttttatgaagaattgtcaacagcattctcagacaaaaataaccaacaatactttcgtgtcaaagaagaagtatacccaagagaagcatatatagaagaatttgatacaataatcaacgcacaaaaagataaacatggattccttacagacaaagtaatacaccaactcagaaacgaaatcatctattttcagcgtaaactcaaaagtcagaaagggttggttagtatctgcgaactagaaggatttgaaaagacagtatatgataaagagaaaaacaaaaataaagtagttttcgtaggaccaaaagtagcgccaaaaactagccccttgtttcaattgtgccggatctgggaagtcgttaatacaatcagtctaaaaatcaaaaacccagaaggcagcaaatataaatggggagaaaaagtacccaacctcaaacagaaagaaattctagcggactatttattcaaaaatgaaaatttatctttctcaacacttttagaaatattagaactaaagaaagaagatgtatatgtcaacaaacaaattctaaaaggaataaaaggtaacgaggcatatgcagctctacacaacgtactcggagaccatgaattattaaacttcgacgtctcaataattacgagtgaccataccgctatcctagtagataagaaaacaggtgaaatattagaagaacgggcaggactagaactagacgcaagcctagaaagagaacccttataccaattctggcacacaatctatagtttgaaagatctagacgaatgtaaaaatgcccttataaaacgatttggattggacgaggatatagctgaaaaattatcacacatagacttcaataaacaagcattcggatcaaaaagcaacaaatccatgagaaaaatacttccctttctaatggagggctacaactatagcgagtcatgttcattagccggatataaccactccaattcgctaacaaaagacgaaagagaatcacaaataacgctagaacgactagaactactacccaaaaacaaccttcgacagcccattgttgagaaaatacttaatcaaatgataaacgtagttaatacaattttagaaaaatacggcaaaccttcagaaatacgagtcgaacttgcaagagaacttaaacaaagtaaagacgaacgaaatgacacagatctacaaaattcaaggaacaagaaactaaatgaagaaattggaaaaaggctcgcagaattaggactgccagtgacgaaaaggtacatacaaaaatacaaatttatatttccatcccttagcaaaaacctcaaagacgctcacgtaaacaaccaatgtatatattgcggcgaaacttttaatctaaccgaagcgttaaatggagacgcatatgacgttgaccatatagtgcctaaagccctactatttgatgactcacaaacaaacaaagtactcgtacatagaaaatgtaactctacaaaaacaaaccaaacagcctatgattacataactgctaaaggtgaagaagaagtccgcatatatagcgagagagtagacgattggttcaaaaagggaattatatcctattctaaaatgcaacggctaaaagtatcacacaaagaatacttagaaagaaagaaattaggaaaagaaaccgaaactgataagaaattatgggaaaatttcatagatcgacaacttcgtgacacacaatatatttcacgtaaatcacgtgaaattctccaaaaagtgtgcaacaacgtaacaactactgaaggaggagtaactgcgaaactacgcaatctatggggatgggacgatatactaatgaatttacaaatgcccaaatataaagaattgggacaaacaatcacaaaagaatggacatccgaacacggaaaacgtaagcatcaaaaagaagaaattgaaaactggacgaagagagatgaccacagacatcacgcaatagatgccctagtagtagcatgtacaaagcaaggattcatacaaaggataaacacactaaattcttcagagaccaaagatctcatgataaaagaagtagaagaggctaaaatcgaatttaacgagaaaaccacattactagaaaaatatctcaaaacacaaaaaccatttacgaccagagaggtgatgaaagaagcagacaagatccttatatctttcaaagcaggcaagaaagtagccacaataacaaaattcaaagcaacaggcaaaaacaaggaaacaggagtaatagtgccccgaggagctctacatgaacaatcagtctatggaaaaataaaagtaatagagaaagacaaacccctgaaatacctatttgaaaatccggataaaatagttaactcgcgaatacgtgacctcgtggaaacacgcctatcagaaaacgaaaataacagcaagaaagcattaagtacagtcaagaaaaatccaatattctttaatgaagagaaaaacgaaatcctcgaaaaagcatcctgttacaacgacgccactgtactaaaatataagctacaaaacctaaaagccaatcaagtggatgatatagtcgacgaaagagtaaaatttcttgtaaaagaaaggttgacacaattcggcagcaaagaaaaagaggcattcaaagacatactatggtttaaccaggagaaacaaatcccaataatcacagtccgactctttgcacgacccgatgccaacaacctccagataattaaaaaggataaaaacggcaaagacatcggattcgtactaactggtaacaatcaccacatagcaatatacgaagacaaagactcaaagctagttcaacactcatgcgccttctggcacgctgtagagaggaagaaatataacattcccgcagttattaaaaacagcgcagacgtttggtccctactactagataaagaactcccagtactcttcttagacaaacttcccgcagatgaattaaatttaaaattctcaatgcaacaaaacgaaatgttcatacttggtctatcccaagaaggctttgatgaagcaatcaaaaacaatgacaaaagcctcctaagcaaacatctatacctagtatggtcaatttcaaacaatgactactatttcaggcatcatcttgaaaccaaaaacacagagctcaaaaatataccaacagcaaaagatagtaaacgatacttcagattcaaatcggtcggcgccttagtaggcattaaccccataaaagttagacttaatcacttaggcgaaataaccaaaataggtgaatga

SEQ ID NO: 5252 - RNA, 3960 nt, synthetic construct
  misc_feature 1..3960: note = Cas9 variant
  source 1..3960: mol_type = other RNA
atgggatacaacatcggattagatatagggactggatcagtaggatgggccgcacttaccgacgaaggcaaacttgctcgagcaaaaggaaagaatctaataggtgtacgtctattcgactcagcacaatcagctgcgcaaagaagatcgtatagaacaacaagacgccgtttaagcagaagaaaatggaggttgagactactcgaaaatatcttttccgacgaaatgggtatgatagatgaaaatttttttgcaagactaaaatattcatatgttcacccaaaagatgaagtcaataacgcacactattatggaggatacctttttccaacacaacaggaaacacatgatttccatgaaaaatttcaaacaatttatcatctacgactaaaactaatgatcgaagattgtaaatttgacctcagagaaatatacttagcaatgcatcatattgtcaaatatcgaggacacttcctaaatagccaaagcaaaatgaccataggcgactcctacaacccaagagacttccaacaagctattcaaaattatgccgaagcaaaaggattaatatggagcctgaacgacgcacaagagatgacagacgtattagtaggacaagcaggatttggtctaagcaaaaaagccaaggccgaaagactactatctgcattttcctttgatactaaagaagacaagaaagcaatacaagcaatacttgcaggcatagttggaaacacaacagacttcacaaaaatttttaaccgtgaacgatcgggagacgaactcaaaaagtggaaacttaaacttgatagcgaagcattcgatgaacaatctcaggcaattgtagacgaattagatgatgacgaaatggaattgtttaacgctataagacaggcttttgatggattcacattaatggatctcctaggtgatcaaacaagtatcagcgcagcaatggttaaacgctatcagcagcatcatgacgacttaaagatggttaaagaaatagcaaaaaaacaaggattatctcatcaagactttagcaaaatctacaccgcatttttaaaagacgacaccgacaaaggcatgaaagcattgttagataaggcagacttagctgatgatgtcctggttgaaattcaacaacgaatagaatcacatgacttcttgccaaaacaaagaacgaaagcgaactctgttatcccttatcaactacatctagcagaactagagaagattatagaaaatcaaggaaaatattatccatttttgttggacacatttaccaataaagcaggcgaaacaataaacaaactagttgaattagtgaaattcagagtgccttattacgtagggcctatggtaaccgcggcagacgttgaaaaagcaggtggagacgccactaatcattgggtcaagcgtaacgaaggatatgaaaaaagtcctgttacaccgtggaattttgatcaagtattcaaccgagaccaagcagcacaagattttatagacagattaacaggcacagacacctacttaataggcgaacccaccctactaaaaaattctttaaaataccaactatttacagtcctaaacgaattgaataacgtaaaaatcaatgggcacaaaatagatgagaagacaaagcacgtgttaatacaagacctcttcaaaagcaaaaaaactgtatcagaaaaagcgatcaaagactattatctatcccaaggtatgggtgaaatacaaatcgttggtctcgctgataaaacaaaattcaactcaaacctttcatcatatatagacctttccaagacatttgatgctgaatttatggagaacccagccaaccaagaactacttgaaaacataatacaaatacaaacggtatttgaggatgtaaaaattgcagaaagagaattacagaaactagctttaccggacgaacaagttcaacaattagcaaaaactcactacaccggatggggcaatctatcagacaaactactaagcacccctatcatacaagaaggttcacaaaaagtgagtatattaaataagctacaaaccaccagtaaaaacttcatgtcaataattacggacaacaaatttggtgttcaacaatggatacaagaacaaaacacagcagaaacagctgactcaattcaagacagaatagacgaattgaccactgctcccgcaaacaaacgaggaattaaacaagcattcaacgtcctcttcgacatacaaaaggctatgggcgaagaacccaacagagtataccttgaatttgcgaaggaaacacaaaattccgtcagaacaaattcacgatataacaggttaaaagacctatataaatctaaaactctatccgatgatgtgaaagcattaaaagaagaactagaatcacaaaaatccagcttacaatcggaacgaataggagacagattatatctatacttcctacaacaaggaaaagacatgtacacaggacaaccaatcaatatagataaactcagcacagattatgatatagaccatatcataccacaagcatatacaaaagacgactccatcgataatcgtgttttggtatcacgacctgaaaatgcacgaaaatcagactcggctacttacacaactgaagttcaacaaagtgccggaggattatggaaatccttaaaaaacgccggattcataagtcaaaaaaaatacgatagattaactaaagggggtgactacagcaaaggacaaaaaacaggatttatagcacgtcaactagtagaaactcgacaaataataaaaaatgtagcatcactaattgaaagtgaattctcacaaactaaagctgtcgcaataaggtcagaaatcacagctgacatgagacggctagtcgccataaaaaaacacagagaaatcaatagcttccaccacgcattcgatgcattactaatcactgccgcgggccaatacatgcaagcacgatacccagacagggacggagctaacgtatataacgagtttgattattatacaaacacatacctaaaagaactcagacagtccagttcaagctcacaagtacgaagattaaaaccattcggatttgttgtaggcaccatggccaaaggaaatgaaaattggagtgaagacgatacacaatacctaagacacgtaatgaacttcaaaaatattctaactacacgaaggaacgacaaagacaacggcgcactgaacaaggaaaccatatatgcagtggacccaaaagcgaaactaataggtaccaataaaaaacgacaagatgtatcactctatggaggatatatatacccgtacagcgcctacatgacactagtcagagcaaatggaaaaaaccttctcgtaaaagtaacgatatcagctgctgaaaaaataaaatctggccaaatcgagctaagcgaatacgtacagcaaagaccagaagtaaaaaaattcgaaaaaatattaatcaacaaattagcaataggtcaattagtcaataacgacggaaacttaatatacctaacttcgtacgaattttatcataacgccaaacaattatggttaccaacagaggaagctgatctaataagtcaattaaataaagattcatcagatgaagatctaataaaaggattcgacatactaacttctcccgctattcttaaaaggtttcccttttatgaattagatctaaaaaagctagtaaacataagagataaatttatagcagtagaaaataaatttgatattctcatggtaatattaaaagctctacaattagatgcagcacaacaaaaacccgtaaaaatgattgataaaaaaagcgccgactggaaagactacagacagagaggcggaattaaactatccgatacatcggagataatatatcaatctacaacaggcattttcgaaaaaagggtcaaaataagtaacctactatga

SEQ ID NO: 5253 - RNA, 3963 nt, synthetic construct
  misc_feature 1..3963: note = Cas9 variant
  source 1..3963: mol_type = other RNA
atgaccgaacaacaacgaccgtataacataggactagacataggaacatcatcaataggctgggcggtgacagaccaaaatgataaattactacatattcgaggacacaatggcataggagtcagacttttcaaagaaggagaatcagccgcagaacgtcgaggcttcagaacaactagaagaaggttatcaagaagaagatggagattacgatttctagaccgaatctttgacgccgaactagccaaagtggatcccaacttcctcgctagattaaagcaatccaatatatctccactagacccaaacaaacaaatgttcggaaacatcttatttgacgatgcccaattcgacgatcaaaaatttcaccaacaatacccaacgatataccacctacgtagcgcactagcacaaccagatgcaccccaagcggacgtacgactgatatatctagctctacatcacatgatcaaatttcgcggccatttcttaaatggtgccgcagtcgaaaagttccatggtggacaattacatctagaagccgagttccaagaactaaaccaaattttctcaaaccaacagagagatcacgtgcaactccaaacaagttcgctagacgaagtcgcaacaatactcaaagataatcaacgcacccccagcgaccgacaaagagaactctctgcaagactgttcgtaccagtggacaaaacaatcgacaaggaaaacaagaagctggccacagaacttttaaaagccgtattagggctcaaggcaaaatttgacgtcatactaggagtagaagccactgacccacaagcattcaaactccaattttcgagtgatgattttgatgataaaatagcagaacttgcaagtgaattaacagacgaagcaaatgaaatccttacagtactacaaagattgtattttagtttaaacttggctgatatccttactaacaggcaaacaaaacaggttgccgacagcatatccacagcaatgatcaacagatatgatgatcacaaacaccatctaaaaatgcttaaagaattagaaactcaagtcactcaagaacaacgagacggattaaagaaagcatacgacgaatacatcgatggcgacaaaccaacaatcgataccttttatactaacgtcaagaaaaacctcgacgactcagaacttgcgaaccaaataaaatcattaatagatttacaagcattcatgccaaaacagagatcaaaggaaaacggaagtataccccaccaactacaccaacgcgaattggaccaattaattgaagtccaaggaaagtattacccatggcttctagcagcaaaagataaattagacgccctaatagcattcagggtaccttactatgtaggacccatgatagatcctaacgaatcagatgacccccaaaacactaaattcgcatggatggtccgaaaagaagccggagaaataacgccatggaactttgaggaaaaagttgacaaaacaggtagtgcaaccaatttcataaagaggatgacaacgaccgatacatacttacttggagaaccagtattaccgaaaaattccctattataccagcaatttacagttttaaatgaactaaacaaattaaaagtagacggcaaggcactcacagttgaccaaaagaaatacttatacgaacatgtatgtaagaaacaaagacgagtaactctaaagaaactatctgattgtctgatggcaaggggagattttccaatgggagcgatatttacaggaacaaccgaccagaaaaacatgaacaacacattaaaaacatatcaagactttcaagaaatatttggtgacgaaatcgataatccagacagacaggtagattttgagaaaatgatcgagtggagcaccatattcgaagatcgcgaaatatttaaactaaaattagcagaactaaactggttgaccagtgaacagctagaaagagtatcaaagaaaagatatcagggttggggaagactatcgcaaaaattattaacacatatagtcaacgaaaacggagaaaggataatagaccaactatggaatacaaatcaaaatttcatggaaataatgggacaagatggagtaaaacaagcaattcaagaacacaacggagctaacgtcgcacaaaccgggataaatgaaacaatagatgagctatatactagcccacaaaataagaaagcgattaggcaaatcttattagtcgtagacgatataaagaaagcagttggctacgcaccagcaaatataatgatggagttcgcaagagaagatagagacgatcatagacttatagcgtcaagagcaaggcaacttgagaaaacctaccaagaaataagtaaaaattggtttgataatgaatcagtaactcaagaactaaaagatcagatcaaaaacaaaacaaaattcactgacagactatacctctacttcatacagggagggatagatttatacaccggccacccattaaatatagaccagttaagcagctatgacatagatcatatattaccacaatcgttcctattagataacagtctaaacaatcgagtactaacgagtcaaagcgaaaatcgtgtgcataaagaagacagactacccggtgaaaccgtagcaaataaaatgcgcccaacctggaaaatgatgagagaacaaggattgatgacgcagcgtaaatacaacaatttaaccctaaaacccgatcaaatctcaaaattcaataaccgcggccaatttataaacagacaactcgtcgaaaccagacaagttataaaactagcagccgacattatgaaccaaaaataccaagctgaccaaacaaaagtcgtaactgtaaaagcgaacttaacacatcacatgcgagaaaaatttaacttctacaaaagtaggaatgtaaacgattatcatcatgcgttcgatgcatacctaacagtttttgtaggaaattggctattaaaagaatatccaaaattgcaaccatatttcgtatacggagacttcgcaaaaacgggtacaaataacttgaaatcattcaactttttataccgctttgaacgtgatcataaattaaatgacaaaggcgcgatagacaccgataaagatcagcaattagggtacatgaaaagaatatacagattcaagaaaatgctagtaaccaaacaactcgaaacaaatgaaggcgcgctatataaacaaacaatatacaaagcaccagctaacgagaaaaatacaaagaaaaaccgttcactaattaacacaaagaaaaataggccctcagacatatacgggggatattcacaatcagttaccgcttatatgagtttagtatttttcaaaaatacatttaaattgataaaaatgcccctcgtagcagccaacgccattaaaaattcactaagttcatatcatgatacaatactgaaaattcttggaagcaatgaatttaaagttttaatcccaaaagtaaaaatgaatcaattaatcaaagaaggagacagtctctacacagtcgtaggggtatacaaacacaatgctcagcaactgattctatccgacaactcaatgggtataatcacaaaacctattcgtgaaatatgtgacagcgacctagactcagtgttcaatgaactcgttgacaacatagataaatatctaaacctatacaaaatagaagacaaactcacaatcaaagaaaaattttatgcacttaaaaataaagaatccaaattcaaatgtattagcgacatcttagtcggcacacactgcaacgcaggaagaagtaacttaaaaataatcggactttcaagttactggggaatgttctcaggaaataacgacggattaaaaataaatgaaaacagccaacttatataccaatcacctactggattattcgaacaccgagtaaaggtctctgatctttga

SEQ ID NO: 5254 - RNA, 3972 nt, synthetic construct
  misc_feature 1..3972: note = Cas9 variant
  source 1..3972: mol_type = other RNA
atgaaagacttctacataggtttagatatgggaaccgactccgtgggatgggctgttgctgacgaagattacaacttatgcaaattcaaaggaaaagctatgtggggagttcgactctttgacgaatcagcaaccgctgcagaacgaagaggatttagaacggcaagacggagagcccaaaggaaaagacaaagaatattatggctccaaatgttatttaacgaagaaatttccaagaaagacatagcattctttcaaaggttaaacgaaagcaaattgtacctagaagacaaatctacaaacgttccatacgcagtgtttgcagatgaaagtttcacagacgtagattatcacaaactctatccaacaatttaccatcttagaaaagaattagtgcaaagtgatgaaccgcatgatgtaagattagtatacttagccctacaccatcttattaaaaataggggacactttttatttgaaaacgtcggaagcgactttgaaaaagaaagctcatttgaagtcctattcaaaaacttacaaaactatatattaggagaatacgaacttgcactagaatgcatatcaccactacagatagcagacatcctaaaagacaaaagtaaaagaaaaactacaaaatcaagcgaaatatgtaaattactaggcataagcaagaaaggacaaccacgactaaacgctatagtcctactgatgtgcggccaaagcgtaaaactcgcagatttatacggagacgaaaactacaacaaagaagagaaaagttctatatcatttgaaaaaggatatgaagacaacgaagaaacatatagagaattattacttgaaagatttgaattaatcgagaaaataaaagccctatacgattgggccatcttagccgatatactgaaaggcgaaacatatatatcatttgcaaaagtcaaaacctatgacgaacatcgacatgatttacaacaattaaaagcatttgtaaaagaacgatgtcgatcagattacaatgaaatctttcgtgaaacatccgacaaactaaacaattataccgcctattgtggtaaattcaaagaaaatggaagaaatggcgtcatactacactcagcaaatcaaacggatttctgcaaatacctaaaatcaaaattcgacaaactagacaaatcagggtatgaagacatgtttgagaaaattgaaaacggatcatttatgccaaaaatagtagtaaaagacaacggtgtaatccctatgcaagtcaacgaatcagaagtaagagcaattctgaaaaatgcttcaggatacctagactttctaaacaatcaagataaagatggcatcacagtagccgataaaattctgcaaatatttgaatttagaatcccatattacgtaggaccattaaacgtacatagcgacaactcatggttagtacgaaaagatggcaaaatatacccatggaacttcaacaaaatagtcgacgtagataaatcagcagaagagttcataaacaaactcaccgctaaatgtacttatctcccagacagagacgtaatccccaaaaatagtatcctatactctagatatatggtattaaacgaattaaataatctaaaacttgacggaaagaaacctgacgtctctttcaaacaagctgtgtttaatgacctatttatgcatagaagaaaagtaacacaaaaggctttaagagaatacatcaaagcacagaccggtacagaaccggaaataacaggaatagacggagacttcaaagcaaacatgaggcccgcgattgaactggcaggatacaacttgtcagaacccgacaaagaagaaataataaaagccataaccatatttggagacgataagaaacttcttaaacgacgaataaaagacaaatatagtgaaatgctatcagaagatgaaatcaagaaaatatgtaaacttaaatacaaagattggggacgattaagtcgagagttcctaacagaaatatttgacgtagatacggctacaggagaatgcaaagacaacataataaacacattatggaacactaacgacaaccttatggaactattaggtgccaaatataacttcacccagtcaatagaacaagcaatatcaaaaagcacccataaagccagtatagagaaaatggtagaggacatgtacgtgagcccaaaagttaaaagaaccgtattccagtcactaaaaattatgaaagaaattgtaaagataaaaggacacgcacccaaaaaggttttcgtggaaatgacaagacatgatgggactaaaggcgacaacggccgaaccaaaagtagaaagaaacaattagaagaactttacaagaaatgcaaagaagacagtacggaattatgggacgaattagagaaaacggacgatgatgagttcaggcaagataaactgttcttatactacacacaaatgggacgatgcatgtacagtggagaaagaatagaactcagagatctattcaacaaaaacttatatgacattgatcacattttcccccgaagtaaagttaaagacgactcaattgataacagggtattagtaaagaaacaaataaactcacacaaagataacgactatcctctagatagtaccgtaagggagaaaatgagaggacattggcaatacttactacgacatggcttcatcagcaaaaagaaatatgacagacttacgagggtcacaccccttacagatgacgaactagcagattttattgcacgtcaattagtcgaaacatcacaatcaacgaaagccgtagcaacgctattaaaaacactgtatcctacaaccgaaatcgtctacgtcaaagcggaactggtttctagatttcgtacagaatataagttcattaaatgtcgagaagtaaacgacctccaccatgcaaaagacgcctacttaaatatcgtagtaggaaacgtatacaatgtcagatatactcatagcaaagccatattcataaagggtctccaaaccaagaaatattcactaaacagaatgttcgcatttgacacacctggagcatggaatatcgaaaatgaaaaatccttgtcaatagtcaagaaaacagtaatgaagaacaacatcctatatacgagatatagctatatgaagaaaggaggattatttaaaattcaacccctgaagaaaggaaacggacaagctcctctaaagaaagacctcccattaagtgacataggtaaatacggcgggtatgacaaacccacagctagttatttctcctacataaaatatgaaggtaagaaaggcaaggagtgtagacaattggtggctatagacaattatcttaagaaatactacgaggagaacccaatagaatatctaacgaatagactagggctcaaaaatcccgcagtattaataccggtaatcaaatacaattcctgtatagagattgacggatttcggatgaatatatcatcaaaaagtaacgaaggaaaaacaatagtctacaaacctgccgtccagcttgtcctaggcgcagaaaaagaagcatacgttaagaaaatatccaaagtgctatcaaaacctgaagaacagaaaataacatcatacgacggcgtcagcgcagaggaaaacattgagttatttgatgcactaacagcaaaaatgaccaacactatatttaaaatcaaactagaagacataggcaataaaataaaatccggacgagataaatttgtaacactagacgtaaagaaacaatgctacgtcatcaatgaaattttaaaaataatgcattgcaacgtagtcacaggagatctcagtctgataggagcagcaaagaaagccggaattgtctcaactaactcagcattatctgagatcaagaaagtgtcatcaattatgttaataaaccaaagtgtaaccggactattcgaaacgaaaatcgatttacttaacatatga

SEQ ID NO: 5255 - RNA, 3975 nt, synthetic construct
  misc_feature 1..3975: note = Cas9 variant
  source 1..3975: mol_type = other RNA
atgcgcgcaaaagggaagacactaataggaacgtctctattccgagaaggaaacactgcagccgaaagacggggatacaggactactcaaagaagactaaaacgtcgcaaaagacgtctcaaactattggaagcatttttcgatccatatatatttgaagtcgatgagaacttcctagcgagactacacgaagcagacataagtccaaaggacgaaaacaaacgattctggggcagcctattattccctaacgaaaaagatgccaacttctaccgcaagtatccaacaatataccacctacgaaaagctctaatggaagaagatagaaaattcgacgtaagagccatctttctcgctattcaccatatcatgaaatatagaggaaactttctcagccccctgtcagtcgactcgtttaaacaagaaggacttgagttaaaagaacaactcgatcgacaacttaaacgcgttgctgaattatataatgagctaaatacggacgtaaagatcaatgtaagtgacgtagaaactatccaagacataataattgacaaaaataaatcaagaagagataaagcaggagcactaaagaaactcctagccgtaagtagtgacaggaaagaaataaacaaactaaacgcatccctagcaaaagaattatctaatgccatcctaggcatgaaagcacaattcgcaaatctattgctagccgatgacttggaaatagataaaaataaaaaaaatttcagtctcctcgacactaacgccgaagagaacgtatcaggactactagaacttgtaaacgaaaaacaagcagaactatttgacgctattaaaacaatacacgaccaaatcatactaaatgaaatcgtaccagacggaaaatctatatcacaatcaatggtagacaaatacgaggcacatagagaacaactccaggtgttaaaagcactatacgaaaaaatggacgcgaaacaaataaaagcaataaaaaaggcatattcactatacatagatggtaaagacccaaaagcaaaaaaagtagataaaagagcacatcaaaatagagctgacttctataaagaagttaaaaaagttctagttgagctagacgacagcagagcagaaaaattactcggtttaatagagatgggacaatttctccccaaacagagaacagccatgaacggcgttatacccaaccaattacaccaagtggaactagacaaaataatcgaaatgcagagcaaatactacccatggttagcagaaaaaaatccagtcaaatcacaccaaaaaagagctccatacaaactagatgaactccttacatttcgagttccctattatgtaggacctatggtaacatccaaaaaacaacagcaaacaagcaactccaatttcgcatggatggttagaaaacaagagggcgaaatcactccctggaacttcgaagaaaaagtagatacaattgctagcgcaaatgactttatcaagcgaatgacagcgaaagatacctatttagtcggagaagacgtcctccccgctaatagcctattataccaaagatacaaggtacttaatgaactaaataacatcaaagtcaacggaagaagattaccagtcgagttaaaaagagaagcttatgttgctttgttcgaaaatggagattcaaaaacagtatcagcaaaatgttttaaaaactggctcaatgttaaactaaaaaaccttaatagtctaaagttagaaggattaagtactggaacgaaatttgacaataatctatcaacataccatgatctcaaaaaaatattcggtaaagcagtagatgatgcgggacgacaaaaagacttcgaacaaattatagaatggttaacaatattcgaagacaaaaaaatcctaagaatcaaactaaaagagatagaatggctaaccgaagagaatataactcaattaacaagattaaactataatggatggggacggctgtctagaagacttttaacaggaatttgtgactcaaatggacaacgaataatggactggctatgggatactacaaacaattttatgcaaatacagtcacaacctgacttccaaaaggcaattgtagaatataattccgataaattggaacaaggagatatagaacaaatactaggcgaagcgtacactagcccgcaaaacaaaaaagctataagaaaggtaatcaaagtcgtacaagacgttgaaaaagctatgggagcaaaaccaacaagcatctcaatagaatttaccagatcagatggaagaagtgagttaacaaacagtcggatgacacaactacagaaaactcttatgtcactatcagaagaaatgactgatcaagcactattagcagaattcaaagacttccaagcgtctaaaaaaaaactaacaaataaatattatctatattttactcaactagggagagacatgtacacaggagaaccactaaatatcgatcaactctcattatacagtgacggagaccatattctaccacgcagtttcatcaaggacgatagtttagataatcgagtacttacaaaacgggcggtaaataacgaaaaaagtgataccgttccagtatgtgaatacggcgcaaaaatgaaagacttttggaatgacctttacgataatggactaataagtaagcaaaaactagcaaacctactgacggacccggacgaaataggaccatacaaagcaaacggttttataagaaggcaattagtcgaaacttcacaagtaataaaactgagtgcagaaattctacaaacactttatcaagacacgaaaattattgaagtcagacagaaatatactcatgaattacgcgaacactttaactttgttaaaatacgacaactaaatgactaccaccatgccttcgatgcgtacctaaccgccttcagcggacgatacctataccaaaggtatccaaaactgaggggatactttgtctatggtgactacaacaaatttgatgcaaaaaaagacagaaactaccttaaatcatataacttcctctatgatctcgaagaaggaaaaacagatcaaatcgttgacaatgtagaacacaaagtgtttatgaaccggcaagacgcaataaatcaattaaaaaaagcatacgaatataaatacatgttagtaagtcaagaaacttataccaactcaggcgcaatgtttaaggaaaccatctaccccgtcaatcctaaacaaaaactaattcaaaaaaaaaacgacaaacccgtagatatctacggaggttatagcaataattatgacgcctatctttcaattgtaagattagaagacaaaaaaggaatcaaattcagggtcgtcggtatccccatgcgaaataaagcagagttagataacttagcaaaagaagaccataatggatatatgcaacggctaaatgaaatcgtagacgaacaaataaacagctcaggcaaaaaaaaaacattcagaattatactaccaaaagtacactttaaacaactagttgaagacgactctggcaaatttatgctaggatccgcagcctatccttataatgccaaacagcttgtcttatcagttaaatcaatagaatccctagctaacaaggatgcaagtgacagagaacttgttgcggtatacgaggaaattttaaatgtagtcaacgacaaattcaccctatatgacgcaagacaatttcggaacaagcttaccagttcaaaagacaaattcgtcgagttaaacactgctgacaaagtaaccgaactattagacatcctagatggcctacatgcaaatccagttgttaaaaaactcaaaataataagcggaagccccttcggattcttgcaaagacctagcggcatagttctaacagaaaacgccaaactcatctaccaaagccctactggaatattcgaacgagtagtatatcttagggacctatga

SEQ ID NO: 5256 - RNA, 3984 nt, synthetic construct
  misc_feature 1..3984: note = Cas9 variant
  source 1..3984: mol_type = other RNA
atggaaggacaaatgaaaaacaatggaaataacttacaacaagggaattactacctgggactcgacgtcggcacatcatcagtcggatgggccgtaacagacacagactacaacgtcctaaaattccgaggaaaaagcatgtggggagcacgactcttcgacgaagcatctacagccgaagaacgtcgcacccatcgaggtaacagaagaagactagccagaagaaaatatcgcctactattactagaacaactatttgaaaaagagataagaaagatcgacgataacttttttgtaagattacacgaatccaatttatgggccgatgacaaaagcaaaccatccaaatttttactattcaatgacacaaattttaccgacaaagactatttaaaaaaatacccaacgatttaccatttgagatccgacttaatacacaattcaacagaacacgatataaggctagtatttctcgcattacaccacctaataaaatatcgcggtcacttcatatatgacaatagcgctaatggggacgtaaaaaccttagacgaagcagtaagtgattttgaagagtacttaaatgaaaacgatatagaattcaacattgaaaacaaaaaagagtttataaacgtcctatccgacaaacacttaacaaaaaaagaaaaaaaaattagtctgaaaaaactctacggagacataacagactcagaaaatatcaatatttctgtcttaatagaaatgctatccgggtcatcaattagtttatccaacctttttaaagatatagaattcgatggaaaacagaatcttagtctcgactcagacattgaagaaacactaaatgatgtagtagatatactaggcgacaatatagacttattaattcacgcgaaagaagtctatgacattgctgtactaacttcgtcgctcggaaaacataagtacctctgcgacgccaaagtagaactattcgagaaaaataaaaaagacctgatgattctcaaaaaatatattaagaaaaaccatcccgaagactacaaaaaaatattcagttcaccaacagaaaaaaaaaactacgccgcatactcacaaacaaacagtaaaaatgtttgctcacaagaagaattctgcctatttatcaaaccatacatccgtgacatggtcaaatcagaaaatgaagacgaagtacgcattgcaaaagaagtagaagacaaatcgtttttaacgaaattgaaaggaacaaataattccgtagtcccatatcaaatacacgaaagagaactaaatcaaatcctcaaaaacatagtcgcctacttaccattcatgaatgacgaacaagaagacattagcgtcgtcgacaaaataaaactgatattcaaattcaaaataccctactacgtaggacccctcaatacaaaaagcaccaggtcttgggtttaccgctcagatgaaaaaatttacccatggaacttcagtaacgtcatagacttagacaagacggctcacgaatttatgaaccgtttaataggtagatgtacttacactaatgatcctgttttaccaatggatagtctactatattcaaagtataacgtactaaacgaaatcaacccaataaaagtgaacggaaaagcaataccagtagaagtaaaacaagctatatatacagacctattcgaaaatagcaaaaaaaaagtaactcgcaaaagcatttacatatacctactgaagaacggatacatcgaaaaagaagatatcgtgtcaggcatcgacatagaaataaaatctaaactcaaaagtcaccatgatttcacccaaatagtacaagaaaacaaatgcacacctgaagagatagaaagaatcattaaaggcatattagtctattccgacgataaaagcatgctacgaagatggctaaaaaacaatatcaaaggcctttctgaaaacgatgttaaatacctagcaaaattaaattataaagaatggggacgcctatcaaaaaccctcctcactgatatctataccatcaatccagaagatggtgaagcatgctcaattttggacataatgtggaacaccaatgccacactcatggagatactaagcaatgaaaaatatcaattcaaacaaaacatagaaaactacaaagcagaaaactacgacgaaaagcaaaacctacacgaagaactagacgacatgtacatatcaccggcagctcgcaggtcaatatggcaagcacttcgaatcgtagacgaaattgtagatataaagaaaagtgctcctaaaaagatattcatcgagatggctagagaaaaaaaaagtgcaatgaaaaaaaaacgaactgagtctcgtaaagacacactcttggaattatacaaaagctgcaaaagccaagctgacggattctatgatgaggaactattcgagaaactaagcaacgaatccaattcacgcctacggagggatcaactatatctttattacacccaaatgggaagaagcatgtatacaggaaagcgcatagacttcgacaaattgataaacgataaaaatacatacgatattgaccacatctatccacgatcaaagataaaagatgattcgataacaaacagagttctcgtagaaaaggacattaacggcgagaaaactgatatatatccgatatccgaagacatccgacaaaaaatgcaacctttctggaaaatattaaaagaaaaaggattaatcaacgaagaaaaatataaacgactaacccgaaactatgaattaaccgatgaagaattatcatcattcgtagcaagacaactcgtcgaaacacaacagagtacaaaggcccttgcaacactattaaaaaaagaatatccatcagccaaaatagtatattcaaaagctggtaacgtaagtgaatttcgcaaccgtaaagacaaggaactaccaaaatttcgggaaataaatgacctacatcacgcgaaggatgcttatctgaacattgtagtaggaaacgtgtatgacacaaaattcacagaaaaattttttaacaacattagaaacgaaaattactccctgaaaagagtatttgacttctcagtacccggggcttgggatgctaaaggaagcacattcaataccataaaaaagtatatggcaaaaaacaatccgatcatagctttcgcaccctatgaagtaaaaggagaactctttgaccaacagattgtgccaaaaggtaaaggtcagttcccaataaaacaaggaaaagatatcgaaaaatacggcggctataataaattatcctctgcgttcttatttgcggtagaatacaaaggaaaaaaagccagggagcgttctttagaaacagtatacataaaagacgttgaattgtacctacaagatccaataaaatactgcgagagtgttttaggtctcaaagaaccccagattatcaagccaaaaatcctgatgggaagtttattctcaataaataacaaaaaactggtagtcacaggacgatcaggaaagcaatacgtctgccatcatatataccaactaagcataaacgacgaagattctcaataccttaaaaacatagccaaatacttacaagaagaacccgatggaaacatagaacgacaaaacatattaaacattacttcagtaaacaacatcaaactcttcgatgtactttgcacgaaatttaacagcaatacatatgaaataatcttaaactcgctaaagaacgatgtaaatgagggaagagaaaaatttagtgaactagacatactagagcaatgtaacattttactacagctcctaaaagcatttaaatgtaatagagaaagctccaacctagaaaaactaaacaacaaaaaacaagccggagtaattgtaattccccatctatttacgaaatgttctgtattcaaagtaatacaccaatcgataacaggattattcgaaaaagaaatggatttattaaaatga

SEQ ID NO: 5257 - RNA, 3984 nt, synthetic construct
  misc_feature 1..3984: note = Cas9 variant
  source 1..3984: mol_type = other RNA
atgaaaaattactcaataggcctagacattggtacgggatcagtagggtgggtctgtattgatgaaaattatcaaatattaagatataacaacagagctgcttttggagtacatgaatttgaaacggcacacgtagcagaagaacgaaggataaaaagaggagcaaggcgaaggtacaatagaagaaagaaacgaatacaactacttcaatccctattcgtaccacacatgcaacaaaaagccttcttcgctccgacgataactgaacattactggaaaaatgataaccaatttgaaaacagaaccctctcagaagtactaatgagcctaggcatgaaccctaacacttatcccaccatattccacctaagacacgaacttatcgaatcaagtgtaaagaaagacgctcgtctcatatatctagcgcttcataatcttgtgaaatttcgaggccacttcttacaagagggttccacttggaatgccaatatgtcagacgccaacttatccgaacaatttgaacaactcctacatatatataccgagatggaagaattaccccaagtatcattgaccgcacaacaatccaccgatgtagaacatattcttctaaacaaccatataagcaaagctgaaagagcacgccaattgacagcattattcgagcgtacatatgaacctttctttaaactaatagtaggattagacatcgctgcagcgcaactcttcaaacaatcagaacaacaacttttatataaagaaagtaaaacaaaagtaaaccttacagctgaaaccctacccgaagtgctacaaaccatgctggaaccagaggtcgctttcatagaagcagttcaaccattttaccaacaaaccgtattattcgacctactaaaaggtcaaagctacgtcgcagctgcaaaagtggaagcattcaaccaatacgaaagagacctagctctacttaaaagtgtaatcaacgaagtcggatcagaaaaacaatacagagcattctttattacatcaaaacaaaagaaacgacaatttgagcaaaaaccaaacatggaattactatgtcatcttgatagatttaatcgcgagaaaaagtacgaagaaacattctataaagaggtatcgaaactactgacagcacttatcaaagaagcaacgggagaagtaaaagaacacattgaacaaattatccaagcaatggaatcacaatctttcctagtgaaacaaaaaggtattcaaaatgcctccatcccatatcaaaatagcctatacgaagcagaaatgatcttaagaaaccaacaagcctactacccttggataaccgatgagttcatagaaaaggttaaacaacttatcgcgttcagaataccatactacataggtcccctagttcagggcgatgaacaaccattcggatggcttcagagacaggctgatggaaacataacaccatggaatttcgatgaaaaggtaaataaggcagcatcagcagaatcattcatcacacgtatgaccaaaaattgcacatatctaaaagaagaaaaagttcttccaaaacaatcacttatgtatgaaaaattcacattattaaacgaactgaactccgtacaaatacgatcatcactagaacaaccccacaagaaacaccgattatgtgaagatatgaaacagtggatcattgaacacgtattcaagaaaacaaaaactgtaacccacaaaacactaatacaagccttaaagaaatcaccatacaaagacgaactttatgatgaaagtacaggtaactggaaagatgtttatggaacgcaaaaagaagatagatttgcatcttctctatccacatatatttcattaaaagaaatagtaggcgatattgtcgacaacgcctttatggaagaaataatatactggctaacagtattcaccgatagagacatcataaccttaaaaatgaacgataaatacccttttatcactgaacaacaaatacaaaggctcttatcacttaatatatcaggatggggacaattatcacaacgactacttcaaagcatccctgtagatgacatgaaccgctcagtaatagaatatatggagaaacacgcagtaaactttatggaactcttatcacccagacagtcagatttagcatacaaaatcgaacaagttaacaaacaacacagtaaaaagatacacaaaataagatacgaagacatagaacagcttaccggttcaccagctctaaaaagaggtatctggagaagcgttaaaatcatcgaagaactcactgcgatatttggcgaacccaaaaatataatgatagaggtagcacgagaagatcaagctagccacagaacaaagtccagaaaagaacaatgggaatctataggtaaatcactcgctaaggaagaaaaagaattaaaagcattctttaaagaaatggcacaataccccaaacaacaatttgatagaacgagattttggttatatgtcacacaacaagggaagtgcctatatactggcaaaacactcagactggaagacctatcatcctatgaaatcgaccacatcttaccaagaaactttgtaaaggacgactcaatagacaacctcgccctagtctatcctatggcaaaccaagagaaaaataaggcaggtaataacaaaatgcccttagaaatcatagatgcaaaacaacaaccagcaatgatggcccactggaaaagactcaatcaattaaaactaatatcggactccaaactacataaacttatgaaaccttcttttaacgatgtagacaaagaaaattttatagccagacagctagtagaaactagacaaataatcaaacacgttcgcgacctgttacaagaacgatttgaacacacagacatacacgttgttaaagcaaaaatggtatcacaatttcgcaaattctccagaataccaaagatccgggactataataacaaacatcatgcaatggacgcattattcacgacagtactaatccaatttattctacaaaaatatggtaaaaatttccttcaattcgatttgcaacataaagatatatcaaagaaatggtcaaaaattgcccaaagcacaaaacacttctttctttttcaacaatttgctgaacaacaaataaaatctccagtaactaaagaattagtcagtggagttcaatattttgaacacatattttatgaacaatcctggcaaacaactaaaatgactcaaacgatagactcgaacttctacaaagaaacaatattttcacccaaactcaaaacagctaaatatacaagtgcgaaagccgaaaaatttgttcacgatgcaatcgtaaagtacgcagtctgtggaatacaatacacatctttaaagaaaaataaagaacaacatcacgtattgttaactgacatcaatgtcatagaacattaccaattaaaagaggcttccttgaatgaattagctctacatttagccaaaagagaatcaaaagacgacgtaatagacgcgcaaatgctagtcgtaataccaaaatataagaaaattatgttaaatggaagcccgtactactgcatatcaagtgacgaacgccatatcgccactcaattcgtactgaggaaagacttactagaggctgttctccatgtcaatgatgaaacatctgttgacgaactaagaacactcttcaggtcaatagtcgaagagatgatgacacaatataaggtatacaataaagacacaatcagaaataaaatagatgcgtttatagaaacagaattaatagacgttgaaacttttcaagtcggatttactgagataaagaaaatggtagcagcaaacgcacaaagatccgacaaattcggcggaagactaagacaagtcatgaaagtcgaagacatttacattatagatgaaagcataaccggactcagatataggaaaccaagaaaattagttaaatga

SEQ ID NO: 5258 - RNA, 3984 nt, synthetic construct
  misc_feature 1..3984: note = Cas9 variant
  source 1..3984: mol_type = other RNA
atgaagaaaaactacactattggattagatattgggactgcgtctgtaggttgggcagtcctaacagaggactacgaattaataaaaaggaaaatgaaaatctctggcaacacacaaaaaaaagcggttaaaaaaaacttttggggtgtaagattattcgaacaaggagaaaccgcagagggacgaagattgaaacgaacaacaagaagacgaatagcaagaagacgacaaaggatccagtatctaaggacgatattcgacgaaggaatgaaccaagtagacgcaaacttctttgctagattagatgagagcttttctataatagatgaaaaagaaaacgaaagacatccaatatttggcaatgtagccgaagaagcagcttaccacgaacaattccccacaatctaccacctaagagaacatttagccaattcatcagaacaagccgatctaagactcgtatatctggccttagcacatattataaaattcagaggacacttcctaatcgaaggagaattaaatacagaaaactcgagcgtaagtggcacatttgaacaatttataaaagtatataacgaaacgtttaatgtcgaaaaagcactagacttaacagtagacctagacggaatagcagaacaaaaaataagtagaatgaaaagagcagaacttatcctcagcctattccctgaagaaaaatcaaccggtgattttgctcaattcataaaaatgattgtaggaaaccaaggaaatgtgaaaaaaaccttcagtcttaatgaagacgcaaaaatacaattctctaaagaagaatacgaggaaaatctagagaccctgctagcagaaatcggagaagatttccgatcagtgtttgacgcggcaaaatcagtatatgatgcaataagtctagccaacatactcaaagtaaccgatgcaacaactagagcaaaattaagttcaagtatggtcgtgagattcacagatcacaaggaagatctaaaaacattaaaacgattcgtgagagaaaatctaccagatgaatatgacgatctgttcaaaaacaaaaaggttgcaggctatgcaggatacatagacgggaatgaaacacaagaagctttctacaaatacctaaaaaaaacactagcgaaagccacaggcgcagaaggtttcctcgctaaaatggaacaggaagactttctaagaaaacaacgaacttttgacaacggagtaatcccataccagctccacctagaagaactaaaggccattataaaaaaccaaaaatcgtattatagttttctggatgaagaaaaaatatcacaattaatgacattccgtataccttactatgttggacctttagctaaagaaaaaggtcaattcgcctggttaacaagaaaggaaatgggaaaaattacgccctggaacttaaatgaaaaagtcgacatagaaaaatcggcaacagacttcgtcgaacgaatgacaaacaatgattcttacctacctatggaaaaagtcttaccaaaacactcattattatacgagacctttactgtctacaacgaactaactaaagtacgttatatagatgacaacgggagagcccaaaattttagcagcaaagaaaaaagacaaatcataaacgaactatttaagcaacaaagaaaagtaaaaaaagaaatgttggaagcattcttaaaaaatgaatatgggatagaaaacccaaaagtggaagggattgaaaaaagctttaacgcctgtttaggaacatatcatgacttgataaagttgggaattagacccgaactattcgaacaacctgaacacgaacaacaatttgaacaaatagtaaaaatcctaacagtatttgaagatcggaaaatgagaagaaagcaactagaaaaattcagtaacattttgacagaagaagaacaaaaacagttagaacgaaaacactataaaggatggggcagattaagtgcaaagttgatacacggaatagttgaccaaaaaacacaaaaaacgatactagactatctaatagatgacgatgacctacccaagaacagaaacagaaatttcatgcaattaataaatgacgaaaacctctcctttaaagaagaaatcgaaaaaattgcctttgacaatgacaagagcacagaagaaattgtgcaagaacttgcgggttcaccagccataaaaaaaggtatattacaaagtctaaaaatagttgaagaaatcatagatataatgggagaattaccaactaacatagtcgttgaaatggccagagaaaatcaaaccacagctcaaggtaacagagcctccaaagcaagaatgaagtacctcgaagaatcaatcaaaaagcttggaagttccatactcgaagatgaaccaatatcgaaagatgctaacctactaagaaatgatagactgtttctttattatttacagaacggtagagatatgtatacaggaaatgaactggatataaataaccttagttcatatgatatagatcacatagttccacaatcattcgtaaaagatgatagtattgataacagagtactaacaactagtagtatgaacagaggaaaatcaaacacggtcccagcggagtcagtcgtaaaaaaaatgaggcctacatgggaacgtttactcgctagtggactaatatcgaaaaaaaaattcagttatttaactaaagctacaaatggaggtcttaccgaagaagataaagcacatttcatacaacgacaactcgtggaaacacgacaaatcacgaaaaacgttgcacaaattctccatcaaaaatataacaacgaacaactaagcgaaaaaccagttagagttattacgctaaaatcagccctggcttcccaattccgaaaagacttctctttatacaaaatacgcgaacttaacgattaccatcatgcacaggatgcatatctaaacggagtaatcgcacaagcactattaaaagtatatccgaaactcgaaccagagttcgtctacggggaatatcaaaaagtttcaattagagcacttaacaaggcaactgcaaaaaaagaattctattccaacatcatgaactttttcacttctgatgaaatggtagccaatgaggaaactggagaggtattatggaatagacaaagagacataaagactatcaaaaaggtcatgaattatcaccaaatgaacattgttaaaaaagttgaaattcaaactggtgcttttaccaaagaatccatattaccgaaaggtccatcaaagaaacttattgcaagaaaaaacaattgggctccggtaaattacggaggtgtcgatagccctacagttgcctactcagttatcattacccacgagaaaggaaaagcagcaaaagttgttcaacaactagtcggtattaaaattctggaacgtcaagcattcgaacaagacgaagtagcgtttttagaagaaaaaggatttattcacccgaaggtccaattaaaattgcccaaatattccttatatcaatttgctgacggcagacgcagactcttagcatcagccgaggaaagccaaaaaggcaaccaaatggttctccctgtacatctcatcgaattactataccacgccaaacacgtctcagatagctctggaaagtcactagaatacctcaacgaacataggcatgaattcgcagaactactagaagccatattacagtttacagaacaatacattgacgcagggaaaaaccaaaaaaaagttcgagacctttacgaaaaaaaccaagatgccgacatgagagaattagcatcctcgttcatacaattattacaattaaacaagcaaggagcaccagcagattttaaattttttggagaaacaatacctagaagacgatataaaaatacagctgaaatagtcgatgccacattcataaaccaaagcatcacaggtttatatgaaacacaaaaaaggttagtatga

SEQ ID NO: 5259 - RNA, 3984 nt, synthetic construct
  misc_feature 1..3984: note = Cas9 variant
  source 1..3984: mol_type = other RNA
atgaccgaacaacaacaaccatataacattgggctagacataggcacatcaagtattggatgggccgtaactgatcaaaatgacaagttattacacatcaggggacacaacggaataggcgttagactatttaaagaaggagaatcagcagcagaaagacgagggtttagaacaacgaggcgcagactctccagaagaagatggcgtctaagatttctcgataggatatttgacgctgaattagcaaaggttgaccccaatttcctagcacgtctcaaacaatcaaatatttccccactagaccccaataaacaaatgttcgggaatatactattcgatgacccacaattcgatgaccaaaagttccatcaacaataccctactatataccacttaagatcagcactggcacaaccagatgcaccccaagcagacgtcagattaatatacctcgcgctacaccatatgattaaattcagagggcactttctaaacggtgctgcagtagaaaaatttcatggcggacaactccatttagagtcagagttccaagaacttaaccaaatcttctcaaaccagcagcgagaccatgttcaactacaaacttcaagtctagatgaagtagcgacaatactaaaagacaatcaacgcacaccgagtgataggcaacgcgaacttagtgctagattatttgttcccgtggataaaacaatagacaaggaaaacaagaaactcgccacagaattactaaaagccgtgctcggattaaaagccaaatttgacgtaatactaggggtggaagccaccgacccacaagcattcaaactacagttctcttcagacgatttcgatgacaaaatagcagaactagctagcgaactaaccgacgaagcaaacgaaatcctaacagtactccaaaggttatactttagtttaaatttagcggatatactaaccaacagacaaacaaaacaagtcgctgactcgatatcaacagcaatgataaaccgttatgacgaccacaaacaccacttaaaaatgttgaaagaactggaagcgcaagtaacgcaagaacaacgcgatggactaaagaaagcctataacgaatacatagacggggacaaacccacaattgacacgttctacaccaacgtaaagaaaaatctagatgatagtgaattagcaaatcaaattaaatccttgatcgatcttcaagccttcatgccaaaacaaagatcaaaagaaaatggatcaataccacatcaactgcaccaacgagaactcgatcaattaatagaggtccaaggaaaatactatccttggctcctagccgcaaaagacaaactagatgccttaatagcctttcgtgtaccctactacgtaggcccaatgatagaccctaatcaatcagatgacccacagaacactaaatttgcctggatggtaagaaaagaagcaggagaaatcacgccctggaactttgaagaaaaggtagacaaaacaagctccgccactaacttcataaaaagaatgaccactacagacacgtatttattaggagaaccggtattacctaaaaacagcttattataccaacaatttactgtcttaaacgagctgaacaaactaaaagtcaacggaaaagcactaactgtagaccaaaagaaatacttatacgatcatgtttgtaagaaacaaagacgagttaccctaaagaaattgtcagattgccttgtagctaggggtgatttccctatgggcgcaatattcacaggaacaacagaccagaaaaatatgaataatacactcaaaacctaccaagacttccaagaaatcttcggcgacgaaatagataatccagatagacaagttgattttgagaaaatgatagaatggagtacaatctttgaagatcgggaaatcttcaaactaaaattagctgaactcaactggctcacaagtgaacaattagaaagggtatcaaagaaaagatatcaaggatggggtcgcctcagtcaaaaactgttaacccacatcgtaaacgaaaatggagagcgaataatcgaccaactctggaatactaatcaaaacttcatggaaataatgggacaagattctgtcaaacaagcaatacaagaacataatggcgcaaacgttgcccaaactggaataaacgaaacaattgatgaattatacacatctccacaaaacaagaaagccataagacaaatactcctagtagttgatgacatcaagaaagcagtaggatatgcaccagccaatataatgatggaatttgcaagagaagatagggatgaccacagactaatagctagtagagcacgtcaactagagaaaacttatcaagaaataagtaaaaattggtttgacaatgagtccgtaactcaagaactaaaagatcaaattaaaaacaaaacgaaattcacagaccgactatatctatacttcatacagggaggaatagatctttatacaggtcatcccttaaacatagaccaactaagttcatatgacatagaccatattttaccgcagagcttcttactagataattctcttaacaatagggtactaacctcccaagcagaaaacagagtacataaagaagatagactgcccggagagaccgtcgcaaataaaatgaggcccacttggaaaatgatgagagaacaaggacttatgacacaaagaaaatacaataatctaactctaaaaccagaccaaatatccaaatttaataataggggacaattcatcaaccgtcaacttgtagaaacaagacaagtgataaaattggcagccgacataatgtcacaaaaataccaagcagatcaaactaaagtcgtaacagtaaaagcaaacttaacacaccacatgagagaaaaatttaatttctataaatctaggaacgtaaatgactatcatcacgcttttgatgcctatctaacactattcgtcggaaactggttattaaaagaatatccgaaactacaaccatatttcgtatatggtgacttcgccaaaacaggaacgaacaacttaaaatctttcaatttcctatatagatttgaacgagaccacaaattaaacgacaaaggcgctattgacactgataaagaccaacaattaggatatatgaaaaggatttatagattcaagaaaatgctagtgaccaaacaacttgaaacaaacgaaggagcgttatacggtcaaacactatatcccgctcctaaaaatgacaagaaaactcgaaatttaataaattcaaagaaaaatcgcccaagcgacatatatggcggttattctaacgaaaacgggagcttcctaacattagtgaaactcaagaaaggctcaaaatacgactatagattggtagctgtaccagtctcaaaaataagtgaaattaaagaatctgaactagctactatagaaaaagcaatagcaccacaattcctaaaatcatcaggaaaataccgagacttccaagttgtactatcaaaaatcctaataaaccaaaaagtaatcgacgatggtatgatattcacaataggatctaaatcatacaaacataacgcaaaacaagtagtcttatccgataacagcatacaaatagtgagcaccctttcaagaatctcagacaaagaaaaactaatcacagtatttgatgaaatagtagacataacgagtaaatacttaccatggtacaaagtaaacgacgtagagaaaacgaaaatgctattcaggcaaatgcaagatattgacgaaatgaaaaagattatagacaatagtcttataggcttacactgcaacgcaagcataacagatttaggaaaagtaggcttaagtaagtactggggaagattcgtattaacagcaggtataagtttaacagtagacgcccaattaatatatcagtcaccaaccggactgtttgaacatagagtcaaggtatcggatttatga

SEQ ID NO: 5260 - RNA, 3990 nt, synthetic construct
  misc_feature 1..3990: note = Cas9 variant
  source 1..3990: mol_type = other RNA
atgaacaaacaaccttataacatcggactggacattggcacctcatccgtgggatggagtgccacagaactagacaacaggctacttcatataaaaggacataacggtattggagtacgtcttttcaaagaaggcgaatcggcggctgacaggagaggattcagaacaacccgacgaaggcttgcaagacgaaaatggcgactcagactcctaaatgaaatatttgccactgaaatcgccaaagttgatccttcattcttcgcaagactcaaacaaagcaacgtaagtccaaaagaccccaataaaacaatgttcggaaacatactttttgacgatgaaaacctggatgatcaaaaatttcatcatgactataagactatctatcacctcagacaagcaataataaaccatcctgagcaaaaattcgacataaggttaatatatctagcaatgcaccacataataaaatatcgaggtcattttctaaaccaagcaaatgtacaagatttcaagggaggcaaaatagatttagaaaaatcttttaaagccttaaatgacatattcgaaaatcaagggagagatcttagattagtaactgacgaggcaaatcaatacgtcaaagtactctccgataacgcaaaaactcgatcagaccgtaaaaaagaactatctaagcttctgtatgtaccaatagataaagacacagacaagaactctaaaaaagtcacaggagaaatactaaaagctattcttggaaataaagcaaaattcgatgttatcttcggcatagaagtagaaaaccccaaagaatgggtattaactttcaacagtgacgactttgatgataaaatagaaggactctcctcacaaatgacagacgaagattcagaaatcctattaatactaaaagaattgtatttcgctttaaatctaagtgacattctaaataactctgttaccgataagaatgcaaaaactttatcagaagctatgataaatagatacgatgaccataaaaaccaactagcgatgctaaaaaaagtaatagactcatcagacaaaaaacacgcaaaagagctaaaagaagcatattcagcctatatcgatggcgaaaataacaaaaaaatcagcttcgaagacctcaaaaaaagaatacaaaaaaatctagtcgattcagagttaagtcaaaaaatcaatgacctactcgaccatgattatttcctcccaaaacaaagatctaaggaaaatggagctatccctcatcaattacaacaacaagaattagaccaaattatagaatctcaaaaacaatattatccctttctagccgaactaaacccaaatgaaaaacgtagcagacaagcaaaatacaaactagacgaattagtagcttttcgagtttcttattacgtcggcccaatggtagaagtaactgacagcaaccaagaaaacaatggcaaattcgcatggatgattagaaaagaacaaggagaaataactccatggaattttgacgagaaagtcgatcgaacagaaacagctacaaaattcattacacgcatgactacaaccgacacatatctaatcggtgaaccagtactcccgaaaaatagtctcctctaccagaaatttgtagtactgaatgaactaaacaatttgaaaataaaccaagaaaccataacacctggacaaaaacaatacttatatgaacatgtcatgaaaaaaaacaagcgcgtaactttaaagaaaatagcagacgcattagtgataaaaggtgattacccctacgcacccgaagttaaaggtacgacggaccagaaaaatttaaataacggcctcaccacctacattgacttagccaaaatcttcggaaacgaactagatgacgtcgaccgcgaagccgactttgaaaaaatcatagaatggtctacaatattcgaagaccaacacatattcgtcttaaaactacaagaactaaaatggctaacagaaaaacaaagaaatcaagttgttaaactccgttaccaaggatggggaaaactatcgaaagaactacttgccggacttgtagacgacaacggacagaggatcatcgaccttctatggtctgacaaccaaaactttatgcaaatcgtaaaccaaaaatcctttaaagaatctatagctgatcataatggagcacatctcgaagagaaaaacctgaaagacgtaataaacgatctctatacctccccacaaaataaaaaagccatacgccaagttatactagtagtcgacgatattatcaacgcagtaggatacgaaccagctaacatcatgatggaattcgcacgagaagattcaaatgaccacaggctaacaaactcacgtagtagacaacttgaaaatgtctacaaagatataactaattcctggtttgataacgactccgtaaaagatgagctagaagacaaaataaaaaataaagacaaatttacagaccgattatacttatattttacacaaggaggcaaagatttatatactggcgaaccgctaaacatagacgacttatcgtcatacgacatagatcatatattaccgcaatcctttatactagacaattcattagacaaccgcgtccttacttcacagcgaaataatagagtaagtaaagaagatcagcttccgggagaattattcgggactaaaatgcacgccttctggaaaagattgaaagcagctcacctcatttcaaataaaaaatactataatctaacattaacaccaaatagcatatctaaatttaacaatcaaggcagatttataaatcggcagctagtagaaacacgacaagtaataaagctagcagcagaaatactccacaaccgttacagcgaagaaaaaggaactaatatcgtaacgattaaagcaaacttaacacaccacatgcgagaaaaattcaacttttacaaaaacagaaatgtaaacgattaccaccacgcatttgacgcatacctcacagcttttgtcggtaattggcttttacaacaatacccaaaattaaaaccatactttgtttatggagacttcgcgaaaacagaaataaataatttaaaaagttttaatatgctctataaattcgaacaagcacaccaacttaacgaaaaagacggtaaaatcgccaaagataccgacgcactactaggctatatgaaaaatgtatatcattttaaaaaaatgcttgtaaccaaagaactggaaactaatcacggcgccctatttaaccaaacactctacccttcaccagcacatgacataaaaaaacgacagttaataaaaccaaaggacaatcggcctaccgatatatacggaggatatacccatgaagaaagaaaatacatgtccctagtcaaagtaattgggaagaaagataacgaataccgtatggcgaacgtcccactcctgaaaatcaacaagaacaacgatattaaagaaatcctaaaatcacaattttcaaacaagaagtttgaaatcgtacttcctaaagtactaaaaaatcaactattctcagaaaacggtgccctgttcgtgatcggatccaaaggatataaatacaatgcaaaccaactagtcctctctgaccttgacatgaaactcctcaatgacctgtctaataacaagagtatagatgaagtaacaattaaccaactcttcaaaaatatcgtagatagcactaacaaatatatgcccttatacgaaataaaaaacttaaacgaagtcgtagaaaaatttaacaacctagaatttaatgataaaaaaaaaactataactgacttcctacttgctacccacgcaaacccaacgatgagcaacttaaaaaatataggactaccttacttcggacgattcatcagaaacacaggtatcaagttatccgaaaatgccaacgtaatctaccaatccccaacaggactcttctccaggaaaatcaaaatatccgacttctga

SEQ ID NO: 5261 - RNA, 3993 nt, synthetic construct
  misc_feature 1..3993: note = Cas9 variant
  source 1..3993: mol_type = other RNA
atgaaaaacgactataccataggactagatatcggtacgaactcagtaggatattctgtagtaacagacgattataaagtaatatccaaaaaaatgaacgttttcggaaataccgagaaaaaaagcatcaagaagaacttttggggagtgcgcctttttgaatcaggacaaacagcccaagaagcgcgcatgaaaagaacgtcacggcgacgaatagcacgtcgaaaaaacagaatttgttacctacaagaaatcttccagccagaaatgaatcacttagataacaacttcttttatagattaaacgaatccttcctagtagccgacgacgcgaaatatgacaaacatcctatttttggtactctggatgaggagatccatttccatgaacaattcccaacaatctatcacttaaggaaatacttggcagacggagacgaaaaagcagatctacgtctagtctacttagcaatagcacatatcataaaattccgcggaaatttcttaatagaaggagaactaaatacggaaaacaatagcgtcatagaactatccaaagtatttgtgcaattatataatcaaacgctcagcgagctagagggttttcaatttatagatgaatcgattgactttagcgaagtgctaactcaacaactctcaaaaagcgaacgagcagacaatgtactcaaactatttccagacgaaaaaggaacaggaatttttgcgcaattcataaaattaatagtcggtaaccaaggaaactttaaaaaagtattccaacttgaggaagaccaaaaattacaactatctacagacgactacgaggaaaatattgaaaacttgttagccataataggagacgagtacggagatatatttgtagccgcacaaaatctatatcaagcaatattactcgcaggcatcttaacatcaaccgaaaaaaccagggctaaattgagtgcatcaatgatacaaagatatgaagaacacgcaaaagatctaaagttattaaaacgcttcgtaaaagagcacataccagacaaatacgctgaaatcttcaacgatgccacaaaaaacggctacgccggttacatagatgggaaaaccaaagaagaagaattctataaatatttaaaaactactctagttcaaaaaagtggataccaatactttatagaaaaaatagaacaagaaaattttttaagaaaacaacgaatttacgacaacggtgtgataccacaccaggtacatgccgaagaactgagagcaattctcaggaaacaagaaaaatactactccttcttaaaagaaaaccacgaaaagattgaacagatatttaaagtccgtatcccgtattatgtaggtcctctagcaaaacacaatgaacaatcacgcttcgcctggaacattagaaaatcagacgaacccattaggccatggaatatgaatgacgtcgtagacgagaacgcaagtgcagttgcattcatagaaaggatgacaataaaagacatatacctaaacgaaaacgtactgccccgccacagtttaatatacgaaaaattcaccgtttttaacgaactaacaaaagtcctctatgcagacgataggggagtatttcaaagattttctgccgaagaaaaggaagatatattcgagaaactttttaaatcagaaaggaaagtgacaaaaaaaaagctagaaaattatttgcgtatagaactatctatttcgtcacctagcgtcaaaggtatagaagaacaattcaatgctaatttcggcacatatctcgacttaaaaaaatttgacgagctccatccatatctagacgatgaaaaatatcaagataccttggaagaagtaatcaaagtacttaccgttttcgaagatagatcaatgatccaaaaccaactagaacaactccctttaaacctaagcacaaaaacaatcaaagcattatcccgacgcaaatatacaggatggggaagactatccgcgcgcctaatcgatggtatccacgataaaaatagcggtaaaacaatattagactacctcatagaagacgaatccgattcatatatcgtaaataggaacttcatgcaattaataaatgacgatcatttatcatttaaaaaaataatagaggactcacaaccttacaaagaacaacaaagcgccgaagaaattgtttccgaactatccggcagtccagccatcaagaaaggaattttacagtctttaaaaatagttgatgaactagttgcaataatgggatataaaccaaaaaatatagttgtagaaatggctcgggaaaaccaaactacgggaagaggaaaacagaactccaaaccaagattaaaaggaatcgaaaatggactaaaagagttctcggatagtgtactaaaaggttccagcatagataataagcaactacaaaacgatcgactctatttatactacttacaaaacggtaaagatatgtatacaggtcatgaactcgatatcgaccacctatcaacatatgatatagaccatatcatacctcaatcatttctaacagacaacagcatagataacagagtactcaccacctctaaaagcaacagagggaagagcgacaacgtaccatcagaagaggttgtccgaaaaatggaccgcttttggcgaaaactcctaaacgcaaaattaatttcagaacgaaaatacacaaatttaaccaaaaaagaacttacagaatcagataaagcaggcttcctaaaaagacaactcgttgaaacaaggcaaataacaaaacacgtagcaacaatactagattccaaattcaatgaagattcaaataatcgagacgttcaaataataacgctaaaaagtgcattagtgtccgagtttcggaaaacatttaacctctataaagtcagagaaataaatgatcttcatcacgcacacgatgcatacctaaatgcagtagtagccttaagcttactacgagtatatcctcagctcaaaccggaattcgtgtacggcgaatacggaaaaaactccattcacgaccagaacaaagcaaccataaaaaaacagttttactccaatataacacggtacttcgcatccaaagactacattattaacgatgatggtgaaatactatggaataaacaagaaaccatagcccaagtcatcaaaacactaggaatgcaccaagtcaatgtagtaaaaaaagtggaaatacaaaaaggaggattctcaaaagaaagtatacaaccaaaaggagaaagtcaaaaacttatacgccgaaaacaacaatggaacacaaaaaaatatggaggcttcgactctccagtagtagcatacgcgatactattgtctttcgacaaaggtaaacgaaaagcacgtagcttcaaaatagttggaataaccatccaggaccgagaatcgttcgaaggaaatcctatactctacctatcaaaaaaggattatcacaacccgaaagtagaagcaattctacccaaatattccctattcgaatttgaaaatggcagaagacgcatggtagcgagcgcatccgaaacccaaaaaggaaaccaacttataataccaggacacttaatggagctactataccactcaaagaaaataatcaatgggaaaaattcagattcagtttcttatatccaaaataacaaggagaaattcagagagatatttgaatacatcgttgacttttcatctaaatacatatcggcagatgcaaatttaaacaaaatagaaaaaattttcgaaaacaacttccataaagcatccgaacaggagatagcaaaatcattcattaatcttctcacattcacggcaatgggtgcaccagcagatttcgaattcttcggagaaaaaataccaagaaaacgatatgtatcaatatccgaaataatagacgctgtgttcatacaccagagcataactggactatacgaaaccagagtaagactaaccgaagtatga

SEQ ID NO: 5262 - RNA, 3993 nt, synthetic construct
  misc_feature 1..3993: note = Cas9 variant
  source 1..3993: mol_type = other RNA
atggaaaaagaatataccataggactagatataggtaccaattctgtaggctgggcggtactcacagacgactatcgattagtcgcacgaaaaatgtcaatccaaggtgactccaatcgtaaaaaaataaaaaaaaacttctggggagcaagattattcgaagaaggtaaaaccgcacaatttagacgaattaaaagaaccaaccgaagacgcatcgccaggagaagacaaagggtgctcgcattgcaagatatctttgcagaagaaatccacaaaaaggaccccaacttttttgcacgactagaagaaggagatagagtcgaagccgacaaacgcttcgctaaatttccagtatttgccacactatccgaggaaaaaaactatcaccgacaatacccaactatataccacttaagacatgacttagcaaattctaaagaacaggcggatattagactggtctacctagcaatagcacattgcttaaaatacaggggacatttcctctttgaaggagaactagatacggaaaatacctccgtcacagaaaactatcagcaatttcttcaagcataccaacaattttttcctgaacctataggtgacttagacgacgcagtcccaatactaacagaacgcttatccaaagcaaaacgagtcgaaaaagtactcgcatactacccaagtgaaaaatcaaccggaaacttcgctcagtttctcaagctaatggtaggaaatcaagccaattttaaaaaaacatttgacctcgaagaagaaatgaaacttaatttcacacgcgactgttatgaagaggatttgaacgaattattagaaaagacgtcagacgactatgccgaactattcttaaaagctaaaggagtatatgacgcaatactcctgtcccaaatactgagtaaaagcgacgacgaaaccaaggccaaactcagtgcaaacatgaagctaagattcgaagaacatcaacgagacttaaaacaactcaaggaattagttagaagagatttacctaaaaaatacgacgacttcttcaaaaaccgttctaaaaacggatatgcaggatacgtaaaaggaaaagcaacacaggaagatttttacaaatttctaagaacagaactcgccggacttgaggaatcacaaagcataatggagaaaatcgatttagaaatctacttgctgaaacaaagaacttttgcaaatggagtaataccccaccaaatacacctcgtagaaatgagagaaataatggaccgacaaaagagattctatcccttcctaaaaggagcccagggcaagattgaaaaactcctcacttttagaataccatactacgtaggacctctcgcccaagaaggacaaagtcctttcgcgtggattaaaagaaaatctccatcccaaataaccccatggaatttcgcagaagtagtcgacaaggaaaattcagcaatagaatttattgaaaggatgaccaaccaagacacatacctacctaaagaaaaggttttacctaaacaatcattaatctatcaaagattcatgatttttaacgaactaacaaaagtttcatacactgacgaaagaggaaaaagccactacttctcgtcggaacaaaaaagaaaaatatttaatgaactattcaaacaacatccaagagttaccgaaaaacagcttagaaagtttctcgagctaaacgaacaaatcgattccaccgaaatcaaaggaattgaaaccagcttcaatgcaagttattctacttatcacgatttactcaaactcagcgaccaaatggatacactattagacgatccagatatgacaactatgtttgaagaaattattaaaatcttgaccattttcgaagatagagaaatgatacgagaacaactgaaaccgtacgaaacagtcttaggtttacctgccataaaaaaactagccaaaaaacactatacgggatggggcaggttatcagaaaaaatgatccaaggtatgagggaaaaacaatcaagaaaaaccatattagactatctgattgacgacgacgactttccgtgcaaccgcaatcgaaacttcatgcaactaataaatgatgaccacctatcctttaaagaaaccatcgccaacgaattgataatgtcagactctaatgtcctcctagatcaggtcaaagctatacccggatcaccagcagtaaaaaaaggaatatggcaaagcataaaaatagtagaagaaatcatagggataataggcaaagcaccaaagaatatagtcattgaaatggcccgtgaaaatcaaagaacttcacgctcaagaccaagattaaaagccttagaagaagctctaaaaaatattgacagtcccctcctaaaagactaccctacagataatcaagcactacaaaaagatagactatatctatattacctacaaaacgggaaagacatgtacactggagaaccactagaaattcaccgactaagcgagtatgacattgatcatatcataccaagatcgtttatagtcgacaattcgctagacaataaagtacttgtctcctccaaagtaaaccgaggaaagttagacaacgctcccgacccgttagtcgtgaagcgaatgagatcacattgggaaaaactacaccaagcaaaattgatctcagacaaaaaactagctaaccttaccaaacaaaacttaactgaagcagataaagctcgcttcatacaaagacagttagtagagacaagacaaataactaaacatgtagcaaatctactccatcagcattttaacttgccagaagaagtgtcagcaacagaaaaaacctcaataataacattaaaaagtacactaacatcacaattccgacaaatgtttgacatttataaagtacgcgaaataaaccaccaccatcacgctcacgatgcttacctaaacggagtcgtagctatgacattactcaaaaaatatccgaaacttgcaccagaattcgtatatggaagttacatcaaaggagacattaaccaaattaacaaagctacagcaaaaaaagaattctactcaaatataatgaaattttttgaaagcgaagagatcatatgcgatgaacaaggggaagtgatctggaacaaaaaacgcgatctatctaccataaaaaaaaccataggcgcccaccaagtcaacatagtaaagaaagttgaaaaacaaaaaggaggattctacaaagaaacaataaattcaaaagctaatccagaaaaactaatacctaggaaagcatcactagacccattaaaatacggaggatacggatcaccactcgtcgcctacacagttatttttatttttgaaaaaggaaaacaaaaaaaagtaactaaaggtatagaaggtataactgtaatggagcaattaaggttcgaacaagaccccagagaattccttaagacgaaaggctatgaaggcgttaaacaatggctgatacttccaaaatacattctattcgaagcccagggaggatacagaaggatgatagcttctcaccaggaaacacaaaaagcaaactcgctcatactacctgaaaacctagtaacccttttatatcatgctagacattacgacgaaataaaccacaaagtctcattcgattatgtgaatgcccacaaagaaggatttaatgacatatttgacttcatctcggacttcggggtacgatacatattagcacctcaacatttagaaaaaatcaaagtagcttatgaaaaaaacaaagaagtagatttaaaagaaatgatcgacgctatactaagcttattaaaatttacattatttggagcatcagtagaattcaaattttttgatataaaaatactaaaacggtacaaatcattaacagatatctgggaggctacaataatttatcaatcagtcactggactatacgaacgaagagttgaagttcgcaaactatgggacggagagagactatga

SEQ ID NO: 5263 - RNA, 3996 nt, synthetic construct
  misc_feature 1..3996: note = Cas9 variant
  source 1..3996: mol_type = other RNA
atgaataaacaaccctacaacataggactagatatcggtaccagtagcgtcggttggagcgcgaccgaactagataaccgtttgttacacataaaaggacacaatgggattggcgtacgattatttaaagaaggcgagtcagctgctgacagacgcggattcagaaccacccgtagacgacttgcacgacgaaaatggagactacgattattgaatgaaatattcgccacagaaatagccaaagtggacccatcgttctttgcgagattaaaacaatcaaatgtaagtcctaaagatccaaacaaaactatgttcgaaaacatactattcgatgacgaaaatctagatgaccaaaaatttcaccacgactacaagacaatatatcatttacgacaagcaattataaaccatccagaacagaaattcgatatacgcttaatttatcttgcaatgcaccacataatcaagtataggggacatttcttaaatcaagctaatgtgcaagacttcaagggagggaaaatagacctagaaaaaagtttcaaagcactcaacgatatatttgagaaccaaggtagggacttaaggctagttacggataaagcgaatcaatatgttaaagtgctatcagacaacgcgaaaacacgtagtgacagaaaaaaagaactatccaaactcttatacgtcccaatagataaagacactgacaaaaattcgaaaaaagttaccggcgaaatactgaaggcaatactcggaaacaaagctaaattcgatgtgatattcggaatagaagtagaaaatcccaaagaatgggtactgacatttaacagtgacgattttgacgacaaaatagaaggacttagctcccaaatgacagacgaagattcagaaatccttctaatactaaaggaactatacttcgcgctaaatttatctgatatactaaataacagtgtaacagacaaaaacgcaaaaacattatctgaagctatgataaacagatacgatgatcacaaaaaccaactcgcaatgctaaaaaaagtaatagattcctccgataaaaaacacgccaaggaactcaaagaagcatactccgcatacatagacggagaaaacaacaaaaaaatatcattcgaggacttaaaaaaacgaatccaaaaaaatctagtagacagcgaattatcccaaaaaattaatgacctattagaccatgactatttcttaccaaaacaaagatcaaaagaaaatggagcaataccccaccagctgcaacaacaagaacttgaccaaataatagaaagccaaaaacaatactaccccttcctcgctgaactaaacccgaatgaaaagcgctcaagacaagcaaaatataagctagatgagttagttgcattcagagtcccatactacgtgggaccgatggtagaagtaactgattcaaaccaagagaacaatggaaaattcgcgtggatgataagaaaagaacaaggcgaaatcacaccatggaactttgatgaaaaagtagatagaactgaaactgcaacgaaatttattaccagaatgacaaccactgatacttacctaataggcgaacccgttctacccaaaaattcattgctatatcaaaaattcgtagtccttaacgaactcaataacctaaaaataaaccaggaaataataactccaggacaaaaacaatacctatacgaacacgtcatgaaaaaaaacaaaagagttacattaaaaaaaatcgccgatgcattggtaataaaaggtgactatccatacgcaccagaagtaaagggaacaacagatcaaaaaaatttgaacaacggattaaccacatatatagacctagcaaaaatatttggaaacgaattagacgacgtcgaccgggaagcagatttcgagaaaattatagaatggtctaccatcttcgaagaccaacatatatttgcacttaaattacaagaactaaaatggctcacagaaaaacaaagaaatcaagtcgtaaaactccgttaccaagggtggggtaaattaagtaaggaattattagctggattagttgacgataacggccaaaggataatcgacctactatggtcggataaccagaacttcatgcaaatagtaaatcaaaaaagctttaaggaaagtatagcagatcataatggtgcacacctggaagaaaaaaacctaaaagacgtaattaatgatttatatacgtctcctcaaaacaagaaagcaatccgtcaagtcattctggtcgtagatgatataataaacgcagttggctacgaacccgccaacattatgatggaattcgcccgtgaagattcaaacgaccaccgtctaacaaacagccgatctcgacaactcgaaaacgtatacaaagacatcactaactcatggtttgataacgactcagtaaaagatgaactagaggataaaataaaaaacaaagacaaattcactgatcgactgtacctctacttcacccaaggcggtaaagatctttacactggagaaccacttaacattgatgacctctcatcctatgacatagaccacatacttccccaatcatttatattagataactcgcttgacaacagagttttaacatcgcaaagaaacaaccgcgtatctaaagaagaccaattaccaggtgaactattcggaacaaaaatgcatgcattctggaaaagactaaaagctgcacatctaatatcaaacaaaaaatattataacttgaccctaacacctaatagcataagcaaattcaataatcaagggcgattcatcaatcgacaactcgtcgaaacaagacaggtcataaagttagcagccgaaatactccataacagatatagtgaagaaaaaggaacaaacatagtaactataaaagccaacttaacccaccatatgagagaaaaattcaatttttacaaaaacagaaacgtcaatgactatcaccacgctttcgacgcctaccttacagcattcgtgggaaactggctactacagcaataccctaaattaaaaccatacttcgtatatggcgattttgcgaaaacagaaattaacaatttaaaatcctttaacatgctctacaaatttgaacaagcccatcaattaaacgaaaaagacggaaaaatagcaaaggacgcagatgcactcctaggatatatgaaaaacgtatatcattttaaaaaaatgttagtaacaaaaaaactagaaacaaaccacggcgccctattcaaacaaacactatacccaagcccagcacacgatataaaaaaacggcaattaataaaacctaaagacaaccgccctacagatatttatggaggatatacacatgaagaacggaaatatatgtcattagttaaagtaataggaaaaaaagataacgaataccgaatggccaatgtcccactcctaaaaattaacaaaaataacgatataaaagaaattctaaaatcccagttttccaacaagaaatttgaaatagtgttacccaaagtattaaaaaaccaactgttcagcgaaaacggagccttatttgtaataggatctaaaggatataaatacaacgccaaccaattagtgctatccgacttagacatgaagctactaaacgacctgagcaacaacaaatctatcgatgaggtaactatcaatcaactatttaaaaacattgtggacagcacaaataaatacatgccgttatatgagataaaaaacttaaatgaggtcgtagaaaaatttaataatctcgaatttaacgacaaaaaaaaaacaataacagatttcctattagccacacacgccaacccaacaatgtcaaacctaaaaaatatcggcctccccagctacttcggacgcttcacaagcggtaacgcaggcattaaattaagcgaaaacgcaaacgtaatttatcaaagtccaaccggcctattttcaagaaaagttaaaataagcgacttttga

SEQ ID NO: 5264 - RNA, 3999 nt, synthetic construct
  misc_feature 1..3999: note = Cas9 variant
  source 1..3999: mol_type = other RNA
atgaaaaacagagaaaatataaaatattatatcggagttgatataggaactaatagtgtaggctgggcagttattgacgaaaatggaaatctactaaaaaaaggaaaacatcacttatggggttctcgccttttcgaccaagcccaaaccgcacaaaacagaagaaattatagaagttctagaagaagatataataaacgccgacaacgaattggactactgcgtctaattatgtctgacatggtactggaagtagatccaagctttttcatcagactagaaaaaaccacatttctcgataaagaagacaaaaaagccatcctaaaagacaattacaaaatgaactataatcttttctgtgacgaagactataacgataagaaatactttaaagattaccccactatttatcatctacgaaaaaaactatgcgaatccgacgaaaaggctgacccccgattaatatacctagcccttcaccatattgtaaagtacagaggcaactttctgtacgaaggacaagaattacatctggaaccttcaaacaaggaagaagacctcaaaatattatttgatatactaggtaagaataacgacacagtttacgacatctcagaggaacagattcagtttatacttaaaaccgtcgtagaaaacatatcaaaaaccgctaaagtagacgagtgcatgtcacaactaaagctaaactcagaagacaaaaaaatagttaaagaattcatgcgagggttggtaggcaacaaattcaacgtatcaaaattatacatgcatgaggaccttcaatttgatgacgaagatcttaaactacagttctccgacaaatcctatgaagaaaaaataacagaatacgaaaatgtcctagaagaaaaaatggagttcatcgatctaatgcaaaggttttactcatggatcgaactatccaagatcgtaggatcagactcccaacacgcatcaatcagtggcgccatggttaacatctatgaaagccaccgtgaagacttgagaacactaaaagaagtgatgttaaaaataggaaaaaaagaatatgatgagatgtttaaaccaacttcgaagaatgtcgtaaactattacaactatgtcaacccggtagcatgcagtggagacaaaacggatggattttacaaatacgtaaaaaaagcaatagaaaaatccgatgattcacgaaaagacgaaatactccaaaaaatagccaacgaaacgtacatgttaaaacaaacaagcaaaaataatgcgtacattccatatcaaatgcaaaaagacgaactcatcaaaatactagaccatcaagaaaaatattacccagtattgaaagaaaacagagacaaaataatctcaatcctagaattccgaatcccctactactacggaccgctcgacggtaataaacaattcggatggcttattaaaaaaaaagggaaagaaaacgaaagaatccttccctggaatcatcaagaaatagtggacgtacaagaaactgcggcacaattcataaaaaaattaacaaactactgcacatatctcccaatagaaaaagttatgccacaaaaatcattaacttgttctatgtacgaagtactatcagaagtaaataaaatcagaatagacggaaaactactacccatagacacgaaaaatcgtttaatagaagacttattcttcaaaagaaaaacagtcaaagagaaagacttaataaattggctaaaacaaaatcaactaaccgtaggagagatcacaggataccaaaaagaaaaagcattttcgagttcattagctccttggatagactttaaagaaatatttgatgaaataaatgactctaactacgatctaatagagaaaataatcgaagacatgaccatatttaatgaaggatccatcctcaaggaacgactcaagaaagcatacaacctagaccaaaataaagtcaagaaaataatgaaattgaaatactcaggatggtcgcgattaagcaaaaagctcataaacggaattcgcgcagataataaatttggatccagcgtaagcatattagacgtcatgaaagaaagccacatggcactaatggaaatcataaacgatcaagacttgggcttcaaacaaataatagaaaaagaaaattttaaaaacgaaaccggttcatttgaatacgaagacatcgaaaatttagcaggttctcctgcgcttaaaagaggaatatggcaaacccttcaagtaatagaagaaataaaaaactatatgggccacgaaccaaaaaatatttatattgaattcgcaagagaagaacaagaaaaagttagaacaaccacaagagtaaaaaaattaaaatcaatatataacgacataaaaaaccaattagacgtacacggaaaagaagtgtatagcaatctaaataagcaagatgaaaaaagtagcatagaaaagagactatatctatattacacacaactcggcaaatgcatgtactcaggagaatcactagatatagacaaattatcaaactatgaaatagatcatatcttcccaaggaccctcacgagcgacgacagtctagataatctagtattggtaaaaaaaaaagaaaaccaaagaaaactcgatgacctcgtcctgccactcgagatacggaataaaatggaggtattttggaaaaaactatacgacaacggactaataactcaaacaaaatactaccggttaatgagagacgaatttcgtagagatcaaatagacaaattcatcaatagacaattagtcgaaacgcgacaaataataaaacatgtagcaaatataattgaaaaccactacgaggacactaaagtttttacggtaagagctaatctctcccatgaatttcgagaaaaatatggcatttacaaaaacagaaacgtaaacgatttccatcacgcacacgacgcatacatcgcctgcataataggcagatatatacaaataagattcccgggactagaagctaaatacgtgtacggacagtacatgcaaaatgtgaaaaaaacaaaaaacaacatagacaaggaaaaccacggatttataataaactcaatgaaatatgaatgcattgacgaagacacaggtgaagttatctggaacccagaacgaatactcgattatataaaatgttttaactacagagacgtctacatcacaaaaaagctagatacgaacaatagagaattatttaatgttacaattttaccaaatgataaaaactctgaaaaaggtaaaacaaaagcgacaatccccgtaaacaaattaagaagcaacgtcagaaaatatggaggcttttcaggactccagtccgacatagtagcaatagaaggaaaaaaaggcaaaaagatcgataggcgtctaataaacctaccgattctgctacgatacgtgtcaattgaagaccaatgcaaatatataatggagaataataaatacagtgacgtaaaaataataaaaaagataaaaaagaaccaactaatagaaatagatggtatttgttactatctaaaatcggcagacgaactcgatacagcataccaattgattctcagtagagacgacaacgagatgatataccgaatagacagagctatccaaaacaatgatttctcctatttcgacaacaaaaaagaaaatatagacgagctgtacagactaatatgtcataaaatgatcgaaaactatccaaaatacaagaaaaaagtttacgagtttataaaagagcgcgaagaggagttcttcgaattagataatagtcaaaaatgtatcgtcatattcgaaatgataagagtcatgaaacgaggcgagcaatacataaacatacctttcgaaccttacaaccttaagaatgacagaaaaggaagactaaattgtcaaagcattctgttagataatacttacttctatgacgtttcaatcaccggcatatattctaagaagtataaattatga

SEQ ID NO: 5265 - RNA, 3999 nt, synthetic construct
  misc_feature 1..3999: note = Cas9 variant
  source 1..3999: mol_type = other RNA
atgcagaaaaattatacaataggactcgacataggaacaaactcagtaggatgggccgttatgaaggacgattatacactaataagaaaacgaatgaaagttctaggaaatactgacataaagaaaataaagaaaaatttttggggcgtacgcttattcgacgaaggcgaaacagcgaaagaaaccagactaaaaagaggaacacgaagaagataccaaagaagacgtaaccgtctcatatacttacaagacattttccaacaaccaatgctagcaatagatgaaaacttcttccatcgtctagacgactcattctttgtgcctgatgacaaaagttacgacagacatccaatttttggctcattagaagaagaagtcgcctatcataacacctatccaaccatatatcacctacgcaaacatttagccgacaatccagaaaaagccgacctaaggctagtctacacagctcttgcacacatagtcaagtaccgaggccactttctaatcgaaggggaactcaatacagaaaatacaagcatctcagaaacgttcgagcaattcttagatacttactcagacatatttaaagaacaattagtgggcgacatatcaaaagtcgaagaaatactcagtagcaaacaatccaggagccgtaaacacgagcaaataatggccttattcccaaatgaaaataaattaggcaacttcgggagatttatgatgttaattgttggcaataccagtaacttcaaaccagttttcgatttggatgacgagtataaactaaaactatccgacgaaacttacgaagaagacctagatacactactgggtatgacagacgacgtatttctagacgtatttatggcagccaaaaatgtgtacgatgcagtagaaatgtcagctataattagtactgacacaggaaacagtaaagcggttctatctaaccaaatgatcaatttttacgacgaacataaagttgatctagctcaattaaaacaattcttcaaaacacacttacctgataaatactacgaatgcttttcagatccaagtaaaaacggttacgcaggatatattgatggaaaaacaaatcaagaggacttctacaaatacatcgaaaaagtaatgaagacgataaaatcagataagaaagactactttttagataaaatagacagagaggtttttctgaggaaacaacgaagtttttataacagcgtaataccacaccaaattcatctacaagaaatgcaagcaatactagacagacaatcccaatattatcccttcttagcggaaaatcgtgacaaaatagaatctctggtaacattcagaataccatattatgtcgggccactaacagttagcgaccaatcagaatttgcatggatggaaagacaatccgatgaaccaataaggccatggaacttcgacgaaatagttaataaagaaagaagcgcagagaaattcatagaaagaatgaccaacatggacacctacttattggaagaaaaagtattacccaaaaggtcactcctctaccaaacctttgaagtatacaatgaacttaccaaggtacgttacacaaatgaacaaggaaaaactgaaaaactaaacaggcaacaaaaagccgagattattgagaccctattcaaacagaaaaaccgagtaagggaaaaggacatagcaaattacctagaacaatacggctacgtggatggcactgatatcaaaggagtagaagataaattcaacgcaagtttaagtacttacaatgacctggcaaaaatcgatggggcaaaagcatacctagatgaccctgaatatgcagacgtatgggaagatataataaaaatattaacaattttcgaagataaagccatgagaaagaaacaactacaaacatactcagacaccctctcgcccgaaatactaaagaaactagagcgaaaacattatacgggatggggaagattttccaaaaagctgatcaacggattaagagacgaaggcagcaataaaacgatactcgattacttaaaatctgatgaaggatcatcaggacccacaaacagaaactttatgcaattaatacgggataacactctcagcttcaaaaagaaaatagaagacgcacaaacaatagaagacactacgcatatctatgacaccgttgcagaactaccaggaagtcctgcgataaagaaaggcattcgacaagctctaaaaatagttgaagaaataatagacataatcggatacgaaccagagaacatagtagtagaaatggctcgagaatcacaaacaaccaagaaaggaaaagacctatcaaaagaacgtttagaaaaactaaccgaagcgataaaagagttcgatggacctagtgatgtcaaagtgaaagatttaaagaacgaaaacctaagaaacgaccgcctatatttatattaccttcaaaacggacgagatatgtacacaaatgaaccgctagacataaataatttatcaaaatacgatatagaccacataattcctcaatcattcacaacagataactctatagacaacaaagtcctcgttagcaggactaaaaatcaagggaacaaatctgatgatgtaccttcaatcaacattgtgcataaaatgaaaccattctggcgacaattacacaaagctggtctgatatcagatcgcaaattcaaaaatctaacaaaagcagaacacggcggcttgacagaagccgacagagcgcacttccttaacagacaattagtagaaacaagacaaattacaaaacatgtagccaatctgttagacagtcaatacaatacagcagaagaacaaagaatcaatatcgtgcttttaaaatcctctatgacttcaagattcagaaaagagttcaaactatacaaagttcgagaaataaacgattatcaccacggccatgacgcctaccttaatgcagtagtagcaacaacaatcatgaaagtataccccaatcttaaaccccaatttgtatacgggcaatacaagaaaacatccatgtttaaagaagaaaaagctacagcccggaaacacttctactcaaacataacaaaattcttcaagaaagaaaaagtagtaaacgaagaaacaggtgaaatcctatgggatacagaacgccatttatcaactataaaaagggttttgtcctggaaacaaatgaacatagtgaagaaagtagaaaaacaaaaagggcaactctggaaagaaacaatctaccctaaaggtgactcctccaaattgataccagttaaagaaggaatggacccacaaaaatacggaggattaagtcaagtatctgaagcctttgccgtagtaatcactcacgaaaaaggaaagaagaaacaattaaaaagtgacttaatttctatcccaattgtagaccaaaaagcatatgaacaacaccccacagcatatttagaagaagctggatataacaacccaactgtactacatgaattattcaaatatcagttatttgaattagaagatggatcacgacgaatgatagcctcagccaaagaatttcaaaaaggcaaccaaatggtcttacccttggaattagtcgaactgctttaccacgctaacagatacgataaagttaaattccctgacagcatagaatacgttcatgataatctagccaaatttgacgatcttctggaatatgtaatagacttttcaaacaaatacattaatgctgataaaaatgtacagaaaatccagaaaatatacaaagaacacggaacagaagatgtcgaattaacagtagaatcattcgtaaacctaatgacatttaccgctatgggcgcaccagctactttcaaattttacggagaatcaataacaagatctagatacacttcaatcacggagttccgaggaagtacactgatctttcaatcaataacaggtctatacgaaacccgatataaactagaagataactga

SEQ ID NO: 5266 - RNA, 3999 nt, synthetic construct
  misc_feature 1..3999: note = Cas9 variant
  source 1..3999: mol_type = other RNA
atgatgaaagagtatagtatcggattagacataggctctagtagcgttggattcgtggcagtagatgatcaataccgagtagtgagagcaaaagggaaaaacgtcatcggcaccagactatttgacgagggcaaaacagcagcagatcgaagaggattgcgaacaacgcgtcgcagattatccagaaggaaatggagattgagactcctacgggggatcttcgaaccgcatataaacgaaatagatgaatccttctttatgcggttaaaagaatccaatatctcgccgaaagattcaaacaaacactttccaggagacatattatttaatgatagatcagatcgagagttttacgagaattacccaacaatttaccatctacgacaggcactaaaaactgagaaaagacaatttgatatacgcgaaatataccttgcaatgcaccacatagtgaaatatagggggcactttttggagggcggaacggtgacagactttgaagtcggcgaacttgacttagcgggaaagtttagcagactcaatgaactatttgaaagtataaatctagaagttcccttcgttttaagactagacaatctagaagacgtaaaagcagttcttatagactcacaacgtagtgcccaagatcgacaacgaacgctaacaccagatatttacgtaccatccacagacaaaatcacagagaaaagatttaaaggaatagcaacggaattattaaaagcaatcgtcggaaataaagctaaatttgacgttttagcaggattagaacttgacaaagaagaagcaaaattatgggcacttacattcgattcggaaacctttgacgaagacatcgaacaactagaaggagatatgactgaagcaacgcaagacctaatagaaattctaaaatcattaagatcattaataagattagcagtaaacatgccagaaggagtatcattaagcgaaatgatgatacaaagatatgaagatcatgcagatcacttaaaattgctcagagacattatacacaatactgatgctgaaaaagcagccggattgcaagcagcttacgatggatacattgatggagtaaaaggtaagaaaacaccagtagacgatttttataaagctataaagaaaaatctggatgatagcgaggcagcacaccaaatcctggcgttaatagataaaaacgagttcatgcccaaacaaaggtcgaaaagcaatggctggataccccatcaaatacaacaaaaagaattagatagaatcatagaaaaccaaaaacaatactatccatggctggcagatgtaaaccccaatgaatcaagaagaaaagttgcaccttataaaatagacgaattggtaacattcagggtaccatactatgtaggccccttagtgaccagtgaagaacaaaagaaatatggctcaaaattcgcatggatggtacgaaaagaagaaaaaggtgaaataactccttggaacttcgatcagaaagtcgaccgtgccgcaagcgctactgagttcattaacagaatgacaactatggatacatacctcttaaatgaagatgtattacccgcgcattcattaatttatcaaaaatatgaagtcctaaatgaacttaacaaagtgaaaataaatggagatgccataacacccgaattgaaacagaaaatataccatgatttatttgaaaaacaaacaacagtaagcatcaaaaacttacaaacatatttagtatcagaatccgaagcaagcgaagtaccagaaataaaaggactagcagacgaaaagaaatttcttagcggtctgacaacgtatcacgacctaatgaaaatattcgaccgtaacgtagtaaacgatcccgaacgtgcagaagatttcgagaaaatcataagatggtctacagtcttcgaagacaaacacatttatagagaaaaattagattcattgagctggttgacaactgaccaaaaagataggctcgcagtaaaacggtatagagggtggggaagactcagcgaaaaattactaataggattaagagatgaaggacaccgatcaataatggactatttatgggaaaccactagcaatttcatgcagatccaggcacaaaacgatttctcggagaaaattgcagcagaaaataaagaatttttagataatacacaaagtgtgcaaggtataataaatgaattatacacatcgccacaaaacaagaaagccataagacaaacattattagtagtggaagacattaaaaaggcattccacggagaagcaccaaaaagaatttttgtagaatttgctcgagaaaacgaaagtacaccacaaagatcaatacaaagacaaagacaagtagaaaatgcatacgaaaaagttacccaaaatttactggtagatgacaaaatcagagctgaattaaaggacagcataaatgagaaaaggttatttcatgatcgactcttcctatactttatgcaaggaggcatagacatgtatagcggtaagaaaattaatatagacaacctaagtgcgtatgacatcgaccatatactaccacaatcgttcacagttgacaatagtcttgacaatagagtccttacaaatcagaaagacaaccgagaaaaaggtaattctcttccaagcgaattatatagaggtagcatgaaagaaacctgggaaatgatgaggaatcaaggactactatcaaaaggtaagttccaccgattaatgatgacaccaaacagtatgacagcctatgaccaacaaggcttcatcaaccgacagctagtagaaacaagacaagtgattaaactcgctgtcgaaattcttgcatccgaatttgatcaagcagacgagaaagtagaaatagtcagtgtcaaagcgggtctcacacatcaaatgcgacaagactttagcctaattaaaaatagagacgtaaatgactatcaccacgcatttgacgcatatctaacagcattcgtagggacatacttattgaagagatatccaaaactacgaccatattttgtctatggtgaatttaaaaagtttagtcaaaagcaagcaaatttaaccaactttaactttttatgggcgttaaaacataaggaccaagtagctgtagaagatacaggcgagaaaatatggaataaaccccaggatttagcgtacataagacatctttttgcatttaagaaaatactaatttcaagagaagtatcagaaaggcacggagcactatttgatcaaacactatacaaagcgtcagatgataaagcatctggacaaggctcgaagaaactaatacctgcaaaagataacagaccaaccgaattgtatggtggatattctggacaaacatccgcattcatggcaatagtaaaggtaaccaaaggtaaaaagacaaaatacctagtagttggagtaccaacagcagctattagtcaactacagggaatggatgtaaaaagctcacagtacaccgaaaagatatataatatactaagtccaaagttattatctaaaaacgatgatttcgaagtgatagttccaaaagttagatacagacaactaatattagataacaaccaattattcactttaggatcagacacatataaatacaacgcgcgccaacttgtcctttctaacgaagtattagcagtgataaatcgtgataaatcctttatagataagaaactatcagaagaagcagaaaaccaagcactaaacgacgcctttgatgaaatagtcgtagcaatggacaaacactttgacctatacgataaaaacggctttagagaaaaagtaaaagcgggtaaacaaaggttcgaagaactccccgtgtccttattctcagaagacaaagaaaatgaaggaattacaaaacgcacagtcttaaaaaggattctacaaggattacacgcaaacgcaaccacatctgatttaaaagtactagacggaaaattctataattga

SEQ ID NO: 5267 - RNA, 4002 nt, synthetic construct
  misc_feature 1..4002: note = Cas9 variant
  source 1..4002: mol_type = other RNA
atgaaaaattatacaatcggtctagatataggtgtagcgtcagttggttgggtatgcatagacgaaaactacaaaattttgaattacaacaatcgccacgctttcggagtacatgaatttgaatcagcagaatcagcagcaggaagacgactaaaaagaggtatgagacgaagatacaatagaagaaagaaacgtttacaattattgcaatcgttattcgactcgtacataacagactcagggttctttagtaaaacagatagccaacatttctggaaaaataataatgagttcgagaatcgatcacttacggaggttcttagctcgctccgtatctcttcaagaaaataccccacaatatatcacttaagatcagatttaattgaatcaaacaagaaaatggatcttagattagtctacttggctctacataacttagtgaaatatagagggcatttcctgcaagaaggaaactggtcagaagcagcgagtgccgaaggaatggacgatcaactactagaattagtaaccagatatgcagaactagagaatctctcaccacttgacctctcagaatcgcagtggaaagccgcagagactctgctcttaaatcgaaacttaacaaaaacagatcaatcaaaagaactgacagcgatgttcggcaaagaatacgagccattttgcaagctagtagccgggctcggggtcagcttacatcaattgtttccgtcaagcgaacaagcgctagcctacaaagaaacaaaaactaaagtacaactcagcaatgaaaatgtcgaagaagtaatggaactattactggaagaagaatccgcattacttgaagctgttcaaccattctatcaacaagtggtattatacgaattattaaaaggcgaaacctacgttgcaaaagccaaagtcagcgcgttcaaacaataccaaaaagacatggccagtctaaagaacctactagataaaactttcggagaaaaagtctaccgtagctatttcatctcagataaaaactctcaacgagaataccaaaaatcacacaaagttgaagtattatgtaaactagatcaatttaataaagaagctaaatttgcagaaaccttttataaagacctaaagaaactactagaagataaaagcaaaacaagtatcggaacaactgaaaaagacgaaatgctgagaattataaaagcaatagacagtaaccaattcttgcaaaaacaaaaaggcatacaaaacgcagcaataccgcatcaaaactcactatacgaagcagagaaaatcttgagaaaccaacaagcacactacccgttcataacaaccgaatggattgaaaaagtgaaacaaatactagcttttcgtattccctattacatcggccctctagtgaaagatactacacaatcaccattctcctgggtagaaagaaaaggtgacgccccaataactccatggaacttcgatgaacaaatcgacaaggctgcatcagcagaggcatttatatcaagaatgagaaaaacctgtacatatcttaaaggacaagaagtgttaccaaaatcatcactgacatatgaaaggtttgaagtcttaaacgaattaaacggcattcaactaagaactactggagctgaatcagattttcgccacagactaagctatgaaatgaaatgttggataatagataatgtcttcaaacaatacaaaactgtaagtacaaaaagattactgcaagagctgaaaaagagcccatacgcagatgaattatacgacgaacatacaggagaaattaaagaagttttcgggactcaaaaagaaaacgcatttgcaactagcttgtcaggatacatatcaatgaaatcaattctaggtgcagtagtagacgataaccctgcaatgacagaagaacttatttactggatcgcagtatttgaagacagagagatattacacttaaaaatacaagaaaaatatccatcaattaccgatgtacaaagacagaaactagcgttagtaaaactcccaggatggggtaggttctctagattactcatagatgggctacccctggacgaacaagggcaaagtgtactagaccatatggaacaatacagctcagtattcatggaagtactgaaaaataaaggattcggattagagaaaaagatacagaaaatgaaccaacatcaagtggacggaacaaagaaaattcgttatgaagacatagaagaacttgcagggagccccgcactaaaaagaggcatatggcgatcagtaaaaatcgttgaagaattagtctcaattttcggagaaccagcgaacatagtattagaagtagcgagagaagatggagaaaagaaacgaaccaaaagccgtaaagaccaatgggaagaacttaccaaaacaacactcaaaaatgatccagacttaaaatccttcattggagaaatcaagtcacaaggtgaccaaaggttcaatgaacaaagattttggttatacgtcactcaacaaggaaaatgcctatacacaggtaaagcgctagacatccagaatttatccatgtatgaagtcgaccatatcttacctcaaaactttgtaaaagatgactcactggataatctagcccttgtaatgccagaagcaaaccaacgtaaaaatcaagtcggacaaaacaaaatgcccttagagataattgaggctaaccaacaatacgcaatgcgaacactttgggaaagattacatgaattaaaattaatatcttcaggaaaactaggtagactaaagaaaccctccttcgacgaagtcgataaagacaaatttatagcacgacagttagtagaaacgcgacaaatcattaaacatgtgagagacctgctagatgaaaggttctctaaatccgacatacatctggtaaaagcaggtatcgtcagtaaattcagaagatttagcgaaatacccaaaattagagattataacaataaacatcatgcgatggatgcactatttgcagccgcattaatacaatccatattaggaaaatatggcaaaaatttcctagcatttgatctctcaaagaaagaccgccaaaaacaatggagaagcgtaaaaggatcgaataaagagttctttttgttcaaaaattttggaaacctacgactccaaagccccgtgacaggagaagaagtgtcaggagtagaatatatgaaacacgtatatttcgaattaccatggcagaccacaaaaatgacacaaaccggagacggaatgttttacaaagaatcgatatttagtcctaaggtaaaacaagcgaaatatgtatctcctaaaacagaaaaattcgtacacgacgaagttaaaaatcatagcatatgtttagtagaatttacatttatgaagaaagaaaaagaagttcaagaaacaaaatttattgacctaaaggtaattgagcatcaccaatttttaaaagaacccgaatcccaactcgcaaaatttcttgctgaaaaagaaactaacagcccaataatacacgcacgcattataagaacaataccaaaataccagaaaatatggatcgaacatttcccttactattttatatcaacaagagagttacataatgcccgacaatttgaaataagctacgaactcatggaaaaggtaaaacaattatctgagagatcttcagtagaagagttaaaaatagtgttcggactcctaattgaccaaatgaatgataattaccctatctataccaaatcaagtattcaggatcgggtacaaaaatttgtagacacacaactgtacgattttaagagctttgaaataggattcgaggaattaaagaaagcagtagcagcaaacgcccaacgatctgacacctttggatcaagaattagcaagaaaccaaaacctgaagaagttgcgatagggtacgaatcaattacaggattaaaatacagaaaaccaagaagtgttgtaggtaccaaacgatga

SEQ ID NO: 5268 - RNA, 4002 nt, synthetic construct
  misc_feature 1..4002: note = Cas9 variant
  source 1..4002: mol_type = other RNA
atgtcacaaaatatagttgattattgtataggcttagacttaggaactggaagtgttggatgggccgtggtcgacatgaaccaccgtcttatgaaaagaaacggtaaacatctatggggatccagattgtttagcaatgcggaaacagcagcaaacagaagagcatcacgaagtattagaagacgatataataaaagacgtgaacgaatcagactcctccgagcaattttgcaagacatggtcttagaaaatgaccccacattctttataagactcgaacacacatcgttcctagacgaagaagacaaagctaactacctcggcgccgattataaagataactacaatttattcatcgacgaggatttcaatgactatacatattaccacaaatacccaacaatctatcacctccgaaaagcactctgcgaaagcacagaaaaagcagacccacgcttaatatatttagccctacaccatatagtgaaatatagaggcaacttcctatatgaaggtcaaaaatttaatatggacgcaagtaacattgaggacaggctgtccgacgttttcacacaatttgccgacttcaataacataccatacgaggacgacgaaaaaaaaaacctagaaatactagaaatattaaaaaaaccattgtcaaaaaaagctaaagttgacgaagtcatggcattaattgcccctgaaaaagacttcaaatcggcatacaaagaattagtaacaggcatagctggaaataaaatgaatgtaacaaagatgatcttatgcgaaccaatcaaacaaggagattccgaaatcaaactaaaattctccgactcgaactatgacgaccaattctcagaagtcgagaacgatttaggagaatacgtagaattcattgactcattacacaacatatattcctgggtcgagctacaaacaattatgggagcgacacatacctataacgccagcatcagcgaagcgatggtctctagatataataaacaccatgaagatctacaactacttaaaaaatgtataaaagataatgtaccaaaaaaatactttgacatgttccgaaacgactcagaaaaactaaaaggctattacaactacataaaccaccctagcaaagcccccgttgatgaattctataaatatgttaaaaaatgcatcgaaaaagtagatactccagaagctaaacaaattttacacgacatcgaactagaaaatttcttattaaaacagaattcacgaacaaatggaagcgtcccgtaccaaatgcaattagacgaaatgattaaaataatagataatcaagccaaatactacccagttctcaaggaaaaacgagagcaattactctcaatattaacattcaaaatcccatactattttggacccttaaacgaaacatctgaacacgcatggataaaaagattagaggggaaagaaaaccaacgaatactaccctggaattatcaagacatagtagatgtggatgcgacagcagaaggattcataaaaagaatgagatcttattgcacctatttcccggatgaggaagtgctgcccaagaatagtctaatagtatctaaatacgaggtttacaatgaattaaataagatcagagtcgacgataagctactagaagtagacataaaaaatgatatatacaacgaacttttcatgaataacaaaacagtcacagagaaaaaactaaaaaactggttagtaaataatcaatgttgtaacaaaaacgccgaaataaaaggattccaaaaagaaaaccaattctcaacaagtcttacaccttggatcgatttcactaatatatttggtgaaataaaccaaagtaacttcgatctaatagaagatataatatatgatctcactgtattcgaagataaaaaaataatgaaacgcagattaaaaaaaaaatacgccctacccgacgacaaaatcaaacaaatattaaaactaaaatacaaagactggagcagactatctaaaaaattactagacggaatagtagcagacaacaaattcggctcatcagttacagtactcgacgtattagaaatgtcccgcctgaatctcatggaaattataaatgatagggacttaggctatgctcagatgattgaagcagctgcaagctgtccagaagacggaaaatttacctacaaagaggtccaacgacttgcgggaagtccagcactcaaaagaggcatttggcaatctctgcaaatagttgaagaaataacgaaagtgatgaagtgtcgtccaaaatacatttacatcgaattcgaacgatcagaagaaacaaaagaaagaacagaatcaaagataaaaaaattagaaaacgtatataaagatttggacgaacagacaaaagttgaatataaaacagtactagaagaactaaaaggcttcgataatacgaaaaaaattagtagtgacagccttttcctatattttacacaactaggtaagtgcatgtactcaggaaaaaagctggatatagactctttagacaaataccaaatagaccacatagtgccacagtcactagtaaaagacgactcttttgataatagagtactagtagtaccatcagaaaatcaacgaaaactcgatgatctagtagtgccaagtgatattagagtgaaaatgaacagtttctggaaattactattcgaccatgagcttataagcccaaaaaaattctacagcttgattaaaacagaatacaccgaaagagatgaagagcgctttataaataggcagctagtggaaacaagacaaataactaagaacgttactcaaatcatagaagaccattattccactaccaaagtcgcagcaataagagctaacttaagtcatgaatttagagtaaaaaatcatatatacaaaaatcgagacataaacgattatcatcatgcacacgatgcgtacatcgtagcactgataggcggattcatgagagacagatacccgaacatgcatgattcgaaagcagtatattcggagtacatgaaaatgttcagaaaaaacaaaaacgacaaaaaacggtggaaagatggatttgtaataaatagcatgaactacccctatgaagtagatggcgagttaatatggaaccctgatataattaacgaaatcagaaaatgcttctactacaaagactgttactgcacaacaaagcttgaccaaaaatcgggccaaatgtttaacctaaccgtcctaccaaacgacgcacacagccctaaaggaaccacagaggccgtaatacccgtgaacaaaaacagaaaagacgtcaataaatacggtggtttcagcggactgcaatatgtaatagtagcaatagaaggaaaaaaaaaacgaggtaaaaaaaccaaacttgtaaaaaaaatatccggtgtaccacttcacttgaaggcggcatcactagacgaaaaaattaaatacatagaagaaaaagaaaacctaacagatgttaaaattataaaagatagcataccagttaaccaaatgattgaaatggacggaggcgaatacctcctaacatcacccatagaattcgttaatggccgtcaactagtactaaatgaaaaacaatgcgcattaatagccgacatatacaacgcaatctacaagcaagattgcgacaacttagacgacgtattaatgattcaattatacatagaactgattaataaaatgaaagctttgtatcctgcataccaatccatagcagaaaaattcgaaagtatgacagaagattacgtggcagtttcaaaggaagaaaaagcagatataatcaaacaaatgctaattataatgcacagaggtcccagaaacggaaaaatacaatacgcagacttcaacgtgggtgatagaattggaaggaaaaacaaaatgagcctggatttagaaagagtaactttcgtatcacagagccctacagggatctacacaaaaaagtataaactctga

SEQ ID NO: 5269 - RNA, 4002 nt, synthetic construct
  misc_feature 1..4002: note = Cas9 variant
  source 1..4002: mol_type = other RNA
atgggcaaagaatactatttagggctagatatcggaacagactccgttggatgggccgtatgtgatacaaattacaaaataccaaaattcaaaggtaacgcaatgtggggaataagactctttgaaaaaagtaatagcgccgaggaacgaagaggattcagaagcagtcgaagaagaacccaaagaaaaagagaaaggctcaaattattggagatgctattcgacgaagaaatttcaaaaatcgatccagcctttttcatcaaactgagagaaagcaacctttatttagaagataaatcaacgaaaatcccatactgtgtattttcagatgaaaactatacagacaaagactttcacagagactatcccacaatatatcacttgcgaaacgaacttataaaatcaaataaacctcacgacgtaagactagtatacttagcactacaccacatcataaagaatagaggtcacttcctattcgactactcctataaaaacgataaatcaggagatttcatgccaatttataatgacttaaaaaattatttctatgacaattatgaaattgaactagattgcagtgatgttgacgaatttgccaatacactaaaggataaaagcaagggaaaaacaaaaaaaaacgcagaaattgcagagttattcggagtctccaaaaaatatgacaaagtcctttacagcgcactatcacttctatcaggaagttcagtaaagctttttgatatctttgatgatgaggcacttaaagacgtagaaaaaaagtcagtaagtttctcaagtggatttgacgataatgctaacgactttcaaagttacttaggcgaaagattcgaacttctcgaaaaacttaaagcagtgtacgattgggcagttttagctgatatactggacggaaaagagtacatatctgaggccaaagtagctatatacgaaaaacataaaagggatctaaaaacactcaaaaaatacatcaaaatatacatgccagaaaaaaaagctgaaatattcaatattagttcaaaagataacaactatgtggcatactccaaacacataaaaacctcaaatggaacaggagtactcattagcacctgcacgcaagaagaattctgcgcatacctcaaaaaaacacttggaatatgcaaagacgcaagctatgaagaaatgttcaaagaaatcgaaaactcaacctttatgccaaaacaagtgacgaaggacaacggagtagtaccaatgcaagtcaacgaaaaagagctagtagcaatattagataatgcaaaagaatacctcccattcctcttgaataaagataacgacggcaaaacagtctacgataaaataaaagcattgttcgaatatcgcatcccttattacatcggccccttaaacactcacagtacaaaatcatggctagttagaagcaacgaaaaaatctatccgtggaatatagaggacgttgtagatttcgacaaaagcgcagagaaattcattgagaacttaaccagtaagtgtacatatttacctcaatacgacgtaataccaaaacattcgctactatataacaaattctgtgtgctaaacgaactcaacaacctcaaaatcgacggagaaaaaatatcagtccaactaaaacaagatatttataacgacttattcaaaaaatactataaagttactaacaaaaaactctgtgactacttaaaaagcagaaatatagccttcgacgaaatcagcggaatagataatgactttaaatcaagtttaaagtcctataaggaccttgtagcatacaaccttacagacgaacaaaaagaagaaatagtaaaagcaatcaccatattcggggacgataaaaaacttttgaaaaaacgactcaaaaacgaatttggaggctgtctatcagacgacgaaatcaaaaaaatttgcaagttaaaatatacaggatggtcaaagcttagcagagaatttctaactgatgtaacggcagtctacaaagagactggagaattaataaatataatctgcgccctttgggaaacaaattacaatctgacatcattactctactcagatgaattttgttgcgacgataaagaaaacaaaacgtttaatgacaaaataaacgaattaaactcatttggaaatgacaaaacgctaaaccaaatagttgaggaactatacgtatcaccactcgtaaaaagacctatataccaaagtctactcattactaaagaactagaaaaaattatgaaatgcccacctaaaaaaatattcgtggaggtggccagaggcgccgaagaaaaaaaaagaactgtcagcaggcgcaacaaattactagatctatataagagctgcaaaaacgactatcccctactatttgatgaactacaaaacaatacgaccgacgacgaactaaagtcagacaaactatatctatatttcacacaatttgggaaatgtatgtatacaggagaaaacatcgaactaggagatctcttcaacaaaaacctatacgacatagaccacatatacccgcaatcaaaaataaaggatgacagcttagataatcgcgtccttgtgaagaaaacgacaaacgcaaaaaaggataacgaatatccactaagtagccagataagagaaaaaatgactccacattggaaagcactcttagacaaaggccttattaacaagaaaaaatacgagcgacttgtacgaaattatcccttaagcgacgaagaactctcacaatttatatcgagacaactcgtcgaaacccgccaatcaaccaaagcagtagccaacatactagaacagttataccccaggccagatacagaaatcgtctacgtaaaagccgccctagcttccgaattccgacatcaatatgacatgttaaaatgcagagaagtgaacgacctgcatcatgcaaaagacgcatacctaaatatcgtagtaggtaacgcctacaacggaaaattcacccataataaagcaaacttcataaaaggcctccaaaacaatgacaaagcatacaccgttaaactcgacagcatgcttaaacataacatagatggagcctggattgcagacaataatgaatctctaaacattgtaaaatcaaccatgaacaaaaacaacataaggtacacaagatacgctttcgaaaaaaaaggtggactatttaaagtaacaatactcaaaaaaggtaacggccaagcatcaatcaaaaaaaacgataaaagaaattctattgaaaaatatggtggatacaaccaagtctcgagcacatacttctcatgcgtagaacacggtaaagataacaaccgtatgatatcaatgttttcggtaaacctatatgacaaaaacaagtacgaagagaaccctatagcgtatctaatagaaaattatggtctaataaaccccataatcaaagttaaaaaagtaaaaattcaatcctgcatctcatttgataatatgttatgtcacttaggaggaaaagattcgggtggaagtcaaatatcttacagaccaggagtacaactggtactaggatacgacaatgagagatacatcagaaatgtcattcgatgtgctggaggtgacctgcacttgcaaacaagtaaaaacgaaaaagacatagttacagcagaaaaaaacatcgagctattcaacttattaatagaaaaaatgaaaaacaatatatatggagtcctttacagcaacctaggagacaaactatactgttctaaagaaaaattcgaaaaactagatatagtagaacaatgcaatgtaataaaaaatgtactcacaatattaaaaaacaatgcatcaaagggtgatctaaaaagtattggtatcaaagctaacggtgctattagattgaataacaacatatccgaaataaaaaaagtcaaatcgataaaacttataaatcaaagcgtaacaggactatttgagcaagaaattgaacttttaaatctatga

SEQ ID NO: 5270 - RNA, 4002 nt, synthetic construct
  misc_feature 1..4002: note = Cas9 variant
  source 1..4002: mol_type = other RNA
atgtcccaaaatatagtagattactgcataggactcgacctaggaacaggtagcgtgggatgggcagtagtcgacatgaatcaccgactgatgaaaagaaatggaaagcatttatggggatcgagattattctctaatgcagaaacggcagccaccaggagaagttcgcgaagcataagacgaagatacaataaacgaagagaacgaatcagattactaagagcaatactacaggatatggtattagagaaagaccctaccttttttataagattagagcacacaagcttcttagatgaagaagataaagcaaaataccttggcactgattataaagacaattataacttattcatagacgaagacttcaatgactacacgtactaccataaatacccaaccatatatcatctaagaaaggcactctgcgaatccaccgaaaaagcagatcctcgactcatatatctagcactgcatcacatagttaaatacagaggtaattttctctacgaaggacaaaaattcaacatggatgcaagtaacatagaggataaattatctgatgtattcactcaatttgcagacttcaacaacataccatacgaagatgatgaaaaaaagaatctagaaatactagaaatcttaaaaaaaccattatcaaaaaaggcaaaagtagacgaagttatggccctaatatcaccagaaaaagaatttaaaagtgcatataaagaacttgtaaccggaatcgccggcaacaaaatgaacgttacaaaaatgatactatgcgaatcaataaaacagggtgatagcgaaataaaattaaaattctcagattcaaactacgacgatcaattcagtgaagtagaaaacgatttaggagaatacgtagaatttatcgacagtttacacaacatctactcatgggtagaactacaaacaataatgggagctacccacacggataatgcttcaatatcggaggctatggtctctagatacaataaacatcatgaagacctacaattattaaaaaaatgcatcaaagataatgtacccaaaaaatacttcgatatgttcagaaacgacagtgaaaaagttaaaggctattacaactacataaacagacccaataaagcaccagtcgacgaattttacaaatttgtaaaaaaatgcatagaaaaagtagacacaccggaagctaaacaaattctccacgatatcgaacttgaaaacttcttgctcaaacaaaacagtcgtactaatggatcagtcccataccaaatgcaactagacgagatgatcaaaataatagacaatcaagcgaaatactatcctgtcttaaaagaaaaaagagaacaactgctttcaatattaactttccgtatcccatattacttcgggccattaaacgaaacttcagaacacgcatggattaaaagattagaaggaaaggaaaaccaacgcatactaccatggaactaccaagacaccgttgatgtagatgctactgcagaaggatttataaaacgaatgagaagttactgtacttactttccagacgaggaagtcttacccaaaaatagtcttattgtttcaaagtacgaagtttacaacgaattaaacaagataagagtcgatgataaactacttgaagtggatgtaaaaaacgatatatataatgaactcttcatgaaaaacaaaactgtaaccgaaaaaaaactaaaaaactggttagtaaacaatcagtgttgcagaaaagatgcggaaattaaaggtttccaaaaagaaaaccaattttcaacgagtctaacgccatggatcgattttacaaacatattcggtaagatagatcaatcgaattttgacttaatagaaaagatcatatatgatttaacagtattcgaagacaaaaagataatgaaaagacgactaaagaaaaaatacgctctcccagacgataaaataaagcaaatattaaaactaaaatacaaagattggagtagactaagtaaaaaactattggacggcattgtagcagataacagatttggaagttcagtgacagtcctagacgtactagaaatgtcacgcctgaacttgatggaaatcattaacgacaaggaactaggatatgcgcaaatgatagaagaagccagttcctgtcccaaagatggaaaattcacatatgaagaagttgccaaacttgccggctcaccagcacttaagagaggtatatggcaatcattacaaattgtagaagaaataaccaaagttatgaaatgtcgcccaaagtacatatacatcgaattcgaaagatccgaagaagccaaagaacgtacagaatcaaaaatcaaaaaattagagaacgtatataaagaccttgatgaacaaacaaaaaaagaatataaatcagtactagaagaattaaaaggatttgataatacaaaaaagatctcatcagacagtctatttttatattttacgcaattagggaaatgtatgtacagtggaaaaaagctagatattgatagtctagataaataccaaatagaccatatagtcccccaaagcctcgtaaaagacgacagctttgacaacagagtacttgtactcccttctgaaaaccaaagaaaacttgatgatctcgtagtacctttcgatattcgcgacaaaatgtatcgattttggaagctactattcgatcacgaactaatatcacccaaaaaattctattcgctaataaaaacagaatatacagaaagagacgaagaacgattcattaataggcaactagttgaaacaagacaaataacaaaaaacgtaacacaaatcatagaagaccattattcaacaacaaaggtcgcagcaataagagcaaatctatcacacgaattcagagtaaaaaatcacatatacaaaaatagggacataaatgattatcatcatgcacacgacgcctacatagtggcacttatcggtggcttcatgagggaccgttacccaaacatgcatgattcaaaagcagtctattccgaatatatgaaaatgttccgtaaaaataaaaacgaccaaaaaaaatggaaagatggtttcgtaataaattcaatgaattatccatacgaagtagatggaaaactaatatggaacccagacctcattaacgagataaagaaatgtttctattacaaagactgctactgcacgaccaaactagaccagaagtccggccaaatgtttaacttaactgtgttaccgaacgatgcacacagtgctaaaggaaccacagaagcagtcatccctgttaacaaaaatcgaaaagacgtaaacaaatacggcggattttccggacttcaatacgttatcgccgcaatagaaggcactaaaaaaaaaggaaaaaaattagtgaaagttagaaaactaagcggaatccctttatatctaaaacaagctgatataaaagaacaaatcgaatacgtagagaaagaggaaaagttaagcgacgtcaaaattattaaaaacaacattccactcaatcaattaatcgaaatagacggacgccagtaccttctcacatccccaacagaatgtgtgaacgctatgcaactagtcctaaatgaagagcaatgtaaactgattgccgatatttacaacgccatctacaaacaagactttgatggccttgacaacatgttaatgatccaactatacctacaactaatagataaattaaagaccctctacccaatctatatggggatagttgaaaaatttgaaaagttaacagaagacttcgtatcgataagcaaagaagaaaaagcgaacgtaattaaacaaatgttaataataatgcacaaaggaccccaaaatggcaacattatatacgacgacttcaacgtcggaaaaagaataggtagactcaatggcagaacattctacctagacaatattgaatttatatcacaatcaccaacaggtatatacaccaaaaaatacaaactgtga

SEQ ID NO: 5271 - RNA, 4002 nt, synthetic construct
  misc_feature 1..4002: note = Cas9 variant
  source 1..4002: mol_type = other RNA
atgtatacctattactttaaggaaagtgagatggtatatgatgtgggtctcgatataggtacaggcagcgtcggatgggtagctctcgacgaaaatggaaaactagcacgagcaaaaggaaagaacttagtaggcgtaagactattcgacacagcacaaactgcagcagatagaagaggattcagaacaaccagaagaagattaagtaggcgcaaatggcgactaaggctactagatgaactgtttagtgccgaaataaatgaaatagacagcagcttttttcaacgtctcaaatattcatatgtacacccaaaagacgaagagaacaaagcacattactatggtgggtatctatttccaaccgaagaagaaacaaagaaattccatagaagttatccaaccatatatcacttaagacaagaactgatggctcaaccaaacaaacgctttgacatcagggaaatttatctagcaatacaccacctcgtaaaatatcgcggacactttttatcttctcaagaaaagataacaattggaagtacctataacccggaagacctcgcgaatgctattgaagtatacgcagacgaaaaagggttgtcatgggaattaaataaccctgaacagttaaccgaaattatatccggagaagcaggctatggtttaaacaaatcaatgaaagcagatgaagctttaaaactatttgaatttgacaataaccaagataaagtagcaataaaaacactccttgcaggattaacaggaaatcagatcgatttcgcaaaattatttggaaaggacatatcagacaaagatgaagcaaaactatggaaactaaaactagatgatgaagcactagaagaaaaaagtcaaacaatactatcccaacttacagacgaagaaatagagctatttcacgcagtagtacaagcatacgatggatttgtactaataggactactaaacggagctgatagtgtttctgcagcaatggtgcaactatatgatcaacatcgagaagatcgtaagcttctaaaatcactcgcacaaaaagcaggactgaagcacaaacgcttttccgaaatctacgaacaattagcccttgcaacagacgaagcaactataaaaaatggcatctcaacggcgcgagaactagttgaagaaagtaatctaagtaaagaagtcaaggaagatactctaagaagactcgacgagaatgaattcttaccaaaacaaaggacaaaagcaaacagtgtcatacctcaccaattgcacttagccgagttacaaaaaatactacaaaatcaaggccaatattaccctttcttactcgacaccttcgaaaaagaagatgggcaagacaataaaatagaggaactactcaggttcagaataccttattatgtcggaccactggttacaaagaaagacgtggaacacgccgggggtgacgcagataatcattgggtagaaagaaatgaaggcttcgaaaagtcgagggtaacaccctggaacttcgacaaagtcttcaatagagataaggcagccagagacttcattgagcggctaacaggaaacgacacttatttaataggggagaaaacactccctcaaaattcactaagataccagttgtttacagtacttaacgaattaaataacgtaagggttaatggaaaaaaatttgacagtaagaccaaagcagatctaataaacgacctcttcaaagcgaggaaaacagtctcactttcagcattaaaagactacctaaaagcacagggaaaaggagacgtcaccataacaggactagcagacgaatctaagttcaatagctcacttagctcgtataatgacctcaaaaaaacattcgatgctgagtacttagaaaatgaagacaatcaagaaactctagagaaaatcatagaaatacaaactgtattcgaagacagtaaaatagcttcaagagaattaagtaagctaccactagacgatgatcaagtaaaaaaattatctcaaacacattacacaggatggggcagactcagcgaaaaattattagactcaaaaataatagatgaaagaggacaaaaagtatcaatactcgataaactaaaatccacgtcacaaaacttcatgtccataatcaataacgataaatacggagtacaagcatggatcacagagcaaaatacaggaagctccaaactcacatttgacgaaaaagtgaacgagctaaccaccagcccagccaataaaagaggcattaaacaatcatttgcagtattaaatgatataaaaaaagcaatgaaagaagaaccaagacgcgtatatctcgaattcgcaagagaagatcaaacaagcgtaagatctgtaccaagatacaaccaattaaaagaaaaataccagtcgaaaagcttatcagaagaagcaaaggttctaaaaaaaaccctagatggaaacaaaaataaaatgagtgatgatcgttattttctttactttcaacaacaaggtaaagacatgtatactggtagaccaatcaacttcgaaagattatcccaagactatgacatagatcacataattccacaggcattcactaaagacgatagtcttgacaatagagtattagtttcccgccctgaaaacgccagaaaaagtgatagtttcgcatataccgatgaagtccaaaaacaggatggatcattatggacttcattattgaaatccggattcatcaacagaaaaaaatacgaaaggttaacaaaagctggcaagtacctagatggacaaaaaacgggtttcatagcgagacagcttgtggaaacgagacaaatcataaaaaacgttgcctcacttatcgaaggtgaatacgaaaattcaaaagctgtcgcaataagaagtgaaataaccgcagacatgagactactagtcggcattaaaaaacatcgagaaataaactcattccatcatgcatttgatgcgcttcttataacagccgcaggacaatacatgcaaaatcgatatcctgacagggattctaccaatgtttacaatgaatttgaccgttatacaaatgattacttaaagaatctaagacaactaagcagcagagacgaggtgcgtcgactaaaaagtttcggcttcgttgtaggaacaatgcgaaaaggtaatgaggactggtctgaagaaaatacaagttatttacgaaaagtgatgatgttcaaaaatattttaaccaccaagaaaacagaaaaagacaggggtccactaaacaaagaaaccatattttcaccaaagtcgggaaaaaaacttatcccacttaactccaagagatccgatacagccctatacggagggtattctaacgtatatagcgcctatatgacattagtcagagcaaatggcaaaaatctattaataaaaattcccatatcaatagcaaatcagatagaagtagggaacttaaaaataaatgattatatagtgaacaatcctgctattaaaaaattcgaaaaaattctaatcagcaaactcccgttgggtcaactagtaaacgaagacggaaatttaatatacctcgcatccaacgaatacagacataacgctaaacaactttggctatctacaactgacgcagacaaaatagcatcaatatccgaaaattcatcagacgaagagttactagaagcatacgatattctaacttcggaaaacgtaaaaaataggttccccttttttaagaaggacattgacaaactcagtcaagttcgggacgaattcttagactcagataaacgcatagcagtcatacaaacaatcctaagaggtttacaaatagacgcagcatatcaggcccccgtaaaaataatttcaaaaaaagtctccgattggcataaactacaacaatcaggaggaataaaactcagcgataattccgaaatgatataccaatcggccactggcatctttgaaacgagggttaaaatttcagacctactctga

SEQ ID NO: 5272 - RNA, 4005 nt, synthetic construct
  misc_feature 1..4005: note = Cas9 variant
  source 1..4005: mol_type = other RNA
atgaaaaacccttatactataggtttagatatcggtactaattccgttggatgggcagttctaaccaaccaatatgacttggtaaaaagaaaaatgaaagtagcaggaaattcagacaagaaacaaataaagaaaaatttctggggagtaagactattcgacgacggccaaactgcagtcgatagacggatgaatcgcactgcccgaagaaggatcgaaagacgcagaaatcgcattagttatctacaagaaatattcgcagtcgagatggcgaacatcgacgcaaatttcttttgccgattaaatgattcattctacgtagactctgagaaaagaaattcacgtcatcccttcttcgcgacaatagaagaagaagtagcctaccacaaaaactatagaacaatataccatttacgagaagaattagtaaattcttcagaaaaagcggatctacgcctagtatacctagcacttgcacatataatcaaatatagaggaaactttctaattgaaggagcattggacactaaaaacaccagtgtcgacggagtgtacgaacaattcatacaaacctacaaccaagtattcatgtcaaatattgaagaaggtaccttagctaaagtagaagaaaatattgaggtagctaacatattagcaggaaaattcaccagaagggaaaaatttgaaagaatccttcaactttatccaggtgaaaaatcaaccggaatgttcgcgcaattcatcagtcttatagtaggctcaaaaggaaatttccaaaaagttttcgacctaatagagaaaacggatatagaatgtgcgaaagattcatacgaagaagacctcgaggctttacttgcgattattggcgatgaatacgcagaactatttgtagcagcgaaaaatacatacaacgcagttgtactaagttcaatcataaccgtcaccgcaacagaaacaaatgccaaactttcagcctccatgattgaacgattcgatgcccacgaaaaagacctaggtgaattgaaagcattcattaaattacacttaccaaaacaataccaagaaatctttaataatgcagccatagatggatatgcgggttacatagatggcaaaacaaaacaagtagacttctacaaatatctaaaaaccatccttgagaacatagaaggagccgattacttcatagcaaaaatagaagaggaaaattttctgcgaaaacaaagaaccttcgataacggcgctatacctcaccaattgcaccttgaagaactagaagccatcatacaccaacaagctaaatactatccatttctaagggaagactatgagaaaataaagagcttagttacattcaggataccctactttgtaggaccgctagccaaaggtcaatctgaatttgcatggctgacaaggaaagccgatggagaaatcagaccatggaacatagaagaaaaagtagacttcggaaaatcagcggtagacttcatagagaaaatgactaacaaagacacatatcttccaaaagaaaatgtactcccaaaacactctttatgctatcaaaaatatatggtctataacgaattaacaaaagtaagatatatagacgatcaaggtaaaacaaattacttctccggccaagaaaaacaacaaattttcaacgacttatttaaacagaaaagaaaagtcaaaaagaaagatcttgaactattccttagaaatatcaatcacattgaatcaccaaccattgaaggcttggaggactcattcaacgcatcatatgcaacttaccacgacctacttaaagtcggaatgaaacaagaaattctagacaaccctctaaacacagaaatgctagaagacatcgtaaaaatcctaactgtttttgaagacaagccgatgatcaaggaacaactacaacaattttcggatgtactagatggtggagtacttaaaaagctagagcgacgccattatacaggatggggtaggttgtccgcaaaactacttgtaggaataagagaaaaacaaagccatctaacaatattagattacttaatgaatgacgacgggctaaacagaaatctgatgcaactaataaatgacagcaatttatcattcaaatcaattatagaaaaagaacaagtcagcacaacagacaaagaccttcaatctattgttgcagatctagcaggcagcccggccatcaagaaaggtatccttcagtctttaaaaatagtagacgaattggtatcgataatgggatacccaccacaaactatcgtagttgaaatggccagagaaaatcagaccactggtaaaggcaaaaataattcaaaaccccgatataaatcattggaaaaagccattaaagaatttggatcaaaaatattaaaagaacacccaacagacaaccaagaactcaaaaataataggctatacctctactacttacaaaatggcaaagacatgtatacaggacaagaattggacatacataacttaagtaactacgatatagaccacattgttccacaatcatttataactgacaactcaattgataatctggttcttacaagctctgcaggaaaccgtgagaaaggaggagatgtaccaccactcgagatagttagaaaacgaaaagtcttctgggaaaaattatatcaaggaaatctaatgtccaaaaggaaattcgactatttaactaaagccgaacgtggtggtctcacggacgcagacaaagcaagattcatccacagacagctagtagaaacccgccaaatcactaaaaacgtagcaaatatactacatcaaagattcaacaatgaaacagacaaccatggcaatacaatggaacaagtaagaatagtcacattaaaatccgctttagtaagtcaatttagaaaacaatttcaattatataaagtaagagaagtaaatgactaccatcatgcacacgatgcatacctaaatggagtggtggctaatacacttttaaaagtctacccacaactagaaccagagttcgtctatggcgaataccatcaattcgactggttcaaagcaaacaaagcaacagccaagaaacaattctatacaaatataatgctattctttggacaaaaagaacgaataatcgacgaaaatggagaaatattatgggataagaaatatttagaaacgattaagaaagtactagattatcgacaaatgaacattgtaaagaaaaccgaaatccaaaaaggagaattttctaaagcaacaataaaaccaaaaggtaacagcagtaaacttatacccagaaaagaaaattgggatccaatgaaatatggcggtctagactcacctaacatggcttacgccgtaataatagaacatgccaaagggaaaaagaaactaatttttgagaagaaaataattagaatcaccatcatggaaagaaaaatgtttgaaaaagacgaagaagcatttttagaagaaaaaggatatcgacatcctaaagtactaactaaattgccaaaatataccttatacgaatgcgaaaaaggacgccgaagaatgctagcaagcgccaatgaagcacagaaaggcaaccaactggtcctatcaaatcatttagtaagtctcctctatcatgctaaaaattgtgaagcctcagacggaaaatctctaaaatacatagaggcacatagagagacatttagcgagttattagcccaagtatcagaatttgccaccagatatactttagccgacgccaacctgagcaaaataaataacctttttgagcaaaataaagaaggtgatatacaagcaatcgcccagagcttcgtagatctaatggcattcaacgctatgggagcacccgcctctttcaaattctttgaagccaccatagacagaaaaagatacacaaatttaaaagaattactttcatcaacgatcatatatcaatcaataacaggtttatacgaatcaagaaaaagattagacgattga

SEQ ID NO: 5273 - RNA, 4005 nt, synthetic construct
  misc_feature 1..4005: note = Cas9 variant
  source 1..4005: mol_type = other RNA
atgaaaaaaccatacaccataggtctagatataggaacaaactctgttggatgggctgctctaactgaccaatatgatctagtaaaaagaaagatgaaagttgccggtaactcagaaaaaaagcaaattaaaaagaacttatggggcgtcaggctggtagacgaaggaaaaactgcagcacatcgacgcgttaatagaacaacaagaagaagaattgaaagacgacgaaacagaatttcatatctacaagaaatttttacggcagaaatgttcgaggtagatgcaaactttttttacagactcgaagattcgttttacatagagtcagaaaaacgacaaagtagacacccatttttcgctacaatagaagaagaagtcgcatatcacgaaaattacagaacaatctaccatttaagagaaaaactagtaaattcatcggacaaggcagacctaagattggtatacttagctctcgcacatatcatcaaatacagggggaatttcctaatcgaaggtaaactagacacaaaaaatactagcgtagacgaggtttttaagcaattcataaaaacatataaccaagtatttgccagcgatattgaagaaggaagtttaacaaggatagaggaaaacaatgaggtagcaaaaatcttttctgaaaaactcaccaaaagggaaaaactcgataaaattttgaacttatatcccaatgaaaaaagcactgacttatttgcccaatttataagcctaatcataggatctaagggcaatttcaaaaaatttttcaacctcacagaaaaaaccgacattgaatgtgcgaaagatagttacgaagaagacttagaagttttactagcccgagtgggagacgaatacgcagaaatatttgtggcagcgaaaaatgcgtacaatgctgtagtattatctagtatcattacagtatccaacaccgaaaccaaagcaaaactatcagcttctatgatagagagattcgataaacatgacaaagaccttaaacgtatgaaggcattctttaaagtcagactaccagaaaatttcaatgaagtatttaatgatgtagaaaaagatggctatgcggggtacatagaaggcaaaacaaaacaagaagcattctacaaatacatgaaaaaaatgcttgagcacgtcgaaggggcggattactttatcaaccaaatcgaagaagaaaattttttacggaaacaacgaacattcgataacggagcaatcccacatcaactacatctcgaggaacttgaagctatactacaccaacaagcgaaatattaccccttcttaaaagtcgactacgaaaaaatcaagagcctagtcacttttagaataccttacttcgtaggacccttagccaatggacagagtgaattctcgtggttaacacgcaaagcagacggagaaataagaccttggaacattgaagaaaaagtcgatttcggaaaaagtgcaatcgactttattgaaaaaatgacaaacaaagatacctacctcccaaaagaaaacgtattaccaaaacacagcatgtgctatcagaaatacatggtatataatgaattaacaaaaataagatacacagatgaccaaggcaaaactcactactttagcgggcaagaaaaacagcaaatattcaatgacttattcaaacaaaaaaggaaagttaaaaaaaaggacttagaattattcctctataacatgaatcatgtagaatcaccaacagtagaaggagtagaggatgcattcaattcctcttttaccacataccacgacctacagaaagtaggagtccctcaagaaatattagatgatccactcaacactgaaatgttagaagaaataattaaaatactaaccgtattcgaagacaaaagaatgatcaatgaaagattacaagaattcagcaatgtcttagacgaagcggtacttaaaaaactagagagaagacactatactggctggggaagactaagtgctaaattactaatcggaatacgcgacaaagaatcccacctgactatacttgattatctaatgaacgacgataaacacaacaggaaccttatgcagcttataaacgacagtaacctttcctttaagtcaatcatagaaaaagaacaagtctcaacagcagataaagatatccagtcaatagtcgcggacttagcagggagcccagcaataaaaaaaggaatcctccaaagcctcaaaatagtcgacgaattagtaggaatcatgggttatccgccacaaacgatcgttgtagaaatggcaagggaaaatcaaaccaccggaaaagggaaaaacaattcaaaaccaagatttacctcattagaaaaagctataaaagaactaggaagccaaattctcaaagaacacccaacagataaccaaggattaaaaaatgacagactatacctttactatctacaaaatggaaaagacatgtatacaggtcaagaattagatatacacaatctaagtaattatgatattgatcacgtagtacctcaaagctttataacagataactccatcgacaatagagtactagcttcatccgctgcaaatagggaaaaaggagacaacgttccctcgctagaggtagtaagaaaaagaaaagtctattgggaaaaactgtatcaagcaaaactcatgagcaaaagaaaatttgattatctaacgaaagcagaacgaggaggcctgactgaagcagataaagcaagattcattcatagacaactagtcgaaacacgtcaaatcaccaaaaatgttgcaaacattttacatcaaagatttaattgcaaaaaagatgagtccggaaacgtcatcgaacaagttagaatcgtaacacttaaagcagcattagtatcgcaattcagaaagcaattccaattatacaaagtacgagaagtgaacgactaccatcacgcacacgacgcctaccttaactgtgttgtcgctaatacattactaaaagtttacccacaactcgaacccgaattcgtgtatggagattatcaccagttcgattggttcaaagccaacaaagccacagctaaaaaacaattttataccaatataatgctatttttcgcaaaaaaagatcgtataatagatgaaaacggcgaaatcctctgggacaaaaaatacctcgacacaataaaaaaggtattaaattataggcaaatgaacatagtaaaaaagacagaaatacaaaaaggtgaattctcaaatgccacagcaaacccaaagggaaatagtagcaagcttatccccagaaaagctgattgggatccaattaaatatggcggtttcgacggttcaaatatggcttacgccatcgttattgaacatgaaaaaagaaaaaaaaaaacggtaataaaaaaagaactaatccagataaatataatggagaggacagcgttcgaaaaggatcaaaaagaattcctcgaaggtaaaggataccgtaatccaaaagttatcacaaagatacctaaatacaccttatacgaatgtgaaaacggaagaagaagaatgctaggatcagccaatgaagcacaaaaaggaaaccaaatggtcctgccgaaccaccttatgaccttactatatcacgcgaaaaactgtgaagcatcggacggtaaatccttagcatatatagagtctcatcgagaaatgtttgcagaattattagactcaatatctgaattcgcgtctcgttacactcttgctgatgcaaatctagagaaaataaacacaatcttcgaacaaaacaaaagtggagacgtcaaagtcatagcacaaagctttgttaatctactcgaatttaatgcgatgggagccccagcatcgttcaaatatttcgagaccaacatcgaacgtaaaaggtacaacaatttaaaggaactattaaatgccacaataatctaccaatcgatcacaggactatatgaggcaagaaaaaggcttgatgattga

SEQ ID NO: 5274 - RNA, 4005 nt, synthetic construct
  misc_feature 1..4005: note = Cas9 variant
  source 1..4005: mol_type = other RNA
atgaaaaacccatacacaataggtttagatataggaacaaacagcgtaggatgggcagtattaaccgaccaatacgatcttgtaaaacgtaaaatgaaagtagctggaaacagcgataagaaacaaatcaagaaaaacttctggggagtcaggctattcgatgatggacaaacagcagtagacaggcggatgaataggactgctcgacgacgcatagaaagacgtaggaacagaataagttatctacaagaaatatttgcagtcgaaatggcaaatatagacgcaaatttcttctgtcgcctcaacgactcattttatgtagatagtgagaaaagaaatagtagacacccctttttcgccacaatcgaagaagaagtcgcatatcataaaaactacagaacaatttaccatctacgagaagagttagtgaacagcagtgaaaaagcagatttaaggttagtgtatttagcactagcacacattattaaatacagaggaaattttctcatcgaaggagcactagatacgaaaaatacttcagtagacgaagtatacaaacaattcattcaaacatacaatcaagtattcatgagtaacatagaagaaggagctctggcaaaagtagaagaaaacacggaagtcgcaagtatattggcaggaaaattcactagaagggaaaaatttgaaagaatactcagactctaccctggcgaaaaatcaaccggtatgttcgcgcaatttatttccctcatagtagggaacaaaggaaacttccaaaaagttttcaacctggtagagaaaacagacatagaatgtgcaaaagattcatacgaagaagacttagaagcactattagcaataataggtgacgaatatgcggaattgttcgtagctgccaaaaacacatacaacgcagtcgtattatcatcaataataacagtaacagcaactgaaacaaacgcgaaactatccgcctccatgatagaacgatttgacgcacatgagaaagaactaggagaattaaaagcctttattaaattacatctgccaaaacaatatcaagaaatatttaataatgcagaaatagatggatacgcaggttatatcgacggaaaaacaaaacaagttgatttttacaaatatctaaaaaccacactagaaaatgtagaaggagctgattacttcatcactaaaattgaagaagaaaatttcttaaggaaacaaagaacatttgacaacggcgttataccccaccaactacacttagaagaattagaagcaatcttacaccaacaagctaaatactacccatttttacgtgaaggctatgacaaaatcaaatcactggtaacatttagaataccgtactttgtaggaccattagctaacggacaatcagagttcgcttggctcacaagaaaagatgatggagaaataaggccttggaacatagaagaaaaagttgatttcggaaaatcagcagtagacttcatcgagaaaatgaccaataaagacacatacctaccgaaagaaaatgttctaccaaaacactcattatgctaccaaaaatacatggtttataatgaactaacaaaaatccgatacattgacgaccagggtaaaactaactacttcagcggacgtgaaaaacaacaaatatttaacgatctttttaaacagaaaaggaaagtcaagaagaaagacttagaactattcttgcgaaatataaaccatatagaatcgcccactatagaaggcttagaagacagtttcaatgcaagctacgccacttatcatgacttacttaaagtaggactaaaacaagaaatactagacaaccctttaaacaccgaaatcttagaagacattgtaaaaatactaactgtattcgaagataaacgaatgatcaaagaacagttagaacaattctcagatgtactagatggagtcgtcttgaagaaactagaacgccgccattacacgggttggggaagattatccgcaaaattgttggttgggattcgtgacaaacaatcgcacctcactatactagattatttaatgaatgacgacggattaaaccgaaacttaatgcaattaataaacgactcaaacctcagcttcaaatcaataattgaaaaagaacaagtatcaacaactgataaagatctgcaaagcatagtagctgacttagcaggatcgcctgctatcaagaaaggcattctacaatcactcaaaattgttgatgagctagtcagtatcatgggatatccaccccaaacaatagtggttgaaatggcgagagaaaatcaaacaactggaaaaggcaaaaacaatagcaaaccaaggtataaaagcctagaaaaagcaataaaagattttggatcgcaaattttaaaagaacaccccaccgataaccaagaactcaaaaacaatagactatatttatattacttacaaaatggaaaagacatatacacaggacaagaattggacatacacaatctctccaattatgacattgatcacatagtaccacagagcttcataactgataattccatagataatctcgttctaacatcatcagctggaaacagagaaaaaggaggagacgtaccaccattagaaatagttaggaaaagaaaagtattttgggaaaaattgtatcaaggcaatttaatgagtaaacgaaaatttgactatctaacgaaagccgaaagagggggcctaactgaagccgacaaagcaagatttattcatcgtcagctagtcgaaacaaggcagattaccaaaaatgttgcaaatatattacaccaacgatttaataaagaaacggacaatcacgggaatacaatggaacaggtaaggatagtaactttaaaaagcgccctagtatcacaatttcgaaaacagtttcaactttacaaagtcagagaagtgaacgactatcaccacgcacatgacgcttatctgaatggcgtggtagcgaatacactacttaaagtatacccacaattagaaccggaatttgtttatggcgaataccaccaatttgactggttcaaagcaaataaagcaactgccaagaaacaattctacacaaatattatgttattctttgcacaaaaagaaaggatcatagacgaaaacggcgaaattttatgggacaagaaatatctagaaaccatcaaaaaggtactagactacagacaaatcaacatagtaaagaaaacagaaattcaaaaaggcgaatttagtaaagctaccataaaaccaaaaggaaacagttcgaaactcataccacgcaaagaaaattgggacccagttaaatacggaggcctagatagcccaaatatggcatatgccgtaataatcgaacacgctaaaggtaaaaagaaaatagtaatcgagaagaaactaattcaaatcaatatcatggaacgaaaaatgttcgaaaaagacgaagaggctttcctagaagaaaaaggttaccaccaacctaaagtattaacaaaattaccaaaatacacactatatgaatgcgaaaaaggcagaagaagaatgctatcatcagcgaatgaagcccagaaaggaaatcaattagttttaagcaatcatttagttagcctactatatcacgccaaaaactgcgaagcaagtgatggaaaaagtctaaaatatattgaagcacatcgagaaacattcagtgaacttttagcacaagtatcagaatttgcaacaaaatatactctcgccgacgccaatttgtctaaaataaacaacctcttcgaacaaaataaagaaggagacataaaagcgattgcgcaatcatttgtagacctcatggcatttaacgcaatgggagcaccagcaagttttaagttctttgaagcaacaatagacagaaaaaggtatacaaatctaaaagaactattaagcagtacaattatataccaaagtatcaccggtctctacgaaagtagaaaaaggcttgacgactga

SEQ ID NO: 5275 - RNA, 4005 nt, synthetic construct
  misc_feature 1..4005: note = Cas9 variant
  source 1..4005: mol_type = other RNA
atgggtcgtaaaccatacatactatcattagatatcggtacaggatcggtaggatacgcttgcatggacaaaggatttaatgtactaaaatatcatgacaaagacgcactaggtgtatatctcttcgatggtgcattaactgcacaagaacgacgacaattccgaacaagccgtcgaaggaaaaaccgacgcataaaacgactaggcttactacaagaactcttagctcccttagtacaaaacccaaacttctaccaattccaacggcaatttgcctggaaaaacgacaatatggacttcaaaaacaaatccttatctgaagtcctctcatttttaggctacgaaagcaagaaatacccaaccatataccacctacaagaagctctactactaaaagacgaaaaatttgacccagaacttatatatatggccttatatcatctagttaaataccgagggcacttcttattcgaccacttaaaaatcgaaaatctaaccaataacgacaatatgcacgacttcgtagagctaatcgagacctacgaaaacttaaataatatcaaactaaacttagactacgagaaaactaaagtaatctatgaaatactcaaagataacgaaatgaccaaaaacgaccgagcaaaacgcgttaaaaatatgcagaaaaagctagaacaattttcaataatgttacttggactaaaattcaacgaaggcaaattatttaatcacgccgacaacgcagaagaattaaaaggagcaaatcaatcccacacatttgccgacaattacgaagaaaatctgacaccattccttacggtcgaacagtctgagttcatagaacgagcaaacaaaatttatctatcattaacactacaagacatactgaaaggaaagaaatcaatggctatgtccaaagttgctgcatatgacaaatttcgtaacgaactcaaacaagttaaagatatagtttacaaagctgattccacacgaacccaattcaagaaaatatttgtatcaagcaaaaagagcctcaaacaatacgacgcgacacccaatgaccaaactttcagctcactatgcctattcgaccaatatctaatcagacccaagaaacaatactcattactcatcaaagaactcaagaaaataattccacaagattcagaactctactttgaagcagaaaatgatacactccttaaagttttaaacacaaccgataatgcatccataccaatgcaaattaacctatacgaagcagaaacaatacttcgcaatcaacaaaaatatcacgcagaaataacagatgaaatgatagaaaaagtactgtcactaattcaattccgaataccatactatgtaggcccacttgtaaatgatcacacagcaagtaaattcggctggatggagaggaaatctaacgaatccatcaaaccatggaattttgacgaagtagtagatcgctcaaaatctgcaacacaattcataagaagaatgaccaacaaatgctcatacctaatcaatgaagacgtactacccaaaaactcactactataccaggaaatggaagtcctaaatgaactaaatgccacccaaatacgattacaaaccgaccccaaaaacagaaaatataggatgatgccacaaatcaaattatttgccgtagagcatatttttaagaaatataaaacagtctcacactccaaattcttagaaatcatgctaaactctaatcatcgtgagaattttatgaaccatggtgaaaaattatcaattttcggaacacaagatgacaagaaattcgcctccaaactcagttcttaccaagacatgaccaaaatatttggcgatatcgaaggaaaacgagcacaaatcgaagaaataattcaatggattaccattttcgaagacaagaaaatattagtacaaaaactaaaagaatgctaccctgaactaacgtctaaacaaatcaaccaattaaagaaattaaattactcaggctggggacgtctctcagagaaactacttacacacgcataccaaggacactccataatagaactcctaagacactcggacgaaaatttcatggaaatactaacgaatgatgtgtacggatttcaaaatttcattaaagaagaaaaccaagttcaatcaaacaaaatccaacaccaagacatcgcaaatctaactacatcacccgcgctaaagaaaggaatctggtcaacaatcaaactggtacgggagctaacatcaatttttggtgagccagagaaaatcataatggaatttgccactgaagatcaacaaaaagggaaagagcaaaaatcgagaaaacagctatgggacgacaacatcaagaaaaacaaattaaaatccgtcgacgaatacaaatacataatagatgtagcaaataaacttaacaacgaacaactacagcaagaaaaattatggctttatcttagtcaaaatggcaaatgtatgtattcaggacagtcaatagatctcgatgcactactatctccgaatgctacaaaacactacgaagtggaccatatattcccacgatcattcataaaagacgatagtatagacaataaagtactcgtcatcaagaaaatgaatcaaacaaaaggagaccaagtacctctccagttcatccaacaaccttatgaaagaattgcctactggaaatctctcaacaaagcaggattgattagcgactcaaaactacacaaactaatgaaacccgaatttacagcaatggataaagaaggtttcatacaacgccaattagtagaaacacgacaaatctccgttcacgtaagagacttcctcaaagaagaatatccaaacactaaagtaatacccatgaaagcaaaaatggtttcagagttcagaaagaaattcgacatacccaaaataagacaaatgaacgacgcacaccacgccattgacgcataccttaacggagtagtttaccacggagcacagctagcatatcccaatgttgacctgttcgacttcaattttaaatgggagaaggtaagggagaaatggaaagcactaggagagttcaacacaaaacagaaaagtagagaactcttctttttcaagaaactagagaaaatggaagtatcacaaggagaacgcctgatctcaaaaataaaactagatatgaatcactttaaaatcaattattccagaaaactagccaacataccacaacaattttacaatcaaaccgcagtgtcacccaaaacagcagagctaaaatacgaatcgaacaaatccaacgaagtagtatacaaaggcctcactccataccaaacatatgttgtagcaataaaaagcgtcaacaagaaaggaaaagagaaaatggaataccagatgatagatcattatgtattcgatttttacaaattccaaaacggaaatgaaaaggaactcgctctatatttggcacaaagagaaaataaagatgaagtactcgatgcccaaattgtatactcattaaataaaggagacctcttatacattaataaccatccctgttatttcgtatccagaaaagaagtcataaatgcaaagcagttcgagttaaccgttgaacaacaactatccctatacaacgtcatgaataataaagaaactaacgtcgaaaaactcctgatagaatatgacttcattgctgaaaaagtcattaatgaataccaccactatttaaactcaaaactaaaagagaaaagagtacgtacattctttagcgaaagtaatcaaacacacgaagatttcatcaaagcacttgacgaattattcaaagtagttaccgcatcagccacaagatcggataaaattggatcaaggaaaaattcaatgacccacagagcatttctaggaaaaggaaaagatgtaaaaatcgcctacacttcgatatcaggattaaaaacaacaaaacctaaaagcctctttaaattagcagaatcacgtaatgagctatga

SEQ ID NO: 5276 - RNA, 4005 nt, synthetic construct
  misc_feature 1..4005: note = Cas9 variant
  source 1..4005: mol_type = other RNA
atgaaaaacccctacacaataggactggatataggaacaaattcagtaggctgggctgtactaacagaccagtatgatctagtcaagcgcaaaatgaaagtagcaggaaacagcgacaagaaacaaataaagaaaaatttctggggtgtcagattatttgacgaaggggaaactgcagctgatagaagaatgaatagaactgccagaagaagaatagaaagaagaagaaatcgcatcagttatttacaagagatatttgcattagaaatggcaaacatcgacgcaaatttcttttgtcgcctgaatgatagcttttatgttgacagcgagaaaagaaactccagacatccatttttcgcaacaatagaagaagaagtcgcatatcacaaaaattatagaaccatatatcacttacgggaagaactggtaaatagtagcgaaaaagcagacttaagattagtatatcttgcgttagcacacatcatcaaatacagaggcaacttcctaatagaaggagcattggatactaaaaacacaagtgtagatggagtatacaaacaattcatacaaacatataaccaagtctttatatccaacattgaagagggcacattagcaaagatggaagaaaacacaacagtcgcagatatactagcaggaaaattcacacggaaagaaaaacttgagagaatactacagctatatcctggagaaaaatcaacagggatgtttgcacaattcatatctcttatcgtaggatcgaagggcaactttcaaaaagtattcgatcttgttgagaaaactgacattgaatgtgcaaaagacagttacgaagaagacctcgaagcactactggcaataattggagacgagtacgcagaattatttgttgctgcgaagaatacttacaatgctgtagtcctttccagcatcatcacagtaacagacacagaaaccaacgcaaaattgtcagcaagcatgatagaacgatttgacgctcacgaaaaagacctaagagaacttaaagcgttcataaaactacacctacctaagcaatatgaagagatattcagtaatgtcgcaattgatggctacgctggctatatagatggtaaaacaaaacaagtagacttttacaaatacctcaaaactttactggaaaacatagaaggagccgattacttcatagctaaaatcgaggaagagaatttcctaagaaaacaaagaacctttgacaacggtgctattccacatcaattacatctcgaggaattagaagcgattttacatcaacaagctaagtactatccattctttaaagaagcatacgacaaaataaaaagtttagttacatttaggatcccatactttgttggtccactagccaatggacaatccgatttcgcctggctaacaagaaaagctgatggcgaaataagaccttggaatattgaagaaaaggtagacttcggaaaatcagccgtagattttatcgagaaaatgaccaataaagacacatatctaccaaaagaaaacgttctcccaaaacactccttatactatcaaaaatatatggtttacaatgaacttacaaaagtacgctacattgacgatcaaggcaaaacaaactacttcagcggacaagaaaaacagcaaatctttaacgattacttcaaaaagaaaagaaaagttagcaaaaaggatttagaacaattcctccgtaacatgtcccatatagaaagcccaactattgaaggtctagaagatagttttaattcttcttacgccacatatcatgacttgttaaaagtaggcataaaacaagaagtactagaaaatccactaaacacagaaatgttagaagatattgtaaaaatcttaacagtgtttgaagacaaaagaatgatcaaggaacaattacaacagttcagtgacgtattagatggagcagtactcaagaaacttgagcgacgccactatacaggctggggccgactatcagcaaaacttctagtagggataagagacaaacaatcacacctaacaatattggattacttgatgaatgatgatggattgaacagaaacctcatgcaactaataaacgatagtaatctatccttcaaaagcataatcgaaaaagagcaagtaagtacaacagataaagacttacaaagcatagtagccgatctagcgggatcaccagctataaagaaaggcatcctacaaagcctaaaaatagtagatgaattagtatcaataatgggatatccaccgcaaacaattgtagtggaaatggctagagaaaaccaaaccacagtaaaaggcaaaaataacagccgacctagatataagagcttagagaaagcaataaaagagttcggctctcagatactaaaagaacaccctacagataatcaagaactaagaaataataggttgtacctatattatttacaaaatggaaaagatatgtatacgggacaagaattggacatccataatctgagtaactatgacatagaccatattgttccccaaagtttcattacagacaacagtatagacaatctagtcttaacatcttctgctggaaatagagaaaaaggagatgacgtacctcccttagaaatagtcaggaaacgaaaagtcttctgggaaaaactattccaaggcaacttaatgtcaaaacggaaattcgattacttgactaaagcagaacgaggaggactaactgaagcagataaagccacattcattcatagacaattagtggaaacaagacaaataactaaaaatgttgctaacatcttacatcaaagatttaacaatgaaacagacaatcacggcaacaacatggaacaagtacggatagtaatgctaaaatcagccctggtctcccaattcaggaaacaatttcaactctataaagtaagggaggttaacgactaccaccacgcccacgatgcctacttgaatggagtggtagctaataccttactcaaagtatacccacaattagagcccgagttcgtctatggtgaataccaccaattcgactggttcaaagcaaataaagcaacagcaaagaaacaattttacacaaacataatgctattcttcgcgcaaaaagaaagaatcatagatgaaaatggtgaaatactttgggataagaaatacctagaaacaattaagaaagtattagattaccgacaaatgaacatagtcaagaaaaccgaaatacaaaaaggagagttctcaaaagcaactataaaacctaaaggtaattcatcaaaattaataccaagaaaagaaaattgggacccaatgaaatatggaggactagactcacccaacatggcctacgccgtcataattgaacacgcaaaaggtaaaaagaaagtagtgtttgaaaagaaaataataagaataacaataatggaacgcaaagcattcgaaaaagatgagaaaagttttctagaaaaacaaggatatagacaacctaaagttctaaccaaattaccgaaatacactttgtatgaatgtgaaaatgggagaagaagaatgctagcatctgccaatgaagcacaaaaaggaaaccagcaagttttaaaaggccaactaataaccttactacaccatgcgaaaaactgtgaagcctcagacggtaaatccctcgattatatcgaatctaatagagaaatgtttggtgaacttttggcgcacgtctcagaatttgctaagcgatacacactagcagatgctaacctttctaaaattaaccaattattcgagcagaacaaggacaacgacatcaaagtaatagcacaatcatttgtaaacttaatggcattcaatgctatgggtgcaccagcaagtttcaagttctttgaagcaacaatagagcgcaaacgatacacaaaccttaaagaattactatcggcaaccataatataccaatccataaccggactatatgaagcaagaaaaagacttgacggttga

SEQ ID NO: 5277 - RNA, 4005 nt, synthetic construct
  misc_feature 1..4005: note = Cas9 variant
  source 1..4005: mol_type = other RNA
atgaaaaacccttatactattggcctagacataggcacgaacagcgtaggatgggcagttctaactaaccaatatgacctagtaaaaagaaaaatgaaagtagcaggaaactctgacaagaaacaaatcaagaaaaatttctggggagtaagactttttgatgacggtcaaacagcagtcgacagacgaatgaatcgaactgctagacgccgcatagaacgaagaagaaatcgaatttcatatctacaggaaattttcgcagtagaaatggcaaatatagacgcaaacttcttttgcaggttaaatgactctttctacgtagatagtgaaaaacgaaattccagacatccattctttgctacaattgaagaagaagtagcgtatcatgacaactacagaacaatataccatttaagagaagaattagttaacagtagcgaaaaagcagatctacgcctggtctatttagctttagcacacataataaaataccgcggaaatttcttaatagaaggcgcgcttgacactaaaaacacatccgtggacgaggtatataaacaattcatacagacatataaccaagtattcatgagcaatattgaggaaggtgcattagctaaagtagaagaaaacctcgaagtagcatcaatactagcaggtaaatttacgcgaagggaaaaattcgaacggattctacgactatatccgggagaaaaatcaacaggtatgttcgctcaattcatttctctaatagtaggaaacaaaggtaactttcaaaaagtctttaatctggtagagaaaacagacatagaatgcgcaaaggatagctatgaagaagacttagaagctctacttgcaattataggcgatgagtacgcagaattatttgtggcagccaaaaacacatacaatgcagtagtattaagtagcatcataacagttacggccacagaaacaaatgcaaaattaagcgcctctatgatagaacggtttgatgcacatgaaaaagacctaggagaactaaaggctttcattaaactccacttgcccaaacaataccaagaaatatttaataatgctgcaatagacggatacgcaggatacatcgatggaaaaacaaaacaagtcgatttttacaaatatctaaaaacaacgttagaaaacgtagaaggagcagattattttataacaaaaatagaagaagaaaacttcttaagaaaacaaagaaccttcgacaacggagtaataccacaccaactccatttagaagaacttgaagcaatattacatcaacaggcaaaatattaccccttcttaagagaagactacgagaaaataaaatccttagtcacatttagaataccatattttgtagggccactagcaaaaggacaatcagaatttgcctggctaacccgaaaagctgacggagaaattagaccatggaacatagaagaaaaagtagacttcggaaaatcagccgtagacttcatagagaaaatgaccaacaaagatacctatctacccaaagaaaacgtactaccaaaacatagtctgtgttatcaaaaatacatggtgtacaacgaattaactaaagtgagatacattgatgaccaaggtaaaacaaattactttagcggtcaagagaagcagcaaatattcaatgatctctttaagcaaaaacgaaaggtaaagaagaaagatttagaacttttcttgagaaatattaatcacatagaaagcccaactattgaaggactagaagatagctttaacgcttcatacgccacttatcacgacctactgaaagtaggtatgaaacaagagagcctagatagccctctaaatgccgaaatgctagaagatatcgtcaaaatcttaaccgtattcgaagataaaagaatgataaaagaacagctacaacaattcagcgacgtactggacggcgtcgtgctaaagaaattagaaagaagacactacacaggctggggtcggctaagtgccaaattgctagtgggcattcgagacaaacaaagtcatttaactatattggattacctcatgaatgacgatggactaaatcgaaatctcatgcaactcataaacgattccaatctatcattcaaatcaataatcgaaaaagaacaagttagtacgactgataaagacctacagtcaattgtagcagacctcgctgggagtcccgccataaagaaaggtatattacaaagtttaaaaatagtagacgaactggtaagtataatgggatacccacctcaaaccattgttgtagaaatggcccgagaaaaccaaaccacagtaaaaggtaaaaacaattcaagaccacgatataaatcactagaaaaagcgataaaagagttcggaagtcaaatactcaaagaacatcctactgacaatcaggaactaaagaataatcgcctatatttatattacttacaaaacggtaaagatatatacacaggacaagaattagacatacacaacttgagcaactatgacatcgaccatattgttccacaaagttttattacagacaactcaattgacaaccttgtactaacaagtagcgctggaaatagggaaaaaggaggcgacgtaccacctttggaaatagtacgaaaacgaaaagtgttttgggaaaaattgtatcaaggcaacctaatgagcaaaagaaaattcgactatttaaccaaagcagagcgaggtggattaacagacgccgataaagcgaggttcatacaccgacaattggtagaaacccgacagatcactaaaaacgtagcaaacatactacatcaaagatttaacaatgaaacagataattacggcaataccatggaacaagtacgaatagtaaccctgaaatccgcattagtaagtcaatttcgaaaacaatttcaattatacaaagtaagagaagtaaacgattaccaccacgctcacgatgcataccttaatggagttgtagccaacactttactgaaagtatatccacaactagaaccagaatttgtatacggagaataccaccaatttgattggttcaaagcaaacaaagctacagctaagaaacaattttacactaatataatgttatttttcgcccaaaaagagagaataatagacgagaatggtgaaatactatgggataagaaatatttagaaaccataaagaaagtgctagattacagacaaatgaacattgtcaagaaaacggaaattcaaaaaggcgagttctcaaaagctactataaaaccaaaaggtaattcttcaaaactaataccaagaaaagaaaattgggacccaatgaaatatggaggattagacagcccaaacatggcatatgctgtaattatagaacatgcaaaaggcaaaaagaaaatagtcatagaaaagaaattaattcaaataaacattatggagcgtaaaatgttcgaaaaagatgaagaggcctttcttgaagaaaaaggataccgacatccaaaagttttaacaaaactaccaaaatacacgttatacgaatgcgaaaaaggcagaagacgaatgctcgcatccgcaaatgaagctcagaaagggaaccaattagtactctctaaccacctggtaagtctactctatcatgcgaaaaattgcgaagcctccgacggaaaatcactaaagtatatagaagcacatcgagaagcgttctcagaactactcgcacaagttagcgaatttgcaactcgatacacactagcagatgcaaacttaagcaaaattaataacttattcgaacaaaacaaagaaggcgacataaaggcgatagcccaatcatttgttgatctaatggtcttcaatgcaatgggcgctccagcgtcctttaaatttttcgaggcaaccatagataggaaaagatacacaaatctaaaagaattactatcatcgaccataatttaccaatcgatcactggactatatgagtcaagaaaaaggctcgacgactga

SEQ ID NO: 5278 - RNA, 4005 nt, synthetic construct
  misc_feature 1..4005: note = Cas9 variant
  source 1..4005: mol_type = other RNA
atgaaaaatccatacacaataggattagatataggtacaaatagcgtaggatgggctgtactaacggaccaatatgacctggtaaaacggaaaatgaaagtagcaggaaacagtgacaagaagcaaataaaaaaaaacttttggggggtacgtttatttgatgaaggcgagacagcggctgatagacgaatgaaccgtactgcaagacgacgcattgaacgacgacgaaatagaatatcatacttacaagaaatatttgcactagagatggcaaacatcgatgcaaactttttctgtcgattgaacgacagtttttatgttgactcagaaaagagaaactctagacatccattttttgccacaatagaagaggaagtagcctaccacaaaaactacagaacaatctaccatttacgagaggagctagtaaactcgagtgaaaaagcagacctccgtttagtgtacttagctctcgcacatataataaaatatagaggtaatttcttaatagagggagcactagatactaaaaacacaagcgttgacggagtatataaacaattcattcagacctacaaccaagtattcatatcaaatatagaagagggaacattagcaaagatggaagagaacactacagtagctaacatactcgccgggaaattcacgagaaaagagaaattggaaagaatactacaattgtaccccggagaaaaatccacaggcatgttcgcacagtttatctcactaatagtcggttcaaaagggaattttcaaaaagtattcgatcttgtagaaaaaacagatattgaatgcgctaaagacagttatgaagaagatctagaagcactactagcaataataggcgatgagtatgctgaattattcgtagccgcaaaaaatacttacaatgcggtagtactaagttcaataataacagtaacagatacagaaactaatgcgaaactttcagcatcaatgatcgaaagattcgacgcccacgaaaaagacctaagtgaattaaaagccttcataaaattacacttaccaaaacaatacgaagaaatattttcgaacgtagcaatagacggatatgctggctacatagacggaaaaaccaaacaagtagacttctacaaatatttaaaaacattactagaaaacatagaaggagcggattactttatagcaaaaattgaagaagaaaattttctcaggaaacaacgtacattcgacaacggtgcaatcccccatcagttacacttggaagaactagaagcaatactccatcaacaagcgaagtactacccattcctgaaagaagcttatgataaaataaaatcactagtaacattcagaatcccatattttgtagggcctctcgcaaacgggcaatctgactttgcatggcttaccagaaaagcggatggagagatacgcccatggaacatagaagaaaaagtagatttcggaaaaagcgctgtcgacttcattgaaaagatgacgaacaaagacacctaccttcctaaggaaaatgtgttacccaaacacagtttatattatcaaaaatatatggtatataacgaactaacgaaagttagatatatagatgaccaaggtaaaaccaactatttttcaggacaagaaaaacaacaaatctttaatgactatttcaagcaaaaacgtaaagtatcaaaaaaagacttagaacaattcttaagaaacatgtcgcatatagaaagcccaacaatcgaagggctagaagattcatttaattcttcatatgcgacatatcatgatttattaaaagtcggaatcaaacaagaagtacttgaaaacccccttaacatggaaatgttagaagatatagtcaagatactaacagtcttcgaggacaaaagaatgattaaagaacaattacaacaattttccggagtcctagacggcgcagtattaaaaaaactagaaagacgacactacacaggatggggaaggttatcagccaaactattagtaggaatacgggataaacaatcccatctaactatactagattatttaatgaacgatgatggattgaacagaaacctaatgcaattaatcaacgacagcaacttgagctttaaatcaataatagaaaaagagcaagttagcaccacagacaaagacctacagagcatagtagcagacttagccggaagcccagcaataaaaaaaggcatacttcaaagtctaaaaatagtagacgaactagtaagtataatggggtaccccccacagacgatagtcgtggaaatggcaagagaaaaccaaacaaccgttaaaggaaaaaataactcaagaccaagatataaaagccttgaaaaagcgataaaagaatttggatcccaaatcctaaaagagcacccaacagataaccaggaactccgaaataatagattatacctatactatctacagaatggcaaggacatgtatacaggtcaggaattagatatacataacctgagtaactacgacatagaccatatcgtcccgcaatcatttataacagacaactccatagataacctcgtattaacaagttcagccggtaatcgagaaaaaggagatgacgtaccaccactagaaatagtccgaaaacgaaaagttttctgggaaaaactttttcaggggaatcttatgtcaaaacgaaaattcgattacctgaccaaagcagaacgaggcgggctaacagaagcagacaaagcgacgttcatacatagacaacttgtcgagacccgacagataacaaaaaacgtggcaaatatattacaccagaggtttaacaacgaaactgacaaccacggaaataacatggagcaagtaagaatagtaatgcttaaaagcgcattggtgtcgcaattcagaaaacaatttcaattatataaagtaagagaggtaaacgactatcaccatgcacacgacgcttatttaaatggagttgtggcaaatactttactcaaagtctacccacaacttgaaccagaatttgtctacggagaataccatcaattcgactggttcaaagcaaacaaagcgacggccaagaaacaattctacacaaatatcatgctcttttttgcccaaaaagaaagaataatcgatgaaaatggagaaattctctgggataagaaatacttagaaactatcaaaaaagtattagactatagacaaatgaatatagttaaaaaaaccgaaattcaaaaaggggaattctcaaaagcaacaattaaaccgaaaggtaactcatcaaaacttataccaaggaaagagaattgggatccaatgaaatatggaggactagactctccaaatatggcatacgcggtcataatagaacatgccaagggtaaaaaaaaaatagtttttgaaaaaaagataataagaattacaataatggaacgaaaagcattcgaaaaggatgaaaaatcattccttgaaaaacaaggatatagacaaccaaaagtactaaccaaactaccaaaatatacactatatgaatgcgaaaatggtcgacgaagaatgctagcatcagccaacgaagcccaaaagggaaatcaacaagtattaaagggacaacttataacactgctacatcacgcaaaaaactgtgaagcctcggacggaaaatcgctcgattatatagaaagtaatagagaaatgtttggtgagcttctagcccacgtatcagaatttgctaaacgatatactctagcagatgcaaatctctcaaaaatcaatcagctcttcgaacagaataaagataatgacatcaaagttatagctcaatcttttgtaaacttaatggcgtttaatgcaatgggggcaccagcaagcttcaaatttttcgaggcaaccatcgagagaaaacgatatacgaacttaaaagaactattgcgagctactatcatatatcagagcataactggactctatgaagcacgaaaaagactagatggatga

SEQ ID NO: 5279 - RNA, 4005 nt, synthetic construct
  misc_feature 1..4005: note = Cas9 variant
  source 1..4005: mol_type = other RNA
atgaaaaatccttataccataggactagacatagggactaattccgtaggttgggcagtattgactgatcagtacgacttagtaaagcgcaaaatgaaggttgcaggcaatagcgataagaaacaaattaagaaaaacttttggggagtccgcctattcgacgaaggtgagacagcagcagacaggcgtatgaatagaacagcaagacgccgcattgaaagaagaaggaataggatctcatacctacaagaaattttcgcccttgaaatggctaatatagacgcgaatttcttttgcagattgaatgacagcttttatgtagattctgagaaaagaaattccagacacccatttttcgcaaccattgaagaagaagtagcataccataaaaactataggactatctatcaccttagagaagaattagttaacagtagtgagaaagccgacctaagattagtctatctagcactagcacatattataaaatacagaggaaactttttgatagaaggagcattagataccaaaaataccagtgtggacggtgtatataaacaatttatccaaacttataatcaagttttcatatcaaatatagaggaagggactctagcaaaaatggaagaaaatactactgtagcagacatactagcaggaaaattcactagaaaagaaaaattagaaagaatacttcaattatacccgggggaaaaatcaacaggaatgtttgcgcaattcataagtctaatagtaggaagtaaaggaaattttcagaaagtttttgatctagtagagaaaactgacatagaatgcgctaaagactcatatgaggaggacctagaagctctcttagccataataggagacgaatacgcagaattattcgtagcagctaaaaacacatacaatgcagtagtcctttcctccataataacagtaacagacaccgaaacaaatgcaaaactttctgcaagtatgatagaaagattcgacgcacatgagaaagatcttagtgaattaaaagcgtttataaaattacatctaccgaaacaatacgaagaaatattctctaatgtagccatagacggatatgcaggatatatcgacggaaaaacaaaacaagtagacttttataaataccttaaaaccttgctagaaaacatagaaggagcagactacttcatagcaaaaatagaagaggaaaacttcttacgaaaacaacggacattcgacaacggagcaataccccaccaactccatttagaggaacttgaagctatactacaccaacaagctaaatactacccctttcttaaagaagcatacgacaaaataaagagcttggtaacgttcaggattccttatttcgtaggaccgcttgcaaacggccaatcagattttgcatggctaaccagaaaagcagacggagaaataagaccttggaacatagaagaaaaagtagactttggtaaatctgcagtagactttatagagaaaatgaccaataaagacacatatctgcccaaggaaaatgtattacccaagcattcattgtactatcaaaagtatatggtctacaacgaattgacaaaagtacgctacatagatgatcaaggaaaaacaaactacttttccgggcaagaaaaacaacaaatatttaacgactacttcaaacagaaaagaaaagtatcaaagaaagaccttgaacaattcctcagaaacatgagtcacatagaatcacccacgatagaaggactagaagatagttttaactcttcatatgcaacatatcatgatcttctcaaagtcggcataaaacaagaagttctagaaaacccactaaacacagaaatgctagaagacatagttaaaatactaactgttttcgaagacaaaagaatgataaaagaacaactacaacagttttcagacgtcttggacggtgctgtcctcaagaaattggaacgccggcactacacaggatggggacgattgtcagcaaaactattagtaggtatcagagataaacaatcacatttaactattctagattacctaatgaacgatgatggcctaaaccgcaacttaatgcaacttattaatgattcaaacctatcattcaaaagcataatagaaaaagaacaagtatcaactacagacaaagatctacaaagtatagtagcagatctagcagggagcccagcaatcaagaaaggaatcttacaatctttaaaaatagtagatgaacttgtatcaattatgggatatcccccgcaaactattgtggtagaaatggcgcgcgaaaaccaaacaactgtaaaaggtaaaaacaactctcgacctagatacaagagcttagaaaaagcaatcaaagagttcggcagccaaatacttaaagaacaccctacagacaaccaggaattacgcaacaaccgcctatacctctattacttacaaaatggaaaagacatgtatacaggccaggaactcgatattcataatctatcaaattacgacatcgatcacatcgtaccccaaagttttatcactgacaattcaatagacaaccttgtcctaacaagtagcgctggaaacagagaaaaaggagatgatgttccacctttagaaatagtaaggaaacgaaaagtcttctgggaaaaattattccagggaaatttaatgagtaagagaaagttcgactatttaacaaaagctgaacgaggcggattaacagaagcagacaaagctacctttatccaccgacagctagtcgagactcgtcaaataaccaaaaacgtcgcaaacatactccatcaacgattcaacaacgagacggataatcatggtaacaacatggaacaagtaagaatagtgatgctaaaatctgctctagtttcgcaattccgaaaacaattccaattgtataaagttagagaagtaaacgactaccatcacgctcatgatgcataccttaacggagttgtcgcaaacaccctactgaaagtatatccacaattggaaccggagtttgtttacggagaatatcatcaattcgattggtttaaagcaaataaagctacagctaaaaagcaattctatacaaacataatgcttttcttcgcacagaaagaaagaataatagatgagaatggcgaaatattatgggacaagaaatacttagaaactataaagaaagtcttagattacagacaaatgaacatcgtaaagaaaacagagatccagaaaggtgaatttagcaaagcaacaattaaaccaaaaggcaactcaagtaaattgataccaagaaaagaaaactgggatccgatgaaatatggcggactcgattctccaaacatggcatacgcagtcataatagaacacgccaaaggcaaaaagaaagtggtatttgagaagaaaataataagaataacgatcatggagagaaaagcatttgaaaaagatgaaaagagcttcctagagaaacaaggatacagacaaccaaaagttcttacaaaactcccaaaatacacactatatgaatgcgaaaacggacgacgacgaatgctggcatcagcaaatgaagcacaaaaaggaaatcaacaagttttaaaaggccaactaataacactcctacaccacgccaaaaattgtgaagcatcagacgggaaatcattagactacatagaaagtaaccgcgaaatgttcggagaactgctagcacatgtctcagaatttgcaaaaagatacacactcgccgacgcaaacttaagtaagataaaccaattgtttgagcaaaataaagacaacgatataaaagtaattgcacaaagtttcgtcaacctaatggcatttaacgccatgggagcaccggcctcattcaaatttttcgaagctaccattgaaagaaaaagatacacaaatcttaaagaactattaagtgcaacgattatatatcaaagcattactggcttatatgaagcaagaaaaagactcgatggatga

SEQ ID NO: 5280 - RNA, 4005 nt, synthetic construct
  misc_feature 1..4005: note = Cas9 variant
  source 1..4005: mol_type = other RNA
atgaaaaacccatacactatcggactagacataggtaccaattccgttggatgggcagtattaaccaaccaatatgacttggtcaaaagaaaaatgaaagtagctggtaattcggacaagaaacaaataaagaaaaacttttggggagttcgcctgtttgatgatggtcaaacggcagtcgaccgtagaatgaacagaacagcgagaagaagaatcgaaagaagaaggaacagaatatcctatctacaggaaatctttgctgtagaaatggccaacattgacgcgaacttcttttgcaggcttaacgactcattctatgttgattcagagaaaagaaatagccgacacccgttctttgcaaccatagaagaagaagtagcataccatgacaactatcgaacaatataccatttacgcgaagaactcgtaaacagctctgaaaaagcagacctaaggctcgtctacttggcactagcgcatatcataaaatacaggggcaactttttgattgaaggggctctggacacgaaaaatacaagtgtcgacgaagtatataaacaatttatacaaacatacaaccaagtcttcatgtcaaacatagaagaaggggccctagctaaagttgaagaaaacttagaagtggcaagcattctagcaggtaaatttacacgacgagaaaaatttgaaaggattcttagactatacccaggagaaaaatctactggaatgttcgcacaatttataagtctcattgtaggaaacaaaggaaattttcaaaaagtgtttaacctcgtagagaaaacagacatagaatgcgcaaaagattcctacgaagaagatttagaagccttattggcaataatcggcgacgaatatgccgaattattcgtagccgcgaaaaatacatacaacgcagtagtcctctcgagcataatcacagtaacggctaccgaaacaaatgcaaaattatcagcctctatgatagaaagattcgacgcacacgaaaaagacctaggggaacttaaggctttcatcaaactccatctaccaaaacaatatcaagaaatattcaataacgctgcgatagacggatacgcaggatatatagacggcaaaacaaaacaagtggatttttataaatatttaaaaacaacactagaaaacgtagaaggagcggattactttattacgaaaatcgaagaagaaaacttcttaagaaaacaaagaacctttgacaacggagttatcccacatcagttacatctagaagaattagaagcaatattacatcaacaagcaaaatattatcccttccttcgcgaagactatgaaaagattaaatcattagtaacgtttagaataccctatttcgtaggacctttagctaaaggccaatctgagttcgcatggttgaccaggaaagccgatggcgaaataagaccgtggaatatagaagaaaaagtagacttcggaaaatccgccgttgacttcattgagaaaatgacaaataaagatacatatttaccaaaagaaaacgtattaccaaaacactctttatgttaccaaaaatacatggtatacaatgaactaacaaaagtgcgttatatagacgaccaaggcaaaacaaattattttagtgggcaagaaaagcaacaaatattcaacgatttatttaaacaaaaacgaaaagttaaaaagaaagatttagagctattcctaagaaatattaaccacatagaatccccaaccattgaaggactcgaagactcattcaatgcgtcatacgctacataccacgacctacttaaagtaggtatgaaacaagaatcactagatagcccactcaatgccgaaatgttagaagatatagtaaaaattttaacagtattcgaagacaaaagaatgataaaagaacagctccaacaatttagtgatgtcctagacggcgtagtgttgaaaaagctagaacgaagacattatacagggtggggccgactatctgcaaagctattagtaggcataagggataaacagtcacatttaaccatactagactacctcatgaacgatgacggattaaaccgaaacttgatgcaactcataaatgattcaaacctaagttttaaaagtatcatcgaaaaggaacaggtcagtacaaccgacaaagatttacaatctattgtagcggatctagcaggaagccctgccattaaaaagggaatattacagagcttaaaaatagtcgatgaattagtttcaataatgggctatcctccccaaacaatcgtagttgaaatggcacgagaaaatcagaccacagtaaaaggcaaaaataactcaagacccagatacaaaagcctagaaaaggcaataaaagagttcggatcacagatcctaaaagaacatccaactgataatcaggaacttaaaaacaaccggttatacctttattacttacaaaatggaaaagacatatatacaggacaagaattagatatacacaatctctccaactacgacatcgaccacatagttcctcaatcattcataacagataattcgatcgacaatctagtgctaacatcatcagcaggaaatcgtgaaaaaggcggggatgtcccaccacttgaaatagtacggaagagaaaggtcttctgggagaaactgtaccaaggaaacttaatgagtaaaagaaaatttgactacttaacaaaagcagaaagaggtggactaactgacgcagacaaagcccgatttatacatcgacaacttgtagaaacacgacaaataaccaaaaatgtcacaaatatactacaccaaagatttaataacgaaacagataattacggcaacactatggagcaagtgagaattgtgaccctaaaaagcgccttagtaagccaatttcggaaacaatttcaactctacaaagttcgagaagtgaacgattaccatcatgcccatgacgcctatctaaatggtgtagttgctaatacattattgaaagtatacccgcaactagaaccagaatttgtttatggagaatatcaccaatttgattggtttaaagctaacaaagcaaccgcaaagaaacaattttacacaaatataatgttattcttcgcacaaaaagagagaataattgacgaaaatggcgaaattttgtgggataagaaatacctagaaactattaagaaagtattagactacagacaaatgaacatagttaagaaaactgaaatacaaaaaggagagttcagtaaagcaacaattaaaccgaaaggaaacagtagcaaactaataccaagaaaagaaaactgggatcccatgaaatacgggggattggactcaccaaacatggcttatgccgtcataatagaacacgcaaaaggcaaaaagaaaatagttatagaaaagaaattaatccaaataaacataatggaaaggaaaatgttcgaaaaagacgaagaagcatttcttgaagaaaaaggctacagacatcctaaagtattaaccaaattaccaaaatacacattgtacgaatgtgaaaaaggacgcagacgcatgctagcatccgcaaacgaagcacaaaaaggaaatcaactcgtactatcaaaccatctagtgagtttactctaccacgcgaaaaactgcgaagcctctgacggtaaatctcttaaatacatagaagcccaccgggaagcattttccgaattattagcacaagtaagtgagttcgcaacaagatataccctagcagatgctaacctatcaaaaattaacaaccttttcgaacaaaacaaagaaggtgacataaaagccattgcacagtcttttgtcgatctaatggtgttcaacgctatgggagctccagcctcgttcaaattctttgaagcgactattgatcgaaaaaggtatacaaacctaaaagaactactatcaagtacaataatatatcaatccatcacaggcctttatgaatcaaggaaaaggctagatgattga

SEQ ID NO: 5281 - RNA, 4005 nt, synthetic construct
  misc_feature 1..4005: note = Cas9 variant
  source 1..4005: mol_type = other RNA
atgaaaaaggaatatacaattggattagatataggaacaaacagtgtggggtgggcagtccttaccgaaaactatgacttagtaaaaaaaaagatgaaagtatacggcaacacggaaaccaaataccttaaaaaaaatttatggggagtacgtctattcgatgaaggagaaacggcagcagatcgccgtcttaaacgaacaacaagaaggagatacagtcgaaggcgaaaccgaatatgcagactacaagacttatttactgaagaaatgaatcaagtggatgcaaactttttccatcggctgcaagaaagttttttagtcccagacgaaaaggaattcgaacgacacgccatctttggtaaaatggaagaagaagtatcttattatcgtgaatttcccaccatttaccaccttcgaaaacacttagcagacacttcagaacaagcagatttaagattagtctacttagccttagctcatattgttaaatataggggccatttccttatagaaggagaactaaatacggaaaattcttctgtgtcagaaacatttcgaacatttattcaggtatataaccagatcttcagagaaaacgaagtcccactagcagtcccagacaatatagaagagttattctcagaaaaagttagtcgcgcaagaaaagttgaggcaatactatcagtctacagtgaagaaaaaagtacgggaacgctcgcacaattcttgaaattaatggtaggaaatcaaggaagattcaagaaaacatttgacttagaggaggatggcatcatacaaatacccaaagaggaatatgaagaagaactagaaactttgctcgctatcattggtgacgaatacgcagaaatcttctcagctacgaaatccgtttacgatgccgtagctttatccggaattctgtcagtgaccgatggagataccaaagccaaactatcagcttcaatggtagaacgatacgaagctcaccagaaagatctagtacaattcaaacaattcataagaaaagaactccctgaaatgtatgcccccatattcagagataactcagtaagtggatacgcaggatatgtagaaaatagcaaagtagttacacaagcagaattttacaaatacataaagaaagcaatagaaaaggtcccaggtgcagaatactttttagaaaaaattgaacaagaaacctttttagataaacaacgtacatttaacaatggcgtgataccacatcaaatccatttagaagaactagaagcaattattcaaaagcaagccacttattacccattcctcgcagacaacaaagaagagatgaaacaactcgtaacctttaggataccctactatgtaggaccccttgcagatgggaattctccgtttgcttggctagaaagaattagctccgaaccaatacgcccaggaaatctagcagaagtcgttgatattaaaaaatccgctacaaaatttattgaaagaatgactaacttcgacacgtatctcccaacagaaaaagttttacccaaacactcaatgatttacgaaaaatatatggtatacaatgaattaacaaaggtatcatacgtagatgaacggggaatgaaccaacgcttttcgggagaagaaaaaaagcaaatagtagaagagttatttaaacaatctagaaaagtaacaaaaaaactattagaaaaattcctgtcaaatgagttcggactagtcgatgtcgctataaaaggcattgagacatctttcaatgcaggatacggaacataccacgactttctaaagataggtatcaccagagaacaacttgataaagaggaaaatagtgaaacactagaggaaatcgttaaaattttaactgttttcgaagaccgaaaaatgatacgagaacaacttaaaaaatacacgtatctcttcgatgaggaagtactaaaaaaactagagcgacgacactatacgggatggggtagactaagcgcaaaattactaattggaatcaaagaaaaacgaacccataaaacaatcctagactatctgatagaagacgacggcggcaaacaaccaatcaaccgtaatctcatgcaattaataaacgactctgatttatcatttaaaagtgaaatagctgaagcacaatctgacatgaatacagaagaccttcacgaagtagtacaaaacttagccggttctccagctataaaaaaaggcatacttcaaagtctaaagatagtcgacgaattagtggatatcatgggatcacttcctaaaaacatagtagtagaaatggcaagagaaaaccaaactacaagccgaggacgtaccaactcaaatcccagaatgaaagcactagaagaggcaatgagaaacttaagaagcaatctactaaaagaatacccgacggataaccaagctctacaaaatgatcgattatacctatactacttacaaaacggaaaagacatgtatactggtctagacctatctctacacaatttatcaagttacgatatagatcacatcgtaccacaaagtttcacaacggacaactcactcgacaatcgcgttcttgtttcatccaaagaaaatcgcggaaaaaaagacgatgtcccaagtaaagaagtggtacaaaaaaatataactctttgggaaacactaaaaaattcgaacctaatctcacagaaaaagtatgacaatctgaccaaaggactaaggggaggattaactgaagacgacagagctcattttataaaaagacaactagtagaaacaagacaaatcactaagcacgtagcaagaatattggatcaacgatttaacagtcaaaaagacgaagaaggaaaaacaatcagagcagtccgagtcgtaaccttaaaaagctcacttacaagtcaattccgtaaacaatttgcaatacataaagtcagagaaataaatgactatcatcatggtcatgacgcgtacctcaacggtgtagtagctaacagtctactacgagtatacccgcaactccaaccagaattcgtttacggagattacccaaagtttaatgcctacaaagcaaataaggccacagcaaaaaaacaattatataccaatatcatgaaattctttgcagaggacgcagtaataatagatgaaaacggagagatcttatgggataaaaagaatattgcaacagtaaaaaaagtaatgtcctaccctcagatgaatatcgtaaaaaaacccgaaatccaaacaggatcttttagcaaggaaacaattaaacctaagggagattctgacaaactcatatcaagaaaaaccaactggtcgcctaaactatacggaggatttgattcaccccaagtagcatactcagtaataataacatacgaaaaaggtaaaaaaaaagtacgtgcgaaagcaatagtaggcattacaatcatggaacaatcattattcaagaaagatccagtatcattattagaagaaaagggatacgcaaaccctgaagtattaattcacctgccaaaatacaccttatatgagctcgaaaacggacgtcgtagactactagccagcgcgaacgaagcacaaaaaggcaatcaactagtcctaccagcgtctctggtaacactactgtaccacgcgaaacaagtagacgaagacagtggaaagtcagaagaatacgtacgagaacaccgtgcagaattcgccgaaatactaaactatgtccaagcatttagcgaaaccaaaatactagccaacaaaaatctccaaaccatcctaaaactttatgaagagaacaaggaagctgacatcaaagaaattgccgagagttttgttaaccttatgaaattttcagcatacggagcaccaatggatttcaaattctttggaaaaacgattccgagatccagatacacttcggtaggcgaactcttatctgctacaataatcaatcaaagtataacaggtctttacgaaacgagacgtaaactagtagattga

SEQ ID NO: 5282 - RNA, 4005 nt, synthetic construct
  misc_feature 1..4005: note = Cas9 variant
  source 1..4005: mol_type = other RNA
atgcgtaaaccatacaccataggactagacatcggaacaaacagcgtaggctgggcagttttgacagatcagtacaacttggtaaaaagaaaaatgaaagttgcaggttcagccgaaaagaaacaaatcaaaaaaaacttctggggagtaagactctttgatgaaggagaagtggcagcaggacgacgaatgaataggaccacaagacggagaatcgaaaggcgacgaaaccgaatcgcctacctacaagaaatatttgccgcagaaatggccgaagtagacgcaaactttttttacagattagaagattccttctatatagaatcagaaaaacgacattcaagacacccattctttgcaacgatagaagaagaagtagcctaccacgaagaatacaaaacaatttatcacctacgagaaaaattagtaaattcgagcgacaaagcggacttaagattagtatacttggcgttggcacacataataaaatatagaggaaattttctaatagagggaatgctagacaccaaaaacacaagtgtagatgaagtattcaaacagtttatacaaacatataaccaaatattcgctagtgacatagaggaaggatcattaaccagacttgaagaaaacaaagaagtagccgaaatactatctgagaaattaacgagaagagagaaacttgataagatactaaaactgtacaccggtgaaaaatcaacaggaatgtttgcaaggttcattaatttaataattggctctaaaggagactttaaaaaagttttcgatttagacgaaaaagcagagattgaatgcgctaaagatacatacgaagaagatttagaagcattactcgcaaagataggagacgaatatgctgaaatttttgtcgctgcaaaatcaacatataacgcagtagtactttcaaacatcataaccgttacagacactgaaacaaaagcaaaattaagcgcatccatgatagaacgtttcgacaaacacgctaaagatcttaagagattaaaagcgttctttaagatgcaactacccgaaaaatttaatgaagtgtttaacgacattgaaaaagacggctatgccggatacatagacggaaaaacgacgcaagaaaaattctataaatacatgaaaaaaatgttagcaaacatagacggagctgactatttcattgaccaaatagaagaggaaaatttcttacgaaaacaaagaacatttgataacggcactataccacaccaactacatctggaagaattagaagctatcctacaccaacaagccaaatactatccgtttctaagaaaagattacgaaaaaataagatcactcgtaacattcagaataccatacttcataggtccattagcaaatggacaaagcgactttgcatggttgacaagaaaagcagacggagaaatcagaccatggaatatagaagaaaaagtagactttggaaaatcagcaatcgactttatagaaaaaatgacaaataaagacacatatctaccaaaagaaaacgtgttaccaaaacattcactatgctatcaaaagtatatggtttataacgaattaactaaaatcaggtatatcgatgaccaaggaaaaacacaccatttctcagggcaagaaaaacaacaaatttttaatgggttatttaaacaacaacgtaaagtaaaaaaaaaggatttagagcgattcttgtatacaatcaatcatatcgaaagtcctacgatagaaggcgtcgaagacgcgtttaactcctcattcgctacctatcacgacctacaaaagggtggagtgacccaagaaatattagacaatcccctaaacgctgatatgctggaagaaatagtcaaaatattaaccgtattcgaagacaaacgcatgattaaagaacaattacaatctttctctgacgttcttgacggaactatcctgaaaaaactagagcggcgtcattataccggctggggacgcttaagcgctaaactcctaacaggcataagagacaagcatagccatctaacaatcttagactatctaatgaacgacgatggcttaaatagaaatttaatgcaactcataaatgattctaacttatcctttaaatctatcatcgaaaaagagcaagtatctaccgcagacaaaggcattcaaagtatagtcgctgaactagctggatccccagcaataaaaaaaggaatacttcaatccctaaaaatagttgatgaattagtaggaataatgggctatccaccacaaactatagtagtagagatggcccgagaaaaccaaactacagggaaaggcaagaataatagcaagccacgatttatctcattagaaaaagcaataaaagaatttggctcacaaatccttaaagaacaccccaccgacaatcaatgcttaaaaaatgatagattgtacttatactatctacaaaatggtaaagacatgtacacagggaaagagctagatatccacaacttgtcaaattatgacatcgaccatataataccacaaagcttcataactgataactccatagacaacagagttcttgtttcatcaacagcaaatagagaaaaaggagataatgtgccgctactagaagtggtaagaaaaagaaaagccttctgggaaaaattatatcaagccaaactaatgtccaaacggaaattcgactacctaacaaaggcagaacgcgggggtttaaccgaagcagacaaagcaaattttattcaaaggcaactagtggaaactagacaaataactaaaaacgttgccaatatactataccaaagattcaattgcaaacaagacgaaaacggaaacgaagtcgaacaagttaggattgtcaccctaaaatcaacactggtatcacaatttagaaaacagttccaactatataaagtaagagaagtaaacgactatcatcatgcacacgatgcataccttaatggggttgtagcaaatacactcttaaaggtttatccacaactagaaccagaattcgtatacggcgattatcatcaattcgactggttcaaagcaaataaagctactgcaaaaaaacaattttacacgaatatcatgagattcttcgccaaagagaatcaaataatcgataaaaatggagagatactatgggacaacagatatctagatacaattaaaaaggtattatcatacagacaaatgaatatcgtaaaaaaaacggaaattcaaaaaggagaattttccaatgcaactgtaaatcccaaaggcaactcaagcaaactaataagcagaaaagctgactggaacccaataaaatatgggggatttgacggatctaacatggcatactccatagttatagaatatgagaaacgaaaaaaaaaaacagtaataaaaaaagaactcatccaaataaacattatggaaagggttgcttttgaaaaagaccaaaaagcgtttctagaagaaaaaggatattattcgccaaaagttctaacaaaaattcccaaatacactctctatgaatgtgaaaacgggcgacgaaggatgttaggtagtgctaatgaagctcagaaaggtaatcagatggtgctaccaaatcatctgatgacacttttatatcacgcaaaaaattgcgaagcaaatgatggagaatcactagcctacattgaaatgcatcgtgaaatgtttgcagaacttttggcatatatttcagaattcgcaaaacgatatacattagccaatgacagattggaaaaaataaatatgttttttgaacaaaacaaaaagggcgatattaaagtcattgctaaatcattcgataaacttaaagtattcaacgcatttggcgcacctcgcgactttgaattttttgaaacaacgatcaaacgaaaaagatattataacatcaaagaacttctaaatgccacgatcatctaccaaagcataacaggactgtatgaagctagaaaaagactagaagattga

SEQ ID NO: 5283 - RNA, 4008 nt, synthetic construct
  misc_feature 1..4008: note = Cas9 variant
  source 1..4008: mol_type = other RNA
atgaaaaactatacgataggcttagatataggaacaaacagcgtgggctgggctgtaataaaagatgatctaacactggtaaggaagaaaatcaaaatatcaggtaacacagataagaaagaagtaaagaaaaatttatggggcagcttcctattcgaacaaggagatacggcacaagatacgagagtcaaacgaatcgcaagaagaagatatgaaagacgacgattccgaataagagaactgcagaaaatctttgataaatcaatgggtgaagtggacagtaactttttccatagattagacgaatcattcttggtggaagaagataaagaatattctaaatacccaatcttctctaatgaaaaagaagacaaaaattattatgataaatacccgacgatctaccacttaagaaaagatttagccgattcaaatcaaaaagcggatctccgactaatatacctggcattagcacatatgataaaatatcgcggacacttcttaattgaaggcgacttaaaaatggacggaatctccattagtgagagctttcaagagttcatagacagttataacgaagtttgcgccttagaagatgaaaatctagaaataatctacaatgatgaactattaacacaaatcgaaaacatatttaaacaagacatcagtcgatcaaagaaactagatcaagctatagcgctttttcaaggagtaaaaaggcaaagcctatttggtatatttctaacacttatcgtcggaaacaaagcaaacttccagaaaattttcaatctagaagacgatataaaacttgatctaaaagaagaagattatgacgaaaacttagaggaactactatcaaacatagatgaaggataccgagatgtcttcttacaagctaaaaacgtatacaatgcaatagaattaagcaaaatactaaaaactgacggaaaagaaacaaaagcaccgttatcagcacaaatggtcgaactatacaaccaacaccgcgaagatttaaagaaatataaagattatattaaggcttacctacccgaaaaatacggagaaacatttaaagatgccactaaaaatggatatgcaggttacatagatggtaaaacatcacaagaagatttttacaaattcgtaaaagcacaactaaaaggtgaagaaaacggagaatacttcctagaagctatcgaaaatgaaaattttctacgcaaacaaagatcattttacaacggagttataccatatcaaatacatctacaagaactaacagctgtcttagaccaacaagaaaaacattattcctttcttaaagaaaacagagacaaaatcatctcattattgacattcagaatcccatactacgtcggtcctcttgcaaaaggcgaatcaagattcgcctggctagaaagatcaaattccgaagaaaagataaaaccatggaacttcgacaaaatcgtagacatagataaatcagcagaactcttcatagaaaatcttacatctcgagatacatatcttccggatgaacccgtacttccaaaacgcagtctcatatatcaaaaattcacgatttttaacgaactaactaaaatatcatacattgacgaaagaggaatacttcaaaactttagcagtagagaaaagatagcaatttttaacgacctattcaaaaacaaaagcaaagtaactaaaaaccaattagttaaatacattgaaaataaagaacagataatagccccagaaatcaaaggaatagaagattcattcaatagtaactattcaacatacatagacttatcaaaaataccagatatgaagaaacttttggaaaaagatgaagacgaaatcctcgaagaaataataaaaatactaaccatattcgaagatagaaaaatgcgaaaaagacaactcatgaaatttaaagacaaactttctgagaaagcaataaatcaactctcgaagaaacactatacaggctggggacaattatccgagaaattaattaatggaataagggacgaacaatcaaataaaacgatattagattacctgatagaagataacggctgccctaaaaatatgaatcgaaactttatgcaactaattaatgatgacaccctatcattcaaagagaaaatcagaaaagcacaagacataaatcaggtaaacgatatcaaagaaatagtaaaagacctcccaggatcaccagccatcaagaaaggaatataccaatcaatccgaatagtggatgaaataattagaaaaatgaaagatcgccccaaaaatatcgtcatcgaaatggcacgagaaaaccaaactacacaggaaggcaaaaataaaagtaaagcaagattaaagaaaatacaagaaggattagaaaatctagattctgtgcacgtagagaaacaagccctagacgaagaaatgcttaaatcaccaaaatactacttatactgtctacaaaatggaaaagacatatacacaggaaaagacctagacataggacaactacaaacatatgatatagaccatataattccacgtagcttcattacagacaactcattcgataacttagtactaacttcaagtacagttaacagaggaaaacttgataacgttccgagccctgatatcgtcaggcaacaaaaaggattctggaaacaactactcagagccggacttatgtcacaacggaaattcaataacctaacaaaaggcaaactaaccgacagagacagacaacagttcatcaatagacaacttgtagaaactagacaaatcacaaaacatgtagctaacttactaagccatcatcttaatgaaaagaaagaagtcggagaaattaacatcgtcctattaaaatctgcactaacgagtcagtttcgaaagaaattcgatttttataaagtgagagaagtgaatgactaccatcacgctcacgacgcatatctaaacggagttatagcattaaaattattagaactatatccatatatggccaaagacctcatatacggaaaatacagctaccataggaaaatagaaggagacaaagcaacacaagccaaatataaaatgtcgaatataatcgagcgattttcccaagacctcttggccaatccagacggcgaaatagcatgggagaaagacaaggatttaaatacaatcagaaaggtactaagcagcaaacaaatcaatattataaagaaagcagaagaaggcaaaggaaggctattcaaagaaacaataaactcaagaccatcaaagaaaactgagaaaaggataccaattaaaaacaatctcgatccaaacatatacggcggatatatagaagagaaaatggcatattacatagcaataaattacctcgaaaacggaaaaactaagaaagccatagtaggcatatccattaaagacaagaaagacttcgaagggcaaacgaccgaatatctcgggaaaattggattcaacaaagccagcatcataaactcattcaaaaattatacacttttcgaactagaaaatgggtctcgcagaatgatcgttggcgctagcaaagaaaacgactcgaaaggagaattacaaaaagggaatcaaatgtaccttcctcaaaatctattggaatttgtttaccatctaaaacactacaacgaagacgaaacatcacacaaattcattgttgaacacaaagcctatttcgacgaactcttaaactatatagttgagttcgcaaacaaatacttagaactagaaaactcaattgagaaaatcaaagacctctatcacggaaaaggtccagacgtggaagaaaaagaactcgttgaatcatttataaacctactagctattacaaaatgcggacccgctgcggacataacatttcttggagagaaaatctcacgaaaaagatatcgatccacaaactgtctatggggcagcgaggtaatatttcaaagccccacagggctatacgaaactaggttaagactcgagtga

SEQ ID NO: 5284 - RNA, 4011 nt, synthetic construct
  misc_feature 1..4011: note = Cas9 variant
  source 1..4011: mol_type = other RNA
atggacgacaactaccagcttatgcatgctaaaggcaaatacggatatggcacacgcatatattccgaaggtcaaacagcggccgatagaaggggattccgaacaacacgaagaagactaaaccgtagaaaatggcgcttaagattacttcaggactttttcgaaccatatatcctaccacaagacgaagcattctttataagacaaaaacaatccaatctagtaccacaagatactaagaaacaatatcccgaaagcgtactctttgatgatacgtcagataaagatttttatacagaatatcccacaatatatcatctaagacaggctttgatgacagaaaaccgccaatttgacatcagagaagtctacttagcaattcatcatatagtaaaatatagaggacatttccttaataatgccccagttaaaacatttaaaagtggaaacctcgacctagccataaaattcaacgaactcaacgaagagttcaaaagtgtttaccctgatttagaactacaattcaatcttgaccaaattgacgaaataaagaaaatactactagactcaacaaaatcacggttcgaccgtcaaggagaagctgtaaaattaatatacacagttagcgaagtaaaaacaattgaaaaactgcaaaataaaatagttaaacagttcctcagtggtatactaggactaaacacacgattcgatgtcctaactaacacagaatcggatgactctatgtggaaatttagcctggacagtgaaagcagtgatgatgctctcgacgaaataatagcacaattagacgatccagccatacacgttgtagaattagtaaatgaaatccacagcagtattacattagcaggtatagtcccagaaggacaaggattatcagaatccatggtcgaaaaatatgaagcacacaaagctcaccttcaattactaaaagcagtagaaaaactcgtagacaagaaagcagccgacaaattggaagtcgcttacgaccaatatataaacggcaaagactcaaaacagttcataaaagaagacttctacaaagcggtccagagtgaaataaaaggtgtcgcaggcgacgaagtcgcagaaataaaccaattaatagagctagatcagtttatgccaaaacagagaacgaaagaaaatggagcaatcccacatcaactacaccaacatgaacttgatgtaatcatagaaaatcaatccaaatattacgactggctgggagaaaaagtcggcaatgaatataaacttgataaactcgtaagttttagagtaccttattatgtaggccccctagtagacacagcatcaaaagaaaagaaagacgaaactagatttgcatggatggtccgtaaaaatccagagtcgacagaagcgataaccccttggaactttgaagatatagtagacaaaaatgcatcagccgaaaactttatcaaacgaatgacaacaaaagataaatacttattaaacgaagatgtattaccaaaatgctctcttctaacacaagatttcgaagtatacaacgaattaaacaacatacgagtgaatggtgagaaatttacggcagaacaaaaacaattaatacacgacgaattgttcacaaaacatgcaagcgtatcaataaaacagctgaaagactttttagtaagcgaactaatgtacgttcgagataacttaaaagtagagggattagcagatgaaaagaaactaatgtcctcactctcaactcagttcgactatcagaaaataatacctgaccaaattaatgatgttaaatatcgagaagatatagaacaaatcattgaatggtcaactatatttgaagatgccgcaatttttaaaacaaaattaaaagaaatcgattggctaacagacgaacaacgtaataaactcgcgaacaaacgttatagaggatggggaagtttatcaaaaagactgttagcctgtttagtagacgagaatggacaaagaatcatcgacattttaagggacagcagtgacaactttatgatgatcgtaaacagacccgagttcaaacaagctatattcgatgaaaacgcaaacttaaccgaaacaaattcaaagaaagatatgttcgaaatgatagacaacttctacacttcacctcaaaataagaaagcaatccgtcaagtcctactcgtagttcaagacatacaaaacgctatgggaggagtagcaccacagaaaatctttatcgagtttgcacgagaagacgaagtaaatggaagaaggacaaattcaagatatagtcaaataagagaaatgtattctaaagttaccgatgatgtaataaacaaaacagtaagaggagaacttgaagcaaacaaaggatcattaaataaagaaaaactcttcctctactttctacaaggaggaattgatctatacagcggcaaaactatcaatatagataatatctcatcatacgatgtagaccatgtcctaccacaatcctttataaaagatgactcaattaacaacaaagtgctcgtaaacgcaaaaggtaaccgagtcaaaaacgacaatgtaccaatggagttatttggagcgaaaatgtatccaacgtggaaacgcatggtagacactgggataatgtcgaaagctaaatttaaaaacttaacgctaaacccggataacgttgacaaattcaaagccgaaggattcatcaaccgccaacttgtagagaccagacaaataataaagctagtcgcccagatattaaacgataaattaggcgatgatacaaaaatagtatctgtaaaagcaaacttaacccacgacatgagggtattctttgatttccccaaaaaccgaaacgtaaacaactaccatcacgccttcgacgcgtacttatcagcatttgtaggaacatatttatacaaaagataccctaaattacaaccatattttgtatatggcgaatttaagaaaatggataaacttaaaaacatgacgtccttcgacttcctccgtgacttaaaacacacagacaaagtggtagataaagacacaggggagataatagctgataaactagccgttataacaaacatgaataaaatatatgatttcaagaaagtcttagtgacccacgaagtacacgaaaactcaggggccatgtacgaccaaaccctataccctgcaaaactcgataaatcactcggtcgcaaaggagctaaacaacttatcccgaagaaagatgatatgcccactgcactatatggaggttacaccggctcaaaagatgcctttatgtcgatagtaagacttaaaaagaaagatgaagtttactataaagtaataggaataccagttcgcatagcagactctgtacaacacggaaaagaggtcgacgtggaagcactaacccagtttatagaaacaaaattcaccaaagaaaatctaaataagaaaaccggggaaataacacgaaaagtagaatggtttgaacttgtccttcccaaagtcctattcggccaagccgtattcgatggagggcaaccatttatgcttggtagcagcacttacccccataatctacgagaactcgttttaacaaaagattcagtaaagaaaatagctgggaaagaatcgaacaaaagttatctagacgcttacgacgaaataatggaggcaatgaacaaatacttcccactctatgatacaaacaaattccgtgaaaaagtaatagagggaagatcaaaattcatagatttgcctgataaagacgagtacgaaaacaataaacttgtacaagtaggcaaatcaaccataatcgacagaatgtttataggtctacatgccaatgctgcacgaaccgatcttaaaaatataggtataacaaccccattcggcttcatgcaacaagcctctggaataaaattaacaaaagatacagtagttttatttcaatcaagtaccggcttgtttgaacggaaagtagcattaaaagatttatga

SEQ ID NO: 5285 - RNA, 4011 nt, synthetic construct
  misc_feature 1..4011: note = Cas9 variant
  source 1..4011: mol_type = other RNA
atgacaaaagactacacaattggacttgatatcggaacaaactcagtaggatgggcagtcctaacagacgactaccaattaatgaaaagaaaaatgtcagtgcatggaaatacagagaaaaagaaaattaagaaaaatttctggggagcaaggctattcgacgaaggacaaacagccgaatttcgaagaaccaaacgcactaaccgacgacgcctagctaggagaaaataccgtttatccaaactacaagacctcttcgcggaagaattatgtaaacaagatgactgcttctttgtaagacttgaagaatcctttctagttccagaggaaaaacaatacaaaccagctagtatctttcccacattagaggaggaaaaagaatactaccaaaaataccccacgatatatcatttgagacaaaagctagtagacagcacagaaaaagaagatcttcgacttgtctacctagcattagcccatctcctcaaataccgaggccactttctgttcgaaggttaccttgacacagaaaacacatcaatagaagaatcttttagggtattcctcgaacaatatgggaaacaatccgatcaaccactcatagtacaccaaccagtcctaacaattttaacagataaactaagtaaaacgaagaaagttgaagaaatcctaaaatattatccgacagagaaaataaactctttctttgcacaatgtttaaaattaatagtagggaatcaagcaaatttcaaacgaatattcgaccttgaagcagaagtaaaactacaattttccaaagaaacatacgaagaagaccttgaaagtctattagagaaaataggcgatgaatacttagacatattcttgcaagctaaaaaggtccatgacgcaatactccttagcgaaatcatcagttcaactgtaaaacatactcaagcaaaactctcaagcggtatggtagaacgatatgaaagacataaagccgaccttgccaaattcaaacaatttgtaaaagaaaatgtaccgcaaaaagctacagtcttctttaaagacacaaccaaaaatggctacgctgggtacatcaaaggcaaaactacacaagaagagttctacaaattcgtcaagaaagaactcagcggtgtagtcggatcagaaccattcttagagaaaatagatcaagaaacattcctgctcaaacaaagaacatacacaaatggagtaattccacatcaagtgcatttaatcgaacttaaagccataatagaccaacaaaaacaacattacccatttctagaagaagcgggacccaaaataatcgcgcttttcaaatttcgaataccatactatgtgggacccttagccaaagaacaagaagcgagctcattcgcctggatagaaagaaaaaccgctgagaaaatacatccatggaacttctcggaagtcgttgacatcgagaaaagtgcaatgagattcatacaacgtatgacaaaacaagacacttatctgccaacagaaaaagtactccccaaaaattcattactataccaaaaatacatgatcttcaatgaacttacaaaagtaagttacaaagacgaaagaggagtaaaacaatatttctctggcgatgagaaacaacaaatatttaaacaactctttcaaaaagaaagaggtaaaataacagtcaagaaactacaaaactttctgtatacacactatcacatcgaaaacgcccacatatttggtatagaaaaagcattcaacgcctcatactcaacataccacgattttatgaaattagccaaaacgaaccaaaaatcaatgcaagagtggctagaacaacccgaaatggaacccattttcgaagatatagtaaaaatcctaaccattttcgaagacagacaaatgattaaacaccaactctccaaatatcaagaagtattcggcgaaaaattactcaaagagttcgcccgaaaacactatactggttggggacgatttagtgcaaaattaatacacggcattcgtgatcgaaaaacaaataaaactattctcgactatttaataaatgatgacgatgtaccagcaaatagaaaccgaaacctaatgcaactaataaacgatgaacacttatcatttaaagaagaaatagcaaaagccactgtcttctcaaaacacaagagcttagtagacgtaatccaagatctaccaggctccccagcaattaagaaaggaatatggcaaagtttaaaaattgtagaagaattaattgccataatcggttacaaacccaaaaacatcgtcatagaaatggcaagggaaaatcagaaaacgcacagaacaaaaccacgattgaaagccttagaaaatggcttaaaacaaataggctcaacactactaaaagaacaacccacagacaataaagctctccagaaagaacgcttatacctatactatctacaaaatggacgtgatatatatacaggagaaccattggatatagaaaatcttcatcaatatgaggtagaccatataatccctagatcatttatagtggacaatagtatcgataataaggtgctagtagcgagtaagcaaaatcaaaagaaacgtgacgacgtacccaataaacagatagtcaacgaacaaagaatattctggaaccaactgaaagaagctaaattaattagtcccaagaaatatgcgtaccttactaaaatagaactaacacccgaagataaagcccgatttattcaaagacaactggttgaaacaagacaaataacaaaacatgtcgctaacatactacatcaatcatttcaccaggaagaagaaggcacagattgtgacggagtacaaataataactttaaaagcaactctaacctcacagttcagacaaacatttggtctttacaaggtaagggaaataaatccacaccatcacgcacatgacgcatatctaaacggttttatagcaaacgtattacttaaacgatatccaaaattagcaccagaatttgtatacgggaaatatgttaaatacagcctggctcgcgaaaataaagcaaccgcgaaaaaggagttctactcaaacatactgaaattcctagaatctgacgaaccattttgtgacgaaaacggtgaaatatattgggaaaaatcctatcatcttccgcggataaagaaagtactgtcctctcaccaagttaatgtagtaaagaaagtagaacaacaaaaaggaggcttctacaaagaaacagtaaattcaaaagaaaaaccagataaattgatcgaacgaaagaataactgggacgtcaccaaatacggagggtttggttcaccagtaattgcatatgcaatcgcattcgtctatgccaaaggaaaaacacagaagaaaacacgagcaattgaaggcatcacaataatggaacaagcagcattcgaaaaagatccaacaacattcctcaaagataaaggattcccacaagtaactgagttcataaaattacccaaatatacgctattcgaatttgataatggcagacgacgatttttagccagtcacaaagaatcacaaaaaggaaatccattcatactatcagatcaattagtcaccctactctatcatgcgcaacattacgacaaaattacctaccaagaatccttcgattacgtcaatacacacctaagcgactttagtgcaatactaaccgaagtcttagctttcgcagaaaaatatacactcgcagacaaaaacatcgaacggattcaagaactctacgaagaaaacaaatacggagaaatatcgatgatagcacagagcttcctacaactccttcaatttaatgcaataggagctccagcagactttaaatttttcggagtaacaataccaagaaaaagatacacatctttaaccgaaatatgggacgcaacaataatataccaaagcgtcacaggattgtatgaaacacgaataagaatgggtgacctatgggccggagagcaatga

SEQ ID NO: 5286 - RNA, 4011 nt, synthetic construct
  misc_feature 1..4011: note = Cas9 variant
  source 1..4011: mol_type = other RNA
atgaccaaagactacacaatagggctagatatcggaacaaatagcgttggatgggcagtgctaacagacgattaccaacttatgaaaagaaaaatgagcgtccatggaaataccgaaaaaaagaaaattaagaaaaacttttggggtgcaagattattcgacgagggacaaacagcagaattcagaagaacaaaaagaaccaacagacgccgccttgcacgacgaaaatataggctatcaaagctacaagacctattcgcagaagaattatgtaaacaagacgactgcttttttgttagactggaagaaagcttccttgtaccagaggaaaaacaatataaacctgcgagtatctttcccactttagaagaagaaaaagaatactatcagaaataccctacaatctatcatctaagacaaaaactagtcgactctaccgagaaagaagaccttcgactagtatatctagcacttgcacacttattaaaataccgaggacattttttatttgaaggcgacttagatacagagaatacgtcaatcgaagaatcttttagagtttttttagaacaatattcaaaacaatctgaccaaccgctaattgtgcaccaacccgtcctaacaatattaacagacaaactatccaaaactaagaaggtagaagaaatattaaaatattacccgacagaaaagataaactcattctttgcgcaatgcttaaagctaatagtaggaaaccaggcaaactttaaacgtatattcgaccttgaagcagaagttaaattacaattctctaaagaaacatatgaagaagatttagaatcacttctggaaaaaataggagacgaatacctagacatatttttacaagccaaaaaggtacacgacgccatattactatcagaaataatatcttctacagtaaaacacaccaaagctaaattatcctctggcatggtagagcgatacgaaagacacaaagccgacctagccaaattcaaacaatttgtcaaggaaaatgtacctcaaaaggctaccgtgttcttcaaagatacgacgaagaacggctacgcagggtacattaagggaaaaacgacacaagaggaattctataaattcgtcaagaaagagctatccggggttgtaggtagcgaacccttcctagaaaaaatcgatcaagaaaccttcctgctaaaacaacgaacatatacaaacggtgtcataccacaccaggttcacttaattgaacttaaagcaatcatagaccagcaaaaacaacactacccatttctagaagaggcaggtcctaaaattattgcactattcaaatttcgaattccatattatgttgggcctctagccaaagaacaggaggcatcatcctttgcctggatagaaaggaagaccgctgaaaaaatcaatccatggaacttttcagaagtagtcgatattgaaaaatccgcaatgcgcttcattcaacgaatgacaaaacaagatacatatctcccaacagaaaaggtgttaccaaagaacagtcttctataccaaaaatatatgattttcaacgaactaacaaaagtatcttataaagacgaaaggggcgtcaagcagtacttctcaggagacgaaaaacaacagattttcaaacagttatttcagaaagaaagaggaaaaataaccgtcaaaaaattacaaaactttttatacacacattaccacatagaaaacgcacaaatatttggtatcgagaaagcattcaacgcaagttatagtacctatcacgacttcatgaaactagccaaaacgaaccaaaaagctatgcaagagtggcttgaacaaccagagatggaaccaatcttcgaagacatagtaaaaatcctaactatatttgaagatcgacaaatgattaaacatcagctttccaagtaccaagaagtcttcggcgaaaaacttctaaaagaattcgcacgcaaacactacacaggctggggaagattctccgcaaaacttattcacgggattagagacagaaagacaaacaaaacaatattggattatctaatcaacgacgacgatgtaccagccaatagaaaccggaatctcatgcaattaataaacgacgaacatctatctttcaaagaagaaatagcaaaagcaaccgtattcagtaaacataaatcactagtcgacgtaatccaagacctaccaggcagtcctgcaatcaaaaaaggaatctggcaatcactaaaaatagtcgaagaactaatcgccatcataggttataaaccaaaaaatatagtcatagagatggcaagagaaaaccaaaaaacacatcgcacaagcccccgtttaaaagcattagaaaacggattaaaacaaattggaagcactctactaaaagaacaacccacagataataaagcccttcaaaaagaaagactatacctatattaccttcaaaacggccgtgatatgtatacaggagaacccttagagatagaaaatctacaccaatacgaagttgatcatatcattccaagatcattcatagtagataattctattgacaacaaagtgctcgtagctagcaaacaaaatcaaaaaaaacgtgacgacgtaccaaaaaagcaaattgttaacgagcaacgaatattctggaatcaattgaaggaagccaaactcatttcacctaaaaaatacgcctacctaaccaaaatagaattaacacccgaagacaaagcacgatttatacaacgacaactggtagaaaccaggcaaatcaccaaacatgtagctaacatattacaccaaagttttaaccaagaagaagaaggcacagactgcgacggagtacaaataataacacttaaggctaccttaacatctcaatttcgccaaacttttggattatataaagtcagagaaatcaacccccaccatcacgcgcatgacgcatacctaaacggattcatcgccaacgttctactaaaacgatacccaaagctagcaccagaattcgtctatggtaaatacgttaaatattccttagcaagagaaaataaagcgacagcaaaaaaggaattttattccaacatattaaaattcctagaatccgacgaaccattttgcgatgaaaatggagaaatctattgggaaaagtcacaccacttaccaaggataaaaaaagtcttatcgagtcaccaagtaaacgtagtgaagaaagtagaacaacaaaaaggtggattctacaaagagaccgtcaattcaaaagaaaaaccagacaaacttatagagagaaaaaataattgggacgtaaccaaatacggaggattcggatctcccgtaatagcgtacgcaatagcattcgtatatgcaaaaggaaaaactcaaaaaaaaacgcgagctatcgaaggaataacaataatggaacaagcagcattcgagaaagatccaacaacattcctaaaagaaaaaggattcccacaagtgaccgaattcattaaactcccaaaatatacattatttgaatttgacaatggcagacgaagattcctggcctctcataaggaatcacaaaaaggaaaccccttcatattaagtgaccaattagtaacactactgtatcacgcccaacattatgataaaatcacataccaagaaagctttgactacgttaacacacaccttagcgactttagcgccatactgacagaagtactagcatttgcagaaaaatataccctcgcagataaaaacatagagcgtatacaggaactctacgaagaaaacaaatacggggaaacaagtatgatagcacaatcattcctccaattacttcaattcaatgcaataggagcccctgcagactttaaattcttcggagtaacaatccctagaaaaagatacacgtccctaaccgagatatgggacgctactattatataccaatccgtaacaggcctctacgaaactcgaataagaatgggagatttgtgggccggcgaacagtga

SEQ ID NO: 5287 - RNA, 4014 nt, synthetic construct
  misc_feature 1..4014: note = Cas9 variant
  source 1..4014: mol_type = other RNA
atgaaaaacatgaagaaaccttataccattggattagatataggcactaacagtgtcggttgggcagtgctgacagaccaatacgatctggtaaaacgaaaaatgaaaattgcaggagattccgagaaaaagcaaatcaaaaagaatttctggggagtaagactctttgatgaagggcaaacggcagcagacaggagaatggcgagaacagcccggcgaagaatagaaagaagaagaaatagaattagttaccttcaaggaatctttgcagaagaaatgtcaaagactgacgcgaactttttctgcagattaagcgattcattctatgtagataatgagaaaagaaattccagacatccattcttcgcaacaatagaagaagaagttgaatatcacaaaaattacccaaccatatatcatctaagagaagaactcgtaaatagttccgaaaaagcggatctgcgacttgtctacttagcgttggcacacataatcaaatacagaggtaatttcctaattgaaggggcattagacacacaaaatacaagtgtagatggaatctataaacaatttattcaaacatataatcaagtatttgcaagtggaattgaagacggatcattaaagaaattagaagacaataaagatgtcgccaaaatattggtggaaaaagtgactagaaaggagaaattagaaagaatattaaaactatacccgggagaaaaatcagcggggatgttcgctcagtttatatcattaatcgttggatccaaaggaaatttccaaaaacctttcgacttaatagagaaaagcgacatagaatgcgcgaaagacagctacgaagaagacctcgaaagtctcctagccctaatcggagatgaatatgcagaactatttgttgctgctaagaacgcatattctgcagtcgtcttgagctcaataataaccgtagcagaaacagaaacaaatgcaaaactttctgctagcatgatagaacgttttgatacccacgaagaagaccttggagaattaaaagcatttattaaactacatttaccaaaacactatgaagaaatattcagcaacacagaaaaacatggctacgcgggatacatagacggtaagacaaaacaagcagacttctacaaatacatgaaaatgacacttgaaaacatcgaaggagctgactactttatagcaaaaattgaaaaagaaaactttctaagaaaacaacgaaccttcgacaacggagcaatcccacatcaattacatctcgaggaacttgaagcaattctccaccaacaagcaaaatactaccccttcttaaaagaaaactatgacaaaattaaatccctagtgacatttagaataccatacttcgtaggcccgctcgcaaatgggcagtcagagtttgcctggctaacacgcaaggctgatggggaaatcagaccatggaacatagaagagaaagttgacttcggaaaatcagcagtagatttcatagagaaaatgactaacaaggatacttatctaccgaaggaaaatgttttacccaaacatagcttatgctaccaaaaatacctagtatacaacgaattaaccaaagtaagatacatcaacgatcagggaaaaacatcctatttctctggtcaagaaaaagaacagatctttaatgacttgtttaagcagaaaagaaaagtcaaaaagaaagacttagaattatttttacgaaacatgtcccatgtggaaagtccaaccatagaaggtttagaagattcattcaattcaagttattctacgtaccatgacctactaaaagtcggtataaaacaagagattcttgacaatcccgtaaacaccgagatgctggaaaacatagtcaaaatactaactgtatttgaagataaacgaatgatcaaagaacagttgcaacaattctcagacgtcctcgatggagtcgtcctcaagaaactagaaagaagacactatacaggatggggacgtcttagcgcaaaattattaatgggaataagagataaacaatcacatcttaccatactagattacctaatgaatgatgacggattaaaccgaaacttaatgcaattaataaatgacagtaacttaagtttcaagtcaatcattgaaaaagaacaagtcacaaccgccgataaagatatacagagcatagtcgcagatctagccggaagccctgccataaagaaagggattctacaaagtttaaaaatagtcgatgaacttgtctccgtaatgggatatccaccacaaaccatagttgtagaaatggcccgcgaaaatcaaacaacaggaaaaggcaaaaataatagccggcctagatacaaatcactagaaaaagccatcaaagaatttggtagtcaaatactaaaagagcaccccaccgacaatcaagaattaagaaataacaggctttatctctactatttacaaaatggaaaagacatgtacacaggacaagatttagacattcacaacctatctaactacgatatagaccacatcgttccgcaaagttttataacagataacagcattgataacctagtactaacgtcatcagccggaaatcgcgaaaaaggagatgacgtaccaccccttgaaatcgtaagaaagagaaaagtattttgggaaaaactatatcaaggaaacttaatgagtaaaagaaaatttgactatctaaccaaggctgaaagaggcggattaaccgaagcagacaaagccagattcatccatagacaattggtagagacacgtcaaataaccaaaaatgtagcaaacatacttcatcaacgatttaattatgagaaagatgatcacggaaatacaatgaagcaggtcagaattgtaaccctaaaaagtgcactcgtatcacaattccgcaaacaatttcaactgtacaaagtcagagatgtcaatgactaccatcacgcacacgatgcatatctaaacggcgtagttgcaaatactctattaaaagtatacccacaacttgaaccagagttcgtatatggggattaccatcaattcgattggttcaaagcaaacaaagcaaccgcaaagaaacagttctatacaaatattatgcttttctttgcacaaaaagatcgaatcatagacgagaacggagaaatactatgggacaagaaatacctggatacagttaagaaagttatgtcctatagacaaatgaacatcgtgaagaaaactgaaatacaaaaaggtgagttttcaaaagcaacgataaaaccaaaaggtaactcgtccaaattaataagcagaaaaacaaattgggacccaatgaaatatggaggactcgattcgccaaacatggcatatgcagtcgtcatagaatacgcaaaaggtaaaaacaaacttgtttttgaaaagaaaataataagagtgacaataatggaaaggaaagcctttgaaaaagatgaaaaagccttcctagaagaacaaggttatagacaacctaaagtgctagcaaaattaccgaaatacacattatacgaatgcgaagaaggaagaagacgcatgctcgcctccgcaaacgaagcacaaaaaggtaatcaacaagttttaccaaaccatttagtaacactattacatcatgtagcaaattgtgaagtctcagacggcaagtcattagattacatagaaagcaaccgagaaatgttcgcagaattgctagcacacgtttctgagttcgcaaaaagatatacgttagcagaagctaatctcaacaaaataaaccaattattcgaacaaaacaaagaaggggacattaaagcaatcgcacaatcctttgtagacttaatggcattcaatgcaatgggagcaccggcatcatttaaatttttcgaaaccacaatagaaagaaaaaggtataacaacctcaaagaacttcttaattcaactattatataccaaagcataacaggtctttacgagtctaggaaaagattagacgattga

SEQ ID NO: 5288 - RNA, 4014 nt, synthetic construct
  misc_feature 1..4014: note = Cas9 variant
  source 1..4014: mol_type = other RNA
atgaaaaaattcgaaaactattacttaggccttgatattggtacaagctcaatcgggtgggcggtaacgaactctcagtacgatattttaaaattcaacggcaaatacatgtggggaacacgattgttcccagaagcaaataccgctcaagagagaagaatacatcgttcaagtcgaagaagactcaaaagacggaaagagagaatccaaatacttcaaatgctttttgataaagagatcgccaagattgatagcggattttttcaacgacttaaggactcaaagtattacaaggaagataaaactgaaaaacaaaccaattccatttttcatgacaaagattattcagataaagaataccatcaagactttcccacaatatatcatctcagaaaattcctcttagaaggaaataaaccaaaagatataagattcgtgtacctagcgctacaccacattttgacacatagaggacactttttatttcctgacatggaagtgagtaacgtcacagaattctcaaatatttttagtgaactaaaacagtatttatatgacgaaatggacctcgattttgaatggaaaaatggaaaattaaatgaagttgaaaacatattaaaagaccgaaacttagctaaaagcgaaaaagaaaaaaagttatgcggaataatagagttagaaggaaaaatagacaatcaaagaaaggccatgattggaatgatgtgcgggtgcaaaaaaaaattctcagacctgttccaaaacgaaaactaccgcgaactcgaaatatcctctttctcattcgcagatagctcatacgaagaaaaacgagacgaacttgaaggaatactcgccgaaaacatcctttgtctagactacctaaagacaatatacgactggggaaaactatcagacattctacaaggcgaagagtcaatctccgtcgcaaaagtgaaatcatacgaggaacatcaactcgacctaaaatatttaaaaaatatcttaaaattgtacagtcataaagaaaaggaaaacgtattccggaaaaaagaaggaaaatatccaaaatacataagtgggaaactctcacaagaagaatttaacaaaagtataaaaaaaatactagaggaaattaaaagcgtgaagcaagaagacaggaaagtatttgacacgttgttaaaaagagcctcaaacaatctgttatgccccaaacaggtaatcaaagaaaatggggtcataccctaccaaattcacaaatttgaattagaaaaaattctccgcaatatggccgatttcttcccaatgctaaaagaaaaaaaggacggaaaaacactatcggaaaaaataataagcgttttcacattcaggatcccatactacgtaggacccttaaatcagaactctgacagagcctggttagtaaaaaacaaagatgaaaagatttacccatggaatttcgaagaaatagtaaacctagaagagtctgccgagaaattcattcaaaacttaactaataaatgtacatacctagttctggaagacgtactaccaaaatcatcaattttatatagtaaatttatggtactaaatgaactcaacaacctaaaaatagacggagaagccattagtgtcgatctgaaacaaaaaatttaccttaacttattccaaaaatataaaaaagttactctcaaaaaactaaaaggatatctaaagtcagaaaacatattaatagatacgagtactcaaataacgggcatcgacggtgatttcaaaagttccctggggtcgtatctagacttttacaacatattaggagacaaagtaaaaactgatttcggcaaaaaactaattgaaaattgcattttatggataactttatatacaggagaaaaaaaacttctaaaaaacaaaataatagcaaattataaaggagaacttagtgaagaagaaataaagaaaatagtaaatctcaagtacaaagattggggaagactcagctacgcatttctagaagagatccaatcagcgtcactagaaactggagaactacgaaacatcatacaaatgatgtgggagacgaacaataacttgatggaattattatcaagcaactaccaatttctatctgaaatagaaaagaggaacagcgtagtagccatcggcaaggaattcaactatgaaacgatattaggcgattcatacgcctcaccatcagtaaagagaatgatatggcaatcattaagcgttgtcgatgaaatcaaaaaaataatgaaaaaagcaccaaagaaaatatttatagaaatggcacgccaagaagacatgaaaaaggaaagaaaagagtccagaaaaagcaccttcttaacactatacaaatcaattaaagaagaaggaagggactggatcaaggaaatcgaaaattggtcagatagcgaatttagaagcaaaaaactctacttatattacacgcaaatgggaaaatgtatgtatactggcgaaaaaataagcctagaccaattatttaataaaaatatatacgatatagatcacatttacccacgatccaaaaccaaagacgattcaatcgaaaacattgtcttagtaaaaagaaacataaacgcaaaaaaaaccgatgaatacccactcgaaagaaacatacaacaaaaacaacatgatttttggaaaatgctacacagtaaaaagctaatcggtgacaaaaaatacgaacggcttacgcgaacaacagaattcactgacgaagaactctccgatttcatagcaagacaattagtcgaaaccagacaaagcacaaaaatagtagcagatattttaaaaaacctgttcccagaaacaaaaatcgtatacgtaaaggcgaacctcacctccgacttcagaaagaactttaaaatacttaaaagcagagacataaatgactaccatcacgctcacgacgcatatttgaacatagtaactggaaacgtctacaatataaaattcacggataacccaagaaacttcataaaagataaaaaattagaaggcaaaaaatacaatttaaaagtcgaaaaaatattcgaatatcgaaaagaaaatgaaagtttctggaaccctaaaacaatggtaacaaaaatcgaaaattacatcttcaaaaagcgaccacaattcaccaggtactcgttcgaacaacatggtggattctttgaccagaatatagtagacaaagaaagttgcaaaaaaggcacgggatacattcccataaaatcatcaaacgccatattatacaataccagtaaatacggtggatatggatcagtaaccgggacctatttcttcctcgtagagcatacaatgaaaggaaagagaatccgaaccatcgaaatgatgcctctttatctatcgaaaaaaatacacagcaaggaagaattagaaaaatactgtaaagaaaaactagaattacagaaaccgtcagttagattagcaaggataaaatataactcattacttaaaataaatggctttccttaccatataactggtaaaactaacgatagttattggataatgagcgcaatacaactactattatcaaaaaattactacgaatacctaagaaaactctatatattctgcaaagaggagcgacttgaggaggaaatcgtcggagaaaagaacatcaaactctacacttgcatacttgaaaaattagagaaaagcatatacagccataaactcttaaacattaattacaatggaaaaagtaaaaacttaaaagacatactcgaaagcgaaaaagaaaactttctacttctcagcgaaaagaaacaagcacaaattctaatcgaaatattcacattattagaatcaaataacttcggagccaacttagaatcattcggatgcggaaaaaaatgcggaataaccaaaataaacaaaaacattgataaattagaagaagtcctattaatcaatcaatcaccgaccggactttttgaaaactcaatagacctcaaaaaagtctga

SEQ ID NO: 5289 - RNA, 4014 nt, synthetic construct
  misc_feature 1..4014: note = Cas9 variant
  source 1..4014: mol_type = other RNA
atgaaaaaggattatgtaataggtctagatataggaacgaacagcgtaggatgggccgttatgacagaagactaccaattagtaaagaagaaaatgccaatttacgggaacacagagaaaaagaaaataaagaaaaacttctggggagtaagattattcgaagaaggccatacagcagaagacagacgcttaaaacggacagcaagaaggagaataagtagacgaagaaatcgtctacgttacctacaagccttctttgaagaagccatgacagatctagatgaaaactttttcgccagactccaagaatcattcctcgtaccagaggacaagaaatggcatagacatccaatttttgctaaattagaagacgaagtagcatatcacgaaacatatcctaccatatatcacttaaggaagaaactggcagatagcagtgaacaagcagacctacgactaatctatctagcactcgcccacatcgtaaaataccgaggacatttccttatagaaggcaaattgagcactgaaaacatatcagttaaagaacagttccaacaattcatgataatctataaccaaacttttgtaaacggcgaatccagattagtttctgcacccctcccagagtcagtcttaatcgaagaagaactaacagaaaaagcgtcaagaaccaagaaatccgaaaaagtattacaacaatttccacaagaaaaagccaacgggctatttggacaattcctaaaattaatggtaggaaataaagcagatttcaagaaagtattcggtttagaagaggaagccaaaattacgtatgccagcgaatcctatgaagaagacctagaaggcattctagcaaaagtgggagatgaatactctgatgtattcctagccgcgaaaaatgtttacgatgcagttgaactttcaaccatcttggcagacagcgataagaaatcacacgcaaaattatcttcaagtatgatagtaaggtttacagaacatcaggaggatctcaagaaattcaaaagatttatcagagaaaactgtccagatgaatacgataatctgtttaaaaacgaacaaaaagatggatacgcaggatatattgcacacgcaggtaaagtgtcacagcttaaattttatcaatatgtcaagaaaataattcaagatatagctggcgcagaatacttcctagagaaaatagcccaagaaaactttttacgtaaacagagaacattcgacaacggtgtaataccccaccaaattcacttagccgaacttcaagctattatacatagacaagcagcttattacccgttcctaaaagaaaaccaagagaaaatagaacaactcgtaacgtttcgaataccatactacgttggacccctctctaaaggagatgcaagtacattcgcctggctaaaaaggcaatcagaagaacctattcgaccatggaatctacaagaaacagtcgatttagatcaatcagcaacagccttcatcgaacgaatgacaaattttgatacttacttgcctagcgaaaaagtattaccaaaacattccttattatacgaaaaattcatggtcttcaatgaactcaccaaaatttcctataccgacgaccggggaataaaagccaactttagtggaaaagaaaaagagaaaatattcgattaccttttcaaaacaagacgaaaagtcaaaaagaaagatataatacaattctaccgaaacgaatacaataccgaaatagtaactctatcaggattggaagaagaccaattcaacgcatcattttctacttaccaagacctactaaaatgcgggttgactagagccgaattagatcatcctgacaatgcagaaaaattagaagacataataaaaatacttactatattcgaagataggcaaagaatcagaacccaactatcgacctttaaaggacaattctcagctgaagtattaaagaaattagaacgaaaacactatacaggatggggaaggcttagcaaaaagctaattaatggtatctatgacaaagaaagtggaaaaacaatactaggatatctaattaaagatgacggtgtttccaaacattacaacagaaactttatgcaattaataaacgatagtcaactcagctttaaaaacgcaatccaaaaagcacaatcatcagaacatgaagaaactctatcagaaacagttaacgaactagcaggatcgcccgccatcaagaaaggaatatatcaaagccttaaaattgttgacgaactcgtagcaatcatgggctatgcaccaaagcgaatagtagttgaaatggcaagagagaaccagacaacatcaacaggaaaacgtaggtccatccaacgcttaaaaatagttgaaaaagcaatggcagaaataggtagtaacctacttaaagaacagccaaccactaatgaacaactaagagatactagattattcctatactacatgcaaaacggcaaggatatgtacactggcgacgaactctcactccatagattatcccactatgatatcgaccacatcatacctcaatcatttatgaaagatgactcactagataatcttgttctagtaggtagcaccgaaaaccgtggaaaaagtgacgatgtaccatcaaaagaagttgtaaaggacatgaaggcctattgggaaaaactatacgcagccgggttaatctctcaaagaaaattccaaagactaaccaaaggagaacaaggcggattaactttagaagataaggcacacttcattcaaaggcaactcgtcgaaacaagacaaataaccaaaaacgtcgcaggaatcttagatcaaaggtataacgctaactccaaagaaaagaaagtccaaataataacactaaaagcgagcctaacatcacaatttagatcaatattcggcttatacaaagtaagagaggtcaatgactatcaccacggacaagatgcctatctcaattgcgttgtagcaaccaccctattgaaagtatacccgaacctagctcccgagttcgtctatggagaatacccaaaatttcaaacattcaaagaaaacaaagcaacagcaaaagccataatctacactaatctcttaagatttttcacagaagacgagcccaggtttaccaaagacggagaaatactctggtcaaacagctacctcaaaacaatcaagaaagaattaaactaccatcaaatgaatatagtaaagaaagttgaagtacaaaaaggaggtttctccaaagaatcaataaaacctaaaggaccatcaaataaactaatacccgtgaaaaatggattagacccacaaaaatacggaggatttgattcaccaatagttgcatatacagtattattcactcacgaaaaaggaaagaaacctttgataaaacaagaaatcctaggtatcaccataatggagaaaacaaggttcgaacaaaatcctatattatttttggaagaaaaaggtttcttaagaccaagagtattaatgaagctgccaaaatacactctatatgagttcccagaaggacgtagaaggctgttggcaagtgcaaaggaagcacaaaaaggaaatcaaatggtccttcctgaacatttactcacactcctataccatgctaaacaatgtttattaccaaatcagtctgagtccctaacatatgtcgagcaacaccaaccagaatttcaagagatcctagaaagagtcgtagatttcgcagaagtacataccctagcaaaatctaaagtacaacagatagtaaagctatttgaagcaaaccaaaccgcagatgtcaaagaaatagcagcaagttttatacaattaatgcagttcaacgcaatgggagcaccatcaacctttaaattcttccaaaaagacatagaacgagcacgatacacgagtataaaagagattttcgatgcaacaataatataccaaagtacaactggcttatatgaaactagaagaaaagtagtagactga

SEQ ID NO: 5290 - RNA, 4014 nt, synthetic construct
  misc_feature 1..4014: note = Cas9 variant
  source 1..4014: mol_type = other RNA
atgaagaaagattacgtgatcggactagatataggaacgaactcagtcggctgggccgtcatgactgaagattaccaactcgttaaaaaaaaaatgcccatatatggtaacaccgaaaaaaaaaaaataaaaaaaaatttctggggagtacgattattcgaggaaggccataccgccgaagaccgacgactaaaaagaaccgctcgaagaagaatctcaagacgacgaaacagattaagatacttacaggcattctttgaagaagctatgacagacctagacgagaatttttttgctagattacaagagtcatttttagtaccagaagacaagaaatggcaccgtcatccaatctttgccaaactagaagatgaagtagcatatcatgaaacctatccaacaatatatcacctacgcaagaaacttgcagacagttccgaacaagcagaccttcgactaatatatctagcattagcccatattgttaaatatagaggccacttcttaatagaaggaaaattgagtacagagaacacatcagtaaaagaccaattccaacaatttatggtcatctacaatcaaacattcgttaacggggaaagcagactagttagcgcacctttacctgaatctgtacttatagaagaagaattaacagagaaagcaagtagaactaaaaaatcagaaaaagtactacaacagttcccccaggaaaaagcaaacggactttttggacaatttctgaaattaatggtaggaaacaaagcagatttcaaaaaagtattcggactagaagaagaagctaaaataacatacgcaagtgaatcatatgaagaagatctagaaggaatactagcaaaagtaggtgatgagtacagtgatgtgttcctagccgcaaagaatgtatatgacgctgtggaactgagcacaatattagcagatagcgacaaaaaatcacatgcaaaattgagttcatcaatgatcgttaggttcacagaacaccaagaagacctcaaaaagttcaaaagatttattagggaaaattgtccagatgaatacgataacttattcaaaaacgaacagaaagacggttacgctggatacattgcccatgccggaaaagtgtcgcagttaaaattttatcaatacgtaaaaaaaataatacaagatatagccggcgccgaatactttctagaaaaaatcgcccaagaaaattttttaagaaaacagcgaacattcgacaatggcgtcataccacaccagatacacttagccgaactgcaagccattatacacagacaagccgcttattacccattcctcaaggaaaaccaagaaaaaatagaacaattagtaacttttagaatcccgtattatgtaggtcccttgtcaaaaggagatgcctccacctttgcatggttaaaaagacaatctgaagagccgataagaccatggaatttacaggaaaccgtagacctagaccaatcagcaacagcattcatagaacgaatgacaaatttcgacacctaccttccctccgagaaagtattacctaaacactctttattatacgaaaaatttatggtctttaatgagttaacgaaaatctcctatacagacgaccgaggaataaaagccaacttcagtggcaaagaaaaagaaaaaatattcgattacttattcaaaacacgacgcaaagtcaaaaaaaaagacattatacaattctaccgaaacgagtacaatacagaaatagtaacgctatcaggacttgaagaagatcaattcaacgcatcattttccacataccaggatctcctaaaatgcggtctaacaagagccgaactagatcatccagacaacgcagaaaaacttgaagacataataaaaatcctcacaatcttcgaagacagacaaaggatccggactcagctctcaacgttcaagggtcaattctccgcggaggtgctcaaaaaattagaacgaaaacattataccggttggggcagattaagcaaaaaacttatcaacggcatctacgacaaagaaagtggtaaaaccatcttagattaccttatcaaagatgacggggtatcaaaacattacaatagaaatttcatgcaactaataaatgattcgcagttatcatttaaaaatgctattcaaaaagcacaaagctgtgaacacgaagaaacactatcagaaacagtaaatgaattagcaggttcacctgctattaaaaaagggatataccaaagtttaaaaatagttgacgaattagtggctattatgggatacgcccccaaacgcatagtagttgaaatggcaagagaaaatcaaacaacatcaacagggaaacgaagatcgatccaacggttaaaaatagtggaaaaagccatggcagaaataggatcaaacctactaaaggaacagccaactacaaatgaacaattaagagacactcgattgttcttgtactatatgcaaaatggcaaagatatgtatacaggcgacgaactttcgcttcaccgactaagtcactatgacatagaccacattatcccgcaaagtttcatgaaagacgattctcttgacaatttagtactcgtcggatcaacagaaaacagaggcaaatctgacgacgtccctagcaaaaaagtagtaaaggatatgaaagcctactgggaaaaattatacgctgccggcctcataagtcaacgaaagtttcaaagactaactaaaggcgaacaaggtgggctaactcttgaagataaagcccattttatacaaagacaattagtcgaaacacgacagataacaaaaaacgtcgcaggtatcctcgaccaaagatacaacgccaaatctaaagagaaaaaggtacagattattaccttaaaagcatctctaacatcccaattcagaagtatcttcggactatacaaagtacgagaagttaacgactaccaccatggacaagatgcatacctgaactgtgtagtcgcaacaacactattaaaagtatatccaaatttagcaccagaattcgtgtacggcgaataccctaaatttcaagcttttaaagaaaataaagcaacggcaaaaacaataatttatacaaacctaatgcgtttttttactgaggatgaaccaagattcacgaaagattcagaaattctatggtccaattcttatctaaaaacaataaaaaaggaactaaactaccatcaaatgaacatagtcaaaaaagtagaagtccaaaaaggcggtttcagtaaagaaagcataaagcccaaaggtcccagcaataaactcataccggttaagaatggactagatccacaaaaatacggtggcttcgattcgccagttgttgcatatactgtattatttacacacgaaaagggaaaaaagcctttgataaaacaagaaattctaggcatcaccattatggaaaaaactagattcgaacagaatcccatactatttctcgaggaaaaaggttttctcaggcccagagtgcttatgaaactaccaaaatatacactttatgaatttcccgaaggtagaagaagactactagcttcagcaaaagaagcgcaaaaaggtaaccaaatggtcttaccagaacatctattaacattgttgtatcatgctaaacaatgcctactcccaaaccaaagtgagtctctagcatacgtagaacaacatcaacctgagttccaagaaatactcgaaagagtcgtcgattttgcagaggttcacacactcgcaaaatcaaaagtacaacaaatagttaaactcttcgaagccaaccagacagccgacgtaaaagaaattgcggcttcatttatccaattaatgcaattcaatgcaatgggggctccttccacattcaaatttttccaaaaagacattgagagagccagatacacatcaataaaagaaattttcgacgctacaatcatctatcaatctacaacgggcctatacgaaacgagacgtaaagttgtagactga

SEQ ID NO: 5291 - RNA, 4014 nt, synthetic construct
  misc_feature 1..4014: note = Cas9 variant
  source 1..4014: mol_type = other RNA
atgaagaaagactatgtaataggattagacataggaacaaactcagtaggatgggcggttatgacagaagattaccagctagtcaaaaagaaaatgccaatatacggtaatacggagaaaaagaaaatcaagaaaaacttttggggtgtaagactattcgaagaaggtcatacagccgaagaccgcagattaaaaagaacagcacgacggcgcataagccgacgaagaaatcgcctaaggtacttacaagcgttctttgaggaagcgatgacagcattagatgagaatttctttgcaagactacaagaaagttttcttgtcccagaagacaagaaatggcatagacacccgatattcgctaaactagaagacgaagtagcataccacgaaacatacccaaccatataccatctccgaaagaaactggcagattccagcgaacaagcagacctcagactaatataccttgcattagcacatattgtaaaataccgcggccatttccttattgaaggcaaattgagcacagaaaacatctctgtgaaagagcaattccaacaatttatgataatatacaaccaaacattcgttaacggcgaaagtagactggtatccgcaccactcccggaaagcgttttaatcgaagaagaacttacagaaaaagcctcaagaacaaagaaatccgaaaaagtactgcagcaatttccccaagaaaaagcaaatggactattcggacaattcttaaaacttatggtaggtaataaagctgacttcaagaaagtatttggactcgaagaagaagcaaaaataacatacgcatcagaatcgtatgaagaggacttagaaggcattctagccaaagtaggagacgaatactcagacgtatttctagcggccaaaaatgtctatgatgcagtagaactatccactatactagcagatagcgataagaaaagtcacgctaaattatccagctccatgattgtacgcttcacagaacatcaagaagaccttaaaaacttcaaaagattcatacgagaaaattgcccggacgaatacgacaacttattcaaaaatgagcaaaaagatggatatgccggatatataacccatgcaggaaaagtcagccaactcaaattctatcaatacgtgaagaaaatcatacaagatatagcaggagcagaatactttttggagaaaatcgcacaagaaaatttccttcgcaaacaaagaacattcgacaatggcgtcatacctcaccaaatacacttggccgaactgcaagcaatcatacatcgacaagccgcctattatccgtttttaaaagaaaaccaagagaaaatagaacaattagtaacattccgcatcccgtattacgtcggacccctatccaaaggagatgccaacacatttgcgtggcttaaacgacaaagtgaagaacccataagaccgtggaatctccaagaaacagtagacctagaccagtcagccactgcgtttattgaaagaatgacaaactttgacacctacctcccatcagaaaaagtcttaccgaaacactccctattatacgaaaaatttatggtcttcaacgaacttacaaaaataagctacaccgatgacaggggaataaaagcaaacttctcaggaaaagaaaaagagaaaatatttgactacctattcaaaaccagaagaaaagttaagaagaaagacatcattcaattctacagaaacgaatataatacagaaatcgtaaccctgtcaggtcttgaagaagaccaatttaacgcgtcattttctacataccaggatttattgaaatgcggacttactagagcggaactagaccacccagacaatgcggagaaactcgaagacataatcaaaatactgacaatctttgaggataggcaaagaatacggactcaacttagcacattcaaaggccaattttcggctgaagtattgaagaaacttgaaagaaaacattacacaggatggggaagattaagcaagaaactaattaatggaatctacgataaagaatcaggaaaaacaatactagattatctaattaaagatgacggggtatctaaacattacaacaggaatttcatgcaactaataaacgacagtcagctttcatttaaaaatgcaatacaaaaagctcaatcgtcagaacatgaagaaaccttaagtgaaacagtaaacgaattagcaggaagtcccgcaattaagaaaggtatatatcagagtctaaaaatagtcgatgagctagtagcgattatgggatacgcaccaaaacgaatagttgtagaaatggcccgagaaaaccagacaacatccacaggaaaaaggagaagcattcaacgtctaaaaatagttgaaaaggcaatggctgaaataggctcaaacctattaaaagaacaacctactacaaatgaacaactacgtgacacacgactattcctatactatatgcaaaatggaaaagacatgtatacaggtgatgaactatcactccaccgtttgagccactacgatatagaccatatcatccctcagtcatttatgaaagacgactcacttgataatctagtactcgtcggctcaacagaaaaccgcggtaaaagtgatgacgtaccaagcaaagaagtagtcaaagacatgaaggcttactgggaaaaactttacgccgccggactcattagccaaaggaaattccaacgcctaacaaaaggcgaacaaggcggtctaacattagaagacaaagcacattttatacaaagacaattagtagaaacacggcaaataaccaaaaatgttgccggaatattagaccaaagatataacgcaaaatccaaagaaaagaaagtacagatcatcacactaaaggcttcacttacatcacaattccgaagcatatttggattatacaaagtaagggaagtaaacgattaccaccacggacaagacgcgtacctaaattgcgtagttgctacaacgttactcaaagtgtatccaaacttagcacctgagtttgtatacggagaatacccaaaattccaaacatttaaagaaaataaagcaactgcaaaagctataatatacacaaacctattaagattctttacagaagatgaaccacgatttacaaaagacggtgagattctctggtctaactcctatctcaaaacaattaagaaagaattaaattatcatcaaatgaatatagtgaagaaagtagaagtacaaaaaggaggttttagcaaagaaagtataaaaccaaaaggaccaagcaacaaactcatacccgtcaaaaatggactagacccacagaaatatggtggattcgactcaccaatagtagcatatacagtcttattcacacatgaaaaaggaaagaaacccttaatcaaacaggaaatattaggaattacaatcatggagaaaacgcgattcgaacagaatccaattttattcttagaagaaaaaggattcttgagaccacgcgtccttatgaaattaccaaaatacacactataccaatttcctgaaggccgtagaagattattagcctcagcaaaagaagcacaaaaaggtaaccaaatggtcctacctgaacatctacttactctcctctatcatgcaaaacaatgcttactacctaaccaatcagaatcactagcatacgtcgagcaacatcaaccagaatttcaagaaatactagaacgagtggtcgatttcgcagaagtgcacactttagctaaatcaaaagtacaacaaatagtaaaattgtttgaggcaaatcaaacagccgatgtaaaagaaatagcagccagcttcatacaattaatgcagttcaatgctatgggtgcaccaagcactttcaaatttttccaaaaagacatagagagagcaagatacacatccataaaagaaatatttgacgctacaataatctaccaaagcaccactggattatatgaaacacgacgaaaagtcgtagattga

SEQ ID NO: 5292 - RNA, 4014 nt, synthetic construct
  misc_feature 1..4014: note = Cas9 variant
  source 1..4014: mol_type = other RNA
atgaaaaaagactatgtaataggactagacattggcacaaacagtgttggctgggctgtaatgacagaagattatcagttagtaaaaaaaaaaatgcccatctatggaaacaccgaaaaaaaaaaaattaaaaaaaatttctggggagttagattgtttgaggaagggcacacagctgaagatagaagacttaaaagaaccgctagaagacgaatttctagacggagaaacagacttagatacttacaagcattctttgaagaagcaatgacagacttagacgaaaattttttcgcgcgtctacaagaatcatttcttgttccagaagacaagaaatggcacagacacccaatattcgccaaactagaggacgaagtcgcttaccacgaaacttacccaacaatctatcacttaaggaaaaaactagccgactcttcagagcaagcagacctaagactcatttaccttgccctagcccacattgttaagtatcgaggccacttcctaattgaggggaaattatccacggaaaacatctcagtaaaagagcaattccagcaattcatgatcatctataaccagacatttgtaaatggagagagcagactagtaagtgctccattgccagaatcagttttaattgaagaagaactaaccgaaaaagcatcaagaacgaaaaagagtgaaaaagtactacaacaatttccccaggaaaaagctaatggattattcgggcaatttctaaaacttatggtaggaaacaaagccgattttaaaaaagtatttggactagaagaagaagccaaaatcacatacgcttctgaaagctatgaggaggatttagaaggaatactagcaaaagtaggcgatgaatatagcgatgtattccttgcagcaaaaaatgtatatgatgcagtagaattaagcactatactggccgatagtgacaaaaaatcccacgcaaaactgtcgagtagtatgatagttagattcactgaacatcaagaggacctgaaaaaatttaaacgcttcatacgcgaaaactgccccgatgaatatgacaatctatttaaaaatgaacagaaagatggttacgccggatacatagcacatgcaggtaaagtatcgcaattaaaattctaccaatacgtcaaaaaaattattcaagacatagcgggagcagaatacttcctagaaaagattgctcaagagaatttcctgaggaaacaacgaacattcgacaacggagtaataccacaccaaatacatctagcagagctacaagcaattatccacaggcaagcagcctattaccccttcttaaaagaaaaccaagaaaaaatagagcaactcgttacatttagaataccatattatgtaggaccacttagcaaaggagatgccagcacattcgcatggctcaaacgacaatcagaagaacctataagaccatggaacctacaagaaacagtagacttagatcaatcggccacagcctttattgaacgaatgactaatttcgacacatacttgccatctgaaaaagtactaccaaaacattcattactctacgaaaaattcatggtattcaacgaactgacgaaaatatcttacacagacgatcggggaatcaaagctaatttctctggtaaagagaaagaaaaaatattcgactacttattcaaaacacgcagaaaagtgaagaagaaagacattatacagttctatcgaaatgaatacaatactgagattgtaactctatcaggattagaagaagatcaatttaatgcaagcttttcaacataccaagacctcttaaaatgcggactaacacgagccgaattagaccacccggacaacgctgagaaattagaagacatcatcaagatactcacaatattcgaggaccgacaaagaattagaacacaattgagcactttcaaaggacaattctcagccgaagttctcaagaaactcgaaagaaaacactacacaggatggggaaggctgtcaaaaaaactcataaacggcatttacgacaaagagtccggaaagaccatactcggatatctaataaaagatgatggagtgagtaagcactataataggaattttatgcaactcatcaacgattcacaacttagcttcaaaaacgcaatacaaaaagctcaatcaagtgaacatgaagaaaccttgtcagaaactgtaaatgaactcgcgggaagcccagcgataaaaaaaggtatatatcaaagcttaaaaatagttgatgagttagtcgcaataatgggatacgcgcccaaacgaatcgttgtagaaatggcaagggaaaatcaaactaccagcacaggaaaaagacgatcaatacaaagactaaaaattgtagaaaaggccatggccgaaatcggtagcaatctccttaaagaacaaccaacaacaaacgaacaacttagagacactagattattcctttattatatgcaaaacggaaaagacatgtatacaggagatgaactctcactacatcgattaagccattacgacatagatcacataataccccagagttttatgaaagacgatagtttagataaccttgtactagtaggctcaactgaaaatagaggtaaatcagatgatgttccatctaaagaagtagtaaaggacatgaaagcatattgggaaaaactatatgctgcggggctaataagccaaagaaaattccaacgactaacaaaaggcgaacaaggcgggctcacgcttgaagataaggcacacttcatacaacgtcaactagtcgaaacaagacaaataacaaaaaacgtagcaggaatcctagaccagcggtacaatgcaaactcaaaagaaaaaaaagtacaaattataacactaaaagcatcacttacatcacaatttagatcaatattcggtctctacaaagtgcgtgaagtaaacgattatcaccacggccaagatgcttacttaaattgtgttgttgctactacactactcaaagtgtatcccaacctagcaccagaattcgtttatggtgaatacccaaaattccaaacgtttaaagagaataaagcaacggcaaaagctattatatacacaaatctccttcgcttttttacggaagacgaaccaagatttactaaggatggtgaaatactatggagtaatagctacttaaaaacaataaaaaaagaactaaattaccatcagatgaacatagtcaaaaaagttgaggtgcaaaagggcggattctcaaaggagtctattaaaccaaaggggccttctaacaaattaatcccagtgaaaaatggcttggaccctcaaaaatacggaggttttgactcaccaatagtcgcttatacagttcttttcacccatgaaaaaggtaaaaaaccattaataaaacaagagatactaggcataaccattatggaaaaaacgaggttcgaacaaaatccaatactattcctagaagaaaaaggcttcctaagaccacgagtacttatgaaactaccaaaatacacattatacgaattcccagaaggtcggagaaggctactagcaagcgcaaaagaggctcagaaaggtaaccaaatggttttgccagagcacctactaacactattataccacgcgaaacaatgtttattacctaaccaatcagaaagtcttgcatacgttgaacaacaccaacctgaattccaagaaatactagaaagagtcgtagacttcgcagaagtccatacattagcaaaaagtaaagtccaacaaatagttaaactattcgaagccaatcaaaccgccgatgttaaagaaatcgctgccagtttcatacaattaatgcagtttaacgctatgggagctcctagtacattcaaattttttcagaaagacatagaaagagccagatatacatcaatcaaagaaatattcgacgcaactattatatatcaatctacaaccggattgtacgagacaagacgaaaagtagtagactga

SEQ ID NO: 5293 - RNA, 4017 nt, synthetic construct
  misc_feature 1..4017: note = Cas9 variant
  source 1..4017: mol_type = other RNA
atgcaagactactatctcggactagacataggcacaaatagcgtagggtgggcagtaacggatgaaaactacaatctactcagaaaaaagggtaaagacctatggggcgttaggctattcaaagaagcgcaaccagctactgaacgcagaggacatagaagtagcagaagacgcaccattagaaaatcactacgtaaacaattactgagagagctctttgaagaagagatcaacgcaatcgataaagacttcttcctacgactggacgaatcaaaatactggttagaagacaaaaagatagaaggaaaatacagcttgtttaacgatgagaatttcacagacaaagattactatgaaaagtttccgacaattttccacctacgaaaggcactaatagaatcagacgacaaagaagacattagactctacttccttgcaataaatcaaatgatgaaaagacgtggccatttcctgattgacggaaaactctctaacgtagaagatataacaccattcaaagaatgtatccaaaacttaataaacgaagaattagataccgaaatagagaccgaattctacgacaaagcaatcaaaatagtgtcagactacagcttaaaaaaaactgaaaaaaaaaacttaataaaagacttagtcaaagaaacagattccatagaagactcaaaaaaaattatcaatatattcaatctattaatcagtggtaaatccaaagtaaacggaatcttcgatgacgaagaaatacttgaaaagatcaaagaagataataaagaagacttctatttaacgagtgagaaatatgaagaaaatctagaatacttcagccaattactcgattaccgattcgaactaatatcaagtttaaagtcaatatacgactacattatcctacaagaagtactcaaaggaaaaaaatacttgtcatacgcgcaagtagagcgttacaaaaaccataaagaagatctaaggaaactcaagcaactcataaagaaatacgataaaaacggcaaaatctactaccaaatcttcagggacgaaaacttcaaaaagggctatgtagcttacctaggttattacaaaaagaataaaaaaaatgtacctgtaaaaaaatgtgactatgacacgtttagtaaaaacataaaatcaacactggacaaaatatgtgacaaggaagacccactctatatagaactaatagacaaaatagagaaaggaggattccttctaaaacaaatagtatcaactaactcagtaatacctcatcaagtgcatgagctagaattagacaaaatactagaaaaccttgaaaaaaattatccaagttttaaggaaatctcagatggcgtaagtaaaattgataagataaaaatgatttttaactttagaataccatactatgttggcccccttaacgactatcacaaagacaaagtaaacagcaacacgtggatcgttaaaaacgaaggatttgagaatgaaaacatacgaccttggaacttttcaaaaatcgtagacgaacatgcatgcgaagaagaattcatcaaacgaatgattaatgaatgttcatacataccaggcgaaaaagtcctaccaaaaagctcattattatattcagaatacatggtattaaacgaactcaataacctacgcgttaatggagacaaactaaaccccaagatcaaaaaggaaatagttgaaaacatatacaaaaaagaacgaaaagtaacgctcaaaaaaataagaaattttttaataataaacaattacgtcgactccaaggtagaattctctggattaagcgacggaatcaaagcaaatatgtcaagctacatcgattttgcggaaatccttgacgataactttgacaacaatatggtagaagatttaatagaacaaataacaattcatgtaggcaacgtaaaactactaaccgaaaaaatatcaaataaatacccaaatcttgaaaaaaaacaaatcaataaaattgtaaacttaaagtttaaagattgggcaaggttctcaagaaagttattagtaggaatagaaggaacagaaaaagaaaccggagagatcaatacaataattggatttctacgtgaaactaacgaaaacttcatggaattaatgagcaatcgatacactttcagcgaagaaatcagtgaaatcaaaaaaaaatacatacctaataaattatctaagcaaatcgtggacgatctctacgtatcacccgcagtaaaaaaaatgatatggcaagtactaaacattaatgacgaactaataaaagtactaggaaaacagccaaagaaaatcttcatcgaaatggcacgcgggaaagaagagaaaccagaagtaaaagactcaaggaaaaataaactcatagaattatacaaaaacctaggaaaagaaggtaaagaatggctaaatagaattgaagataaaaccgaagccgacttcagaaatcgtgccttatacctatactacactcaaatgggaagatgtatgtacacaggagaaataatagacattgaacgtttatacgacaaagaattatacgacctcgaccacatcatacctcgcaaaatgaaaaaggacgattccatacacaaaaatttagtactagtaacaagaaacagtaaccaatacgaaaaaaaagacaattacccagtaccggaagtaataaaatctagagaaaatgtacgtcacctctggtatgcactaaaaaaaaagggcctaatcacagaggagaaatacaatcgacttactcgtatcaacccactctcagataaagaactatcagagttcatagaaagacaactagtggaaacaaggcaaacaacaaaagtcgtaaaagacctctttgaaaactactacacagactcgaaaatagtcacagtgaaagcagggctagtctctgaactgcgacgagattttgaagttctaaaatgcagagaaataaatgacctcaaccacgcccatgacgcattccttaatatcatagtaggtgacgtatggagcaaaaaatttacctccaacccatataattttgtcaagaaaaaccgagagaaatacacattaaacaacatcttcactaaaaatcaaaaagatctacgagggaacgaaatttggaactgcgcagaaggtaaaaaaagaataattaaaacattaaacaaaccatctgtcctattcagcgtagaaaacttcgaacaaaccggtcaactatttgaccaaaatatcataggcaaacaagactataaagaaaaaacaagctatgttccaataaaaggagacgaaagattacaagacatatcgaaatatggaggataccgaggaatatcaggcgcgtactttttcatcgtagaacataccgaaaaaaataaaagagtcaaaacaatcgaaagcctaccaatatacatgaaaagttatgtagaagagaatggcttgctagacttctgtacaaatgaaatgaaattagtagaccctaaaataatagtgaaaaaactaaactacaaatctgaaataatagttgacggattcaaatatctcatatcaggaaagacagaaaaccgattaagcttagaaacaaatgaatatctctattggaatcatacccaaacaacagacataaaaaagatcctaaatataaatgaaaaaatagagcttgaaaaatacaacggagatatagagagtgaacgagaaaacataataaaatacatacaaataatattagagaaatttaaacttaagccattcataaagcgacgaaaccttccaaacatagagatcaatttcgcagattacgaaaccgaaaaattactacaattactcgtcaacctcatcccactcacaactaaatacgtcagtccagtagatctcacagtaatcagcggatccaaatatgccggcaaagtcctaatcccgaaaaagataagtaatctcaacgaagtcatattcatatctaaaagcataacaggaatctatgaatcacgccgtagaattatatga

SEQ ID NO: 5294 - RNA, 4017 nt, synthetic construct
  misc_feature 1..4017: note = Cas9 variant
  source 1..4017: mol_type = other RNA
atgaaacaagaatatttcttaggacttgatatgggcacaggaagtctaggatgggccgtaacagacagcacgtatcaagtcatgagaaaacatggaaaagcactatggggaacgagactatttgaatcagcatcaacagccgaagaacgcagaatgtttagaacagcaagacgaagactggacaggcgaaattggcgaatacaagtattacaagagatattttcagaagaaatatcaaaagtagatccgggattctttttaagaatgaaagaaagcaaatactaccctgaggacaaaagagacgcagaaggaaattgtccagaattaccctacgcgctatttgtagacgacaattacaccgataagaattatcacaaagactatcccacgatatatcacctcagaaaaatgctaatggagacaactgaaattccagatattagattagtatacttagtactccatcacatgatgaaacatcgaggacactttcttctcagcggagatatatcacaaattaaagagttcaaatccacttttgaacagttaatacagaacatacaagatgaggaacttgaatggcacataagtctagatgatgctgctatacagtttgtagagcacgtactaaaggacagaaacttaacaagatcaacaaagaaatcaagactaataaaacaactcaatgccaaatcagcatgtgaaaaagcaatactaaacctactatcaggcggtacagtcaaattgagcgatatatttaacaacaaagaactggacgaaagtgagagaccaaaagtatcattcgcagactctggatatgacgactatattggaatagtagaagctgaacttgcagaacagtactacatcatagccagtgcgaaagcagtttatgactggtcagtcctcgtcgaaatactgggaaacagcgtatcaattagcgaagcaaaaataaaagtatatcagaaacaccaggcagacttaaaaactttgaaaaagatagtcagacaatatatgaccaaagaagattacaaaagagtatttgtagatacagaagaaaaattaaacaattattcagcatacatcggtatgactaagaaaaatggaaagaaagtagaccttaaatcaaaacaatgcacccaggcagatttttatgatttcctaaagaaaaacgtaataaaagtcatcgaccataaagaaatcacacaagaaatcgaaagtgaaattgaaaaagaaaacttcctaccaaaacaagttacaaaagacaatggtgtaatcccataccaggtacacgattatgaattaaagaaaatattagacaatttagggacaaggatgcctttcatcaaagaaaatgcagagaaaatacaacaactatttgaatttcggattccttattacgtaggtcctctaaacagagttgacgacggtaaagatggaaaattcacctggagtgtaagaaaatctgatgcacgtatatatccctggaatttcacagaagtaattgatgtagaagcatccgcagaaaaatttatacgaagaatgacaaacaaatgcacatatttagtaggcgaagacgtgctaccgaaagactcattagtgtattccaaatttatggtgttaaatgaattaaataatttgcggttaaacggggagaaaataagtgtcgaactaaaacaaagaatctatgaagaactattttgcaaatatagaaaggtaacacgaaagaaattagaacgctatctagtaatagaaggaatagcaaagaaaggagtcgaaattacaggaatagacggcgacttcaaagcctcgctcactgcatatcacgatttcaaagaacgtctgacggacgtacaactatctcaaagggcaaaagaagctatagtattaaacgtcgtactcttcggcgacgataagaaattactaaaacagcgactatcaaaaatgtacccaaacctaacaacaggacaactaaaagggatttgttcacttagttaccaaggctggggcagacttagcaaaacgttcctcgaagaaataaccgtacccgcgccgggaactggtgaagtttggaacataatgactgccttatggcaaacaaacgacaacttaatgcaattattatcaagaaactacggtttcacaaacgaagtagaagagttcaatacactgaagaaagaaacagacttaagttacaaaactgtagatgaattatacgtttcccctgctgtaaaaagacaaatctggcaaaccctaaaagttgtaaaagaaattcaaaaagtcatgggtaacgcaccaaaaagagtattcgtggaaatggcccgcgaaaaacaagaaggaaaaaggagtgactcaagaaagaaacaattagtagaactttacagagcctgtaaaaatgaagaaagagactggataactgagttaaacgcacagtcagaccaacaactgagatcggataaattattcttatattacatacaaaaaggacgatgtatgtactcaggggaaacgatacaattagacgaattatgggacaatacaaaatatgacatcgaccatatatacccgcaatcaaaaactatggatgactcgctgaataatagagtacttgtaaagaaaaattataacgcaataaaatctgacacttaccccctttcactcgacatccaaaagaaaatgatgtcattctggaaaatgcttcaacaacaagggtttataacaaaagaaaaatatgtcaggctagtccgatcagatgaactgagcgcagacgaattagccggctttatagaaagacaaatagtagaaacacgtcaatctacaaaagccgtcgcaactatccttaaagaagcactgccagacacagaaatagtatatgtcaaagctggtaatgtatcaaactttcgacaaacgtatgaacttctaaaagttagagaaatgaacgaccttcatcacgcaaaagacgcttatctaaacatagttgtcggaaatgcctatttcgttaaatttaccaaaaatgccgcctggttcataagaaataacccaggcagaagttacaacttaaaacgaatgttcgagttcgatatcgaaagatctggggaaatagcctggaaagccggaaataaaggcagtatagtaacagtaaagaaagttatgcagaaaaataatatacttgttaccaggaaagcatatgaagtaaaaggaggacttttcgatcaacaaataatgaagaaaggaaaaggtcaagttccaataaaaggaaacgatgaacgactagcagatatcgaaaaatatggaggttataacaaagcagcaggtacatatttcatgttagttaaatcattagacaagaaaggcaaagaaataagaactatagagttcgtccctctttacctaaagaaccaaattgaaataaatcatgaatcagcgatacaatatctagcacaggaacgaggcctaaacagcccagaaatactattaagtaaaataaaaattgatacactctttaaagtagacgggtttaaaatgtggttaagcggcagaacaggtaaccaattaattttcaaaggagcaaatcaactcatactatcacatcaagaggcagcaatattaaaaggagtggtgaaatatgtaaaccgaaagaacgaaaataaagatgcaaaattaagcgaaagagacggaatgaccgaagaaaaattactacaattatacgatacctttcttgacaaactaagtaacacagtatacagcataaggctctcagcacaaataaaaacactaacagagaaacgagctaaattcataggacttagtaatgaagatcaatgtatagtactcaatgaaattctacatatgttccaatgtcaatcaggatctgcaaacttaaaactcattggcggccctggatccgcaggaatattagtaatgaacaataatattacagcttgtaaacaaatatctgtgatcaaccaatcaccaacaggcatctacgaaaaagaaatagacctaataaaactatga

SEQ ID NO: 5295 - RNA, 4017 nt, synthetic construct
  misc_feature 1..4017: note = Cas9 variant
  source 1..4017: mol_type = other RNA
atgactaaaccatacagtatcggattggacattggaaccaacagtgtaggatgggctgttgttacagatggttacaaagtccccgctaaaaaaatgaaagtattaggaaacactgataaaagccacatcaaaaaaaacctgcttggagccctattattcgacagcggaaacaccgcaaaagaccgcagactcaaacgcacagctagaagaagatatacaagacgccgaaacaggatcctttatttacaagaaatctttgctgaagagatggcaaaagcagacgaatcgttttttcaaagattaaatgaatcttttctaaccaatgacgacaaagaattcgactcacaccctattttcggtaacaaagctgaagaagaagcgcaccaccacaagtttcccacaatatttcacctaagaaaacacctagcagactcaacagaaaaaagtgacttaagattaatatacctagcattggcacatatgataaagtttagagggcactttttaatagaaggccaactaaaagctgaaaatacaaatgtgcaaaccctatttgacgatttcgtagaagtctacgacaaaacagtagaagaatcacacctttcagagatttcggtatcctcaatacttacagaaaaaattagtaaatcaagaagactagaaaatctaataaaatactatccaacagaaaaaaaaaatacactatttggtaacctaatagcgttaagtctaggtttacaaccgaacttcaaaactaactttaaactctcagaagatgcaaaattacaattctcaaaagacacatacgaagaagacttaggagaactcttgggtaaaataggagataattacgcagatctattcatatctgcaaaaaacttatatgacgctatattactatccggaatccttaccatagacgataatacaacaaaagcaccattaagtgcgagtatgataaagaggtacgaagagcaccaagaagatttagctcaattgaaaaaattcataagacaaaacctaccagatcaatattccgaggtattttcagacaaaaccaaagatggttatgctggatatatagacgggaaaaccaatcaagaagcattttataaatatattaagaacatgctatctaaaaccgaaggcgcggactacttccttgataaaatcgacagagaagactttctaagaaaacaacgaacattcgacaatggatctgttccgcaccaaatccatctacaggaaatgcatgccatcctcagacgtcaaggagaatactacccattcctgaaagaaaaccaagataaaatagaaaaaatacttacgttcagaatcccctactatgtaggccctttagcccgcaagggctcgcgctttgcttgggcagagtataaagcagacaaaaaggttacaccatggaactttgacgacatattagataaagaaaaaagcgcagaagaattcattactagaatgacgttaaatgatttatatctcccagaagagaaagtattaccaaagcattcgttagtatacgagaccttcaacgtatacaatgaactcactaaagttaaatatgtcaacgaacaaggtaaagcaatcttctttgacgctaacatgaaacaagaaatattcgatcatgtttttaaagaaaaccgaaaagtaacaaaggacaaactactaaattatttaaacaaagaatttgaagaattcagaatagtaaatttaacaggattagataaagaaaacaaagcattcaattcatccctaggtacataccacgacctaagaaaaatcttagataaatcattcctagacgataaggtaaatgagaaaataattgaagatataatacaaactcttaccttatttgaagatagagaaatgattagacaaagattgcaaaaatactcagatatttttactacccaacaactcaaaaaactagagcgaagacactacacagggtggggccgcttaagtgctaaactcataaacggcataagagacaaacaatcaaataagacaatactaggatatttaatcgacgacggttattcaaatcgaaactttatgcaactcatcaatgatgattcattaccatttaaagaagaaatagctcgagcacaagtcatcggagaaactgatgatttaaaccaattagtgagcgatatagccggctctccagccataaaaaaaggcatactacaatccttaaaaatagtagatgagttagtaaaagtgatgggccataatcccgctaacattgtaatcgaaatggcacgcgaaaaccaaacgacagctaaaggtagacgttcgtcacaacaacgatataaacgattagaggaagcaataaaaaacctggaccatgatctaaatcataaaatactaaaagaacacccgacggataaccaggctctacaaaacgaccgcctattcttatactacctacaaaacggaagggacatgtatactgaagatccgctagacatcaatcgcttaagcgactatgacatagatcatataatcccccaatcctttatcaaagacgacagcattgacaataaagtcttagtttcttcagcaaaaaacagaggtaaatccgacaatgtaccatcagaagatgtcgtaaatcgcatgagacccttctggaacaaactattatcttgcggactcatctcacaaagaaaatattcaaacttaacaaaaaaagaacttaaaccagacgataaagcaggatttataaaaagacagctagtagagacacgacaaatcacaaaacacgtagcgcaaatactggacgcaagattcaacacaaaaagagatgaaaacaaaaaggttataagagatgtcaaaataattactcttaagtcaaacttagtaagccaattccgaaaagactttaaattttacaaagtaagagagataaacgattatcatcatgcacatgatgcatatctaaatgccgtaataggaaaggcactcttagacgtatatccgcaactagaacctgagtttgtctacggtgaatatcctcacttccatggatacaaagagaataaagcaactgcgaaaaaattcttttattctaacatcatgaacttcttcaaaaaagacgacataagaacagatgaaaatggtgaaatagtttggaaaaaagacgaacacatatcaaatataaagagagtactaagttaccctcaggtaaacatagtcaaaaaagtagaaatacagaccgtaggacaaaatggcgggctattcgacgacaaccctaaaagcccactagaggttactcctagtaaactcgttcccctaaaaaaagaattaaatccaaaaaaatacgggggctatcaaaagcctaccaccgcatacccagtattattaatcacagatacaaagcaattaataccaatatcagtgatgaataaaaaacaatttgaacaaaaccccgtaaaattccttagagatcgagggtaccaacaagtaggaaaaaacgacttcataaaattaccaaaatacacactagttgatataggagacggcataaagagactatgggccagctcgaaagaaatacacaaaggaaaccaattagtcgtaagtaaaaaaagccaaatcctactataccacgcacaccaccttgactcagacctctcaaatgactacctgcaaaaccataatcaacagttcgatgtattattcaatgaaatcatatccttttcaaaaaaatgcaaattaggaaaagagcacatacaaaaaatcgaaaacgtgtatagcaataaaaaaaactctgcatccatagaggaattagcagagtcattcattaaactactcggcttcactcaactaggcgcaacctcaccgtttaactttttaggtgtaaaactaaaccaaaagcaatataaaggcaaaaaggattatatactcccatgcacagaaggaaccttaattagacaatccattacaggattatacgaaacaagagtggatctaagcaaaataggagaagattga

SEQ ID NO: 5296 - RNA, 4017 nt, synthetic construct
  misc_feature 1..4017: note = Cas9 variant
  source 1..4017: mol_type = other RNA
atgcgcgactattatataggactagacctaggaaccggatcactaggctgggccgtaacagatcgagaatatgaaatcatgagagcacacggaaaagcattatggggagttagactcttcgattccgccaatacggctgaagagcgcagaggcttcaggacagcacgacgaagattagacaggagaaattggaggatagaactcctacaagagttatttggtgaggatataggcaaagtagatagtgggtttttcctgcgcatgaaagaatcaaaatacatgccagaagacaaaagagatgttaacggtaactgcccaaaattaccttacgcactttttgtagaagatggttatacagacaaagattatcaccgtcaatttccgacaatttaccatctcagaaaatggttaatggaaacagaagaaacgcctgatatacgtcttgtttacttggcattacaccacatgatgaaacatcgaggccattttttatttagtggcaacattgaaaaaataaaagaatttcaagaaaccttcaggcaatatataggaaaaataagagaggaagaacttgatttccatttatgtatagaaggagaagaattaagagagacagagaacatactaaaagataaaaacctaacgcgttcggctaagaaaactaggttaataaaattactaggagcgcacacagcttgcgaaaaagcagcattaaacttagtcgcgggagggacagtgaagctaagcgacatatttggaaattcagaactagatgcttgtgaaaaaccaaaactatcatttgctgatgccggttatgatgactacgcaggaatgattgaagatgaattaggtgagcaacatgtaattatagaaacagcgaaagccgtatatgactggtcagtattagcagatatattaggagactaccgctgcatttcagaagcgaaggctgcggtttacgagaaacatcaaaaagatctaagacatttaaaagaattagtaaaagaaaacctaggaagagatgtatataaggaagtcttcgtcaagactaacgaaaagcttccgaattacagtgcctatataggtatgacaaaaaaaaacggagtaaaaagtgaaatggaaggaaagaggtgtgacagaaaagcattctatgattacctaaaaaaaacagtggtaaacgccatacccgatgaaagtaaaactgaatatctaagaaaggaaatggaaacagaaacatttctaccaaggcaggtaaccaaggataacggagtaataccgcaccaagtccacctccaagagttagacgcgatactagaaaacctaagcggtagaataccggcactcaaagaaaatggcagcaaaataagagacatattcacttttagaataccatattatgtaggaccactaaatgggattgtaaaaggtggcgaaaggacaaactgggttaggagaaaaaaagcgggacgcatatgtccatggaactttgatgaaatggtagacacgggagcgtcagcagaagagtttataagaagaatgacatcaaaatgtacatacctcatccacgaagatgtcttacccaaaaattcaatgctgtattctaaatttatggtattgaatgaattaaacaatgtgcggctaaacggtgaacccattagtgtagaattgaaacaaaaaacatatgaagacctctttcagagacatagaaaagtaacacgtagacgactaaccgattatataagaagagaaggaatagccggacgagacgctgacatcacgggaatcgacggtgattttaaaggaagcttaacagcttatcacgactttaaagaaaaactcaccggatgtgaattatcacaagcagataaagaaaatataattttgaacatcacactatttggagaagataaagcattattaaaaaagagactaggcgctttatatccagctttaacagagccccaaaaaaaagcaatatgtgcactatcatacaagggatggggaaggctaagtcaaaggttattagaaggtataacagcaccagcaccagaaactggagaaatatggaccgttattagagcgatgtgggaaacaaatgataatttgatgcaggtgctctcagaaaaatattgttttgccgctgcgatagatgaggaaaatgcaggagaggaactaaaagaaataacatataaaaccgttgaacaaatgaacgtaagtccagcggtaagacggcaaatatggcaatcattacaagtgattaaagaaatatgcaaagtaatgggtggccctcccaaaagggtgttcgtggaaatggcacgagagaaaatggaatcgaaaagaaccgaaagtagaaagaaaagactcattgatttatataaaaagtgccgtgaagaagaaagggactggatcgaagaattaggaaatacagaggaaacaaggctacgatcagataaattatatctatactacactcaaaaaggtagatgcatgtattcaggtgaagttatagagctagaagagctttgggataatcgaaagtatgatattgatcatatatacccccaaagcaaagtaatggacgacagtcttgataatagggtcttagttaaaaaggaatacaacgcagacaaaacagatgaatacccaataagagctgacattagaggcaaaatgagagcattttggcggatccttcgagaagaaggatttatatccaaagaaaaatacaatcgattaacaaggggaacagggtttgaaccatccgaattggcgggattcatagctcgacagctagtagaaacaagacaaggtacaaaagccgtagcatcagtactcaaacaagtatttcccgaaacggatatagtatacgctaaggccagggttgcttcacaattcagacaagagtttgatctaattaaagtccgcgaaatgaatgatctacatcacgctaaagacgcttacgtcaacatagtcgttggtaacgtatattatacaaaatttacttcgaatgcagcctggtatgtaaaagaacacccaggaagaagttataatctgaaaaaaatgtttacgagcgaaagagacgttgcaagaaacggagaaacagcatggagggcagggaattctggcactatagcgaccgtaaaaagagtaatgggaaaaaataatatattagttactagaaggagttatgaagtaaaaggaggtctatttgatcagcaattaatgaaaaaagggaaaggacaggtacccatcaaaggacgagatgaaagattagcagatatagataaatacggaggatacaataaagccgcagggacatacttcatgctggctgaatccgaggataaaaagggagcaaaaataaggagtgttgaatatgttccactatacttatgcaactgcatagaaaaagatgaagaagcagcaaaaaaatatttacagaaagaaagaggactaaagaacccaagagtcttaatagccaaaataaaaattgatacgctttttaaagtagacggattttatatgtggttatcaggaagaactggaaatcaactaatttttaaaggtgcaaatcagctcatattatcagaaccggatatgcgaatacttaaaaaagtactcaaatacgtaaatagaaaaaaagaaaataaaaatgccgtgttaggagaacacgaccaattacctgaaacagacctgatacggctatacgatgtcttcttagacaagatcgaaaatacagtttatcatgtccgtctatcagctcaacaaggcacattaacaaaaaataaagacactttttgtgaactatcaaacgaagataaatgtatagtactaagcgaaatcctacatatgtttcaatgtcaatcgggtagtgcaaatcttaaactaataaaaggaccgggtagcgcaggtatactggtactaaataatataatatcgaaatgcaatcaagtaagtataatacatcaaagcccaacaggaatatacgaacaagaaattgatttaaaaaagatctga

SEQ ID NO: 5297 - RNA, 4020 nt, synthetic construct
  misc_feature 1..4020: note = Cas9 variant
  source 1..4020: mol_type = other RNA
atgaacaaggcttacaccttaggattggacataggaaccaatagcgtaggatgggccgtagtgacagatgactaccgcttaatggcaaaaaaaatgccagtacattcaaagatggaaaagaaaaaaataaaaaaaaatttttggggtgcgagattatttgatgaaggccaaaccgcagaagaacgtagaaacaaaagagcaacacgacgaagattacgaagaagaaagtaccgcattctagaactccaaaagatattttccgaagaaatattaaaaaaagactcacattttttcgcaagattagacgaatcgttcctaatcccagaagataaacagtatgcaagatttccaatatttccaaccctcttagaagaaaaagcatactatcaaaattatccaactatataccaccttaggcaaaaactagcggattcaactgaaaaagcggacatacgcctagtgtatcttgctttagctcacatgatcaaataccgaggacactttctcttcgaaggggaactagacaccgagaatacctccgttgaagagacctttaaagaatttatagacatctacaacgaacaatttgaagagggaataatattttataaagatataccactaatactaacagataaacttagcaaatcaaaaaaagtagaaaaaattcttcagtattatcccaaagaaaaaacgactggatgcctagcacaatttctgaaactcattgtcggcaatcaaggaaattttaaacaagcgttccacttagacgaagaagtaaaaatccaaatatccaaggaaacatatgaagaagacttagagaaactattaagaaaatcaaacgaagaaatgatagatgttttcttacaggttaaaaaagtatatgatgcaatacttctaagcgacatactaagcacaaaaatgaaagatacgaaagcaaaactatccgcaggaatgattgaaagataccaaaaccataaaaaagatcttgaagaattaaaacaatttgttcgggcgcacctacacgaaaaagttacagtattcttcaaagacagctccaaagacggatacgccggatacatcgatggaaagaccacgcaagctgacttttacaaattcttgaaaaaagaattaacaggagtaccaggaagcgaacccatgttagctaaaatcgatcaagaaaatttcctattaaaacaacggactcccacaaatggtgtaatacctcatcaagtacatttaaccgaatttaaggcgataatagatcaacaaaaacaatattacccatttctagaaaaatctaaggaaaaaatgatccagctccttaccttccgaataccctactatgttggtccacttgcacaagacaaagaaactagttcatttgcatggcttgaaagaaaaactacagaaaagataaaaccgtggaatgctaaggatgtaatcgactatggtgcaagtgctacaaaatttatacaaagaatgatcaattacgatacctacttacccacagaaaaagtactaccaaaatattcaatgctttatcaaaaatacacaatcttcaacgaactaacaaaggttgcatacaaagatgatcgtggaataaaacatcaattcagttctgaagaaaaactacgaatatttcaagaattatttaaaaaacaacggcgagttacaaaaaagaagctccaacatttcttatcagcgaattataacattgaagacgctgagattctaggagtagacaaagtattcaacagcagctacgcaacataccatgactttctagaacttgccaaaccatacacggaaaaaataattgaattactagaacaacccgaaatggaagaaatgtttgaagatatagtaaaaatcataacaatcttcgaagacagagaaatggtacgaacccaactaaaaaaataccaaagaattttaggagaagaaatttttaaaaaactagttaaaaagaaatacacaggatggggcagactttcaaaaagattgataaatggaattcgggaccaaaaaacaaataaaacaatcctggactacctcattaacgatgacgatttcccctataatcggaacagaaactttatgcaacttataaatgacgaccacttatcatttaaagaagaaatagcaaaagaactgaccttgtcagacaaacaaagcctgctagaagtagtcgaagctataccaggatcacccgctattaaaaaagggatctggcaaacacttaagatagtagaggaactaatagccatcatcggttacaaaccaaaaaacatagtaatagaaatggcacgggaaaaccaaaccacaaccggaggcaaaaatagaagcaaacccagactaaaaagtcttgaggaggccttaaaaaatttcgactcacagctgttaaaagaaagacccgtcgacaaccaatcactacaaaaggaccgattatacctgtattacctacaaaatggcaaggacatgtatactggcgaatcacttgacatcgaccgcttatcggaatacgatatagaccacataatacccagaagcttcattgtagatcattcactagacaataaagtactagtatcctctaaagaaaaccgcttaaaaaaagacgacgtaccggattcaaaagtagtcaaaagaatgaaagcgtactgggaaaaactactacgagcaaacttaatcagtgaaagaaaattctcctatttaacaaaactagaactaacagatgacgataaagcacggttcatacagagacaactcgtagaaaccagacagataaccaagcatgtagcagctattctacatcaatatttcaatcagactcaagaactagaaaaagaaaaggacatcagaataataaccctaaaatccagtcttgttagccaatttcgacaagtatttggtatacacaaagttagagagataaaccatcatcatcacgcgcatgatgcttatctaaatgccgtcgtcgctctggcattactaaaaaaatatccaagactagcaccagaatttgtatacggatcgtttgccaaattccacttagtaaaagaaaacaaagcaactgccaaaaaagaattctattcaaacatccttaaattttttgaaaaagaagaacaattctgcgacgaaaacggagaaatcttctgggacaaaagaaaacacatacagcaaattaaaaaggtaatctccagtcatcaagtaaacatcgtaaagaaagtagaagtacagacagggtcattctacaaggaaacagttaacacaaaagaaaaacccgacaaactaataaaacgaaaaaataactgggatgtaacaaaatatggaggattcgggtcaccggtcgtcgcatacgcagtagtattcacatacgaaaaaggtaaaaaccataaaaaagctaaagcaatagaaggaataacaataatggagcaagcgctattcgaaaaagaccccatatcattcctaatcgaaaaaggatactcgaatgtaaaccaattcattaaactccctaaatacaccctattcgagttagcaaacggccaacgacgaatgcttgcatcacaccaagaactacaaaaagccaactcgtttattctaccagaaaaactggtaactctactatatcatgcaaaccactatgatgagattgcatacaaagactcatacgactatgtaaacgaacacttctcaaacttccaggacatcctcgacaaagtcataatatttgcagagaaatatacaagcgcgccccaaaaacttaaccagataattgcaacttatgaaaaaaaccaagaagccgaccgcaagattatggcacatagcttcgtaaatctaatgcaatttaatgcattgggcgctccagcagacttcaaattctttgacactacaatcactcgcaaacgatacacatcgctaactgaaatatggcaaagtacaataatataccaatcagtaacagggctttacgaaaccagacgtagaatggccgacttatgggatggcgtacagtga

SEQ ID NO: 5298 - RNA, 4020 nt, synthetic construct
  misc_feature 1..4020: note = Cas9 variant
  source 1..4020: mol_type = other RNA
atggaaagataccacatcggattagacattggaacttcaagtattgggtgggcagtcataggtgacgatttcaagattaaaaaaaaaaagggtaaaaatttaataggaaccagactcttcaatgaaggagcaaccgcagcagaaagacgaggatttagaacacaaagaagaagattaaaccgacgaaaatggagattaaaattattagaagaaatatttgatccctacatggcagaagtagatgaatacttcttcgcaagactcaaatcatcgaatttatcaccaaaagacagtaacaagaaatacctggggagcctactattccccgacaaatccgatagcaacttctatgataaataccctaccatttaccatcttagaagagacttgatggaaaaagatgaaaagttcgatctaagagaaatatatttagctatccatcacatagtaaaatacagaggaaacttcctcgaaaaagtaccagcaaaaaactataaaaactcaggagcctcaatcggattcctactcgaggaagtaaatagtctttataaagatataataggagacgaatccatagcaatcttaaactcagaaaaattcgaagacgttgaaaaaataatattagatgaagaaaccagaaatctagacaaacaaaaatcagtaggaaaactactagtagaagacaaaaaaaaaaaaaatatagttacagcattctcaaaagcaattttcggctacaagtttaacatagaggaccttctgctaatcgaaaatgacgaaaagaacaaactaacctttaatgacgaaaacatagatgacatctttaatgagttgagtcattcactagacgacaaacaaatggatctcctaacaaaaacccgagaaatatacttcaaattcaaactaaatatgatagtgccgacaggctataccctaagcgaaagcatgatcgaaaaatacgaaatgcataaagcacatttaaaaatgtacaaagaattcatcaatacattaaatacaaaagacagaaagatattaaaaaatgcatactcagattacataaacacagaaaaagccaaagcagcaaacgcccaagaaaatttttacaagacagtcaagaagataatcaaagataacaatagcgatacagcaaaaaaaataattgtactaatagatgagggaaacttcatgcccaaacaaagaacaggagaaaatggcgtaatcccacatcaactacaccaaatagaactagatagaatcatagaaaatcaagcaaaatactacccttggctcgcagaagccaatcctgtggaaaaaaacagaaaattcgcaaaatacaaactagacgaattagtaacatttagagtcccctactacgtaggaccactaattgacaaaaccgaaagtaataaaaacgaaaaagaaacaaaattcgcgtggatggtgcgcaaagcaaaaggtacaattacaccgtggaacttcgaaaatcttgtagacagaacagaatcagcaaacagatttatcaaaagaatgacatcaaaagacacttatataattggcgaagatgttttgcccgcatcatcattgctctacgaaaaattcaaagtacttaacgaactaaataacatcaaagttaacgaaaaaaaactagacatagaacagaaacaggatatctacctaaacctgttcacaacagcaaaaaacgtaactaaaaagtcattagctacctatttaaattgttccgctgactcaatcagcggtctatctgatggagaaaaatttaacagctccctatcatcttacatcgatctaaaagctatactgggcaacatcgtcgatgattgtaacaaaaacgaggatctagaaaaaattatagaatactcaactgttttcgaagatgggaacatctacaaagaaaaattatctgaaatatcatggctaacggatgaacaaatcgagaaacttagtaatatacattttaaaggatggggccgcctttcaaagaaattactcactcaaataacaaatgaaaacggagaaagaatcatagatgcattatggaacaccagcaataacttcatgcaaatcataaatgatgaaagcatacaagcaaagctagcggagataaacggcaaatatgccggaaaatctgatctcgaggacatactttctgaagcatatacttcgccccaaaacaaaaaggcaataagacaagtaatgaaagttgtcgaagatattgaaaaagcaatgcaatgcgaaccgacatcaataagcattgaatttacaagaaaaaaacaaaaaagtagactaacaaataccaggtacaagaaaatatccgacgtctacgaaaaaatagctgatgaagtgattagcgagtacgaactgagaaaactacaatcggaacttgacagcaatgcaaacaatatgagagaccgatattatttatacttcatgcagttaggccgtgacatgtacaccggcgaaaaaatcaacattgacgaactccaccaacgttatgacattgatcatattctccctcaatcattcataaaagatgattcaattaacaatagagtactaacaagaaaagacgtcaacaataaagaaaaatcagacaaaacagccgctgacttatacgcagtagaaatgtcagatttttggagaaaattaagaaaacaaggactaatcacagagcaaaaatacaaaaatttattaactaagagcgacagtatagacaaatatgcgaaaaaagggtttataaaacgacaactagtagaaacatcacaagtagtgaagctagtagccaacatacttcaagacaaatattcagacactaaaataatagaagtaagagctaaactgaactcaaatcttcgagaggagtataaattaataaaaaaccgggcggtaaacgactaccaccacgcgatagacggttacctgacaacatttataggacaatacctctacaaaacatacccaaaactaagaagctatttcgtctataatgacttcaaaaaattagacagcaactatttgaaacacatgaagaaattcaatttcctatggcaactccaggatgacaaaaccatcgacatatacgacaacgtaaataacaaattcgtactgaatgtacccgaaatgaaaaaatatatacagaaaatctacaactacaaatacatgttagtctcaaaagaggtcactaccaaaaacggagcgttttatgatcaaaccaagtacaacgcaaaaactgtcaatctcataccaatcaaaaaaaacaaaccaacaaatatatatggaggatataaaggaaaagtctctagctatatgatgctagtaaaaatacgaaaaaaaaaggaagtaatatacaaattcgttggagtccccagactgtggacagatgaattagatagactgaaggacacaacagaaagaaaaatactattaaacgagatcgcaaaaaattcactatctaaaacagaacaagatttcgaagttatattagacaaagtatattatgggcagctaataattgacggaaaccaaaaatatacactcgggagtagtgaatataaatataacgcaatgcaactacatttaagcaaacacgcactagaagtattggcaaaagaaaacgtaaaagatgcagaaataacagacaaagacttagtctcagtatacgaagaaattctctcagtagtaaacaaatacttcgagctatatgacataaataaattccgacaaaagttaaacgagggattggaaatattcagaaaactccccgtctacaacgtatatgaatcaaacaaaattaaacaagttggaaaattcgaagtacttaatcgaatattaatgggcctacacgcgaacgcaatgataacggacctcaaagtcctaggaatcaagacaaaactaggtcaaatgcaagtaaacggtggcatcaaactaagcccagatgcaaaactgatctatcagtcacctacaggtatcttcagtagagccgtccgagtcaaagacctaggatga

SEQ ID NO: 5299 - RNA, 4020 nt, synthetic construct
  misc_feature 1..4020: note = Cas9 variant
  source 1..4020: mol_type = other RNA
atgagcttaaatacgaacaagaaatacaatattggtctagacataggtacaacctcagtcggatgggccgtcacggatgcagatggacaaaaactgcttaaagctaaaaacaaaaatttatggggagtatcactattcgaagcaggtaaaacagcagcagaaagaagaggatatagatcaactagaaggaggctaaaccatagaaaatttagactacgcctacttgaagacatgtttgaaaaagaaatattatctaaagacccttcattctttataagacttaaagaggcttttctaagtcctaaagatgaacaaaaacaattcaaaggcaacatactatttaatgacaaagattacactgatgccgactactatgaacaatataaaacaatttatcacctacgctatgacttaatatcacaacaccgacaatttgacatacgagaagtatacttagccatacaccatctgattaaatacagaggacacttcatttacgaagatcaaacttttacaacagacggcaaccaactacaacatcacataaaagcaataataaccatgatcaattccatccttaacaggataataatacccgaaacaatagacatcaacgtatttgagaaaactttactcgacagaactatgaatcgctcatccaaagtcaaattcttaatcgaactaacaggagaagataaacaagacaaacctcttttaaaagaactatttaacttaatcgttggtctaaaagccaaaccagcttcgatattcgaacaagaaaatttagcgaccatcgttgaaacaatgaatatgtcaaccgaacaagtacaattagatttacttaccttagctgacgtgctagctgacgaagaatacgatcttcttctaacagcccagaaaatatattcagccataatacttgatgaatccatggatggatacgaatatttcgccgaagccaagaaagaatcatacagaaaacatcaagaagagttagtattagtcaagaaaatgctaaaatcgaatgcaatcacgaatgatgaaagagcaaaatttgaatatttttacacagattacatcggagctaaaagttcaaactatgaagaatcaaaaataatcaagaaaggcctcagtgccgcatacggaaaatactcaaaagaagaaagactattcaaacacatcgaattattattagccaaagaaaatgtactaaccacagtcgaacatgacttactggagaaaaacataacctttgcttccttactccccttacagaggtcctcccgaaacgctgttataccgtatcaagttcatgaaaaagaacttgtcgcaattctagaaaatcaagcaacgtactacccatttttactcgaacagaaagacaatatacacaaattactaacattccgaataccctactacgtcggaccacttgcagaccaaaaagactcagaatttgcgtggatggtgagaaaacaagccggaaaaataacaccatttaattttgaagaaatggtagacattgatgccagctcggaagcatttataaaaagaatgacaaacaaatgcacctatttgatacacgaagacgttatccctaaacactcattttcatatgcaaaattcgaagtgctcaacgaactaaacaaaatacgcctagacggtaaaccaattgacataccactaaagaaaagaatttttgaaggcctcttccttgagaaaacgaaagttacccacacatcactaaagaaatggctagcggaatatgaacatatgaccgtgtcagttgtacaggggacacaaaaagaaaccgaatttgctacatcgctccaagcatttcaccgattcgttaaaatatttgaccgggaaaccgtatccaaccctgccaacgaagaaatgtttgagaaaattatatactggtcgactgtatttgaagataagaaaataatgagaagaaaattatcagaatacccccaactcacagaacaacaacaggttcaactagcccaagttcgattccgaggatgggggagacttagccaaagactaattaaccgaattaaaacaccagtaagtggagacgaagaccacaaattaagcatcaatgaaatattatggcaaacaaacgaaaatttcatgcaaataattagaaacaaagactatttatttaagaaaattatcgaagaacaatttgaaaatgaaactgcgttactcaacaaacaaagaatagacgaactagcaacgagtcccgcaaacaagaaaggaatatggcaagctatcaaaattgttaaagaactcgaaaaagtcttacagcaaccagccgaaaacatattcattgagttcgcaagatccgatgaagaatcaaaacgctcaacacccagagacaaattcatagaaaaagcatacgctcaactcaagaaagaaacggacactttcaacttagaacatcttaaagaactaaaacaaagaagcaaacagctaagcagccaacgacttttcctctacttcatacaaaatggaaaatgcatgtacagtggcgaacacctcgacatagaaagattagactcatacgaagtcgatcatatacttcctcagtcctatatcaaagataactccatagaaaacttagctctagtcaagaaagtagaaaatcaaaggaagaaagacagcttactcctcaattcgtcaataataaatcaaaattactcaagatgggaacaactcaaaaacgcaggattaataggagaaaagaaattcagaaatctaacaaggacaaaaataacagacagagacaaagaaggattcatagcacgacagctagtagaaacaaggcaaataacaaaacatgtaacacaattacttcagcaagagtacaaagatacaacaaaagtattcgcaataaaagcaacgctagtctcagatcttagaaggaaattcgagttcatcaaaaatcgtaatgtcaatgattatcatcatgcacaagacgccttcttagtggcatttctcggtacaaatataacaagtaactacccgaaaatagaaatggaatatctatttaaagggtaccaacactacctcaatgaagtaggtaaatccgctgctaaaccaaaatttacttttatagtagaaaacctatccaaacaacaatataacagtactacaggagaagttaaatggaacccagaagtagacatagcaaaacttaaaaggatcttaaatttcaaacaatgcaatatagtccgaaaagtcgaggaacaaagcggagcattatttaaagaaaccatttatccagtcgaagaatctagcagcaagacaatccctctcaagaaacatctagacacagctatctatggaggctacaccgccgttaattatgcatcatatgcactaatccagttcaagaaaggacgcaaactaaaacgagagataataggtatacctctagccgtacaaacccgaatagataattcagaaacatcactacaaacatacatcgcagaacaaatcaaatccgaggtagaaatattaaatggtcgcattctaaagtaccaacttatctctaacaacggaaacagattatacatagcaggccctcgagaaagacacaacgcaagacaactcattgtatcagatgaagcagcgaaagtaatctggctcatatcaaccaaacaagcagtggaggccactttcctaaaacactatactctagaacatttagaagcagttttcgaagaattaatccgcaaacaagctgcagattaccaaatattcgaaaacctcatcaagaaaattgaggtcaataaagcatatttttattcatgtacctacaatgaaaaagtaaaagtgatagaagaactactaaagatcacacaagccaacgcaaccaatggcgacctgaaattacttaaaatgactaaccgagaaggacgactagggagcgtttcagttgccctcgatttcaaaatcatcaatcagtcggttacaggtttatatcaatcaatagaggactacaacaactga

SEQ ID NO: 5300 - RNA, 4020 nt, synthetic construct
  misc_feature 1..4020: note = Cas9 variant
  source 1..4020: mol_type = other RNA
atgtcacttaataccaataagaagtataacataggactagatataggaacaacgtctgtaggatgggccgtcactgacgcagacggccaaaaactactaaaagcaaaaaacaaaaacttgtggggagtaagtcttttcgaagctggtaaaaccgcagctgaaaggaggggctatcggagcacacgaagacgattaaaccaccgtaaatttagactccgactactagaagacatgttcgaaaaagaaatcttatcgaaagacccttccttcttcattagattgaaggaagcatttttatcacccaaggatgaacaaaagcagtttaaaggaaacatattatttaacgataaagactatacggatgcagactattacgaacaatacaagacaatctaccacctgagatatgacctcatctcacaacacagacaatttgacatccgagaggtatacttagccatccaccacctaataaaatatcgaggtcacttcatctatgaggaccagacattcacaacggatggtaaccaattgcaacaccatattaaagcaattatcactatgatcaactcgatactcaatcgaattataatacctgaaactatagatatcaatgttttcgaaaaaaccttgttagacagaactatgaatagaagcagtaaagtaaaatttctcattgaattaaccggcgaagataaacaggacaagcctttactaaaggaattattcaatctcatagtaggattaaaagctaagccagctagtatatttgaacaagaaaacctagcgaccatagtagaaacaatgaacatgagtaccgagcaagtacaattagatttattaacactcgcagacgtactcgcagacgaagaatatgacttactcctaaccgcacaaaaaatatactcggcaataatcctggacgaatcaatggacggttatgaatactttgcagaagccaaaaaggaatcttacagaaaacaccaagaagaattagtactcgtaaagaaaatgctaaaatctaatgctatcaccaatgacgaaagggctaagttcgagtacttctatacagactacataggagcaaaatctagcaattacgaagaaagtaaaataatcaaaaaaggtctaagtgctgcatatggaaaatattcaaaagaagaacgacttttcaaacacattgaattattactggccaaagaaaacgtactaacaacagtagaacacgacttattggagaaaaacattacttttgcatccctacttcccttacaacgctcatctagaaacgctgtaattccataccaagtacatgaaaaagaattagttgcgatcctcgaaaaccaagcaacatactatcccttcctcctagaacagaaggacaatatacacaagctattaacttttcgaattccctactatgttggtccattagcagaccaaaaagattccgaatttgcttggatggttagaaaacaagcaggaaaaataacccctttcaattttgaagagatggtagatatagatgcctcttccgaagcatttataaaacgaatgaccaacaaatgtacatacttaatacacgaagatgtaatccccaaacacagcttctcatatgcaaaatttgaagtgctaaatgaactcaacaaaatacgcctagatggaaaaccaatcgacattcctctgaaaaaaagaatatttgagggactttttttagagaaaacaaaagtaactcataccagtctaaaaaaatggctagctgagcacgaacatatgaccgtctctgtagtacaaggaacacaaaaagaaactgaattcgctacaagcctacaggcttttcacaggttcgtaaaaatctttgacagagaaacagtctcaaacccagcaaacgaggaaatgttcgaaaaaatcatatattggtcaacagtattcgaagataaaaaaattatgagaagaaaattatcagaatatccacaactcaccgagcaacaacaagtacaattagcacaagtaaggtttagaggatggggacgtctaagtcaaagattaataaacagaataaaaaccccggtttccggtgacgaagatcataagctaagcataaatgaaattttatggcagaccaacgaaaactttatgcaaatcataaggaataaagactacctatttaaaaagattatcgaagaacagtttgaaaacgaaactgctctactcaacaagcaaagaatagatgagctagcaacatcaccagcgaataaaaaaggtatctggcaagcaataaaaattgtaaaagaactagaaaaagtcctccaacagcccgccgaaaacatatttatagaattcgcaagatctgatgaagaaagcaaacgatccacaccaagggataaatttatcgaaaaagcctatgcacaattaaaaaaagaaacagatacatttaatcttgagcacctaaaagaattaaaacaacgatccaaacaactttcctcacaaagactctttctctatttcatacaaaacggaaagtgtatgtattcaggcgaacatttagatatagaaagattagatagttacgaagtagaccacatactcccccaatcatacattaaagacaattcaatcgaaaatctagcattagtcaaaaaggtggaaaaccaaagaaaaaaagacagtctactactaaactcgagtataatcaaccaaaattactccagatgggaacaattaaagaacgcaggactaataggagaaaaaaaattcagaaatctcactcgtacaaaaataacggatcgagacaaagaaggctttatagcacgacaattagtcgaaactcgacaaataacaaaacacgtcacacaactgctacaacaagaatacaaagacacgacaaaagtattcgcaataaaagcaactctagtctctgaccttcgaagaaaattcgaattcataaaaaatcgcaatgtcaacgactaccatcatgcacaagatgccttcctcgttgcttttctcggcacaaatataacaagcaactatcctaaaatagagatggaatatttatttaaaggatatcaacattatctaaacgaagtcggtaaaagcgcagccaaacctaaatttacctttatagtcgaaaatctatccaaacaacaatacaatagtaccaccggagaagtaaaatggaaccctgaagtagacatagctaaactaaaacgtatattaaacttcaaacagtgtaacatagtaagaaaagtagaagaacaatccggtgcactatttaaagaaacgatatactcggtagaagagtcctcaagcaagaccatcccactaaagaaacacctcgacactgctatatacggaggatatacagcagtaaattatgcatcctatgcattgatacaattcaaaaaaggcagaaaattgaaaagagagataatcggaatccccctcgcggtacaaacaaggatagacaattcagaaacatctttacaaacttacatagccgaacaaatcaaatctgaagttgaaattctcaacggacgaatcttaaaatatcaactaattagcaataatgggaatcgattatacattgcaggaccaagggaaagacacaatgctagacaattaatcgtaagtgacgaagcagctaaagtaatatggcttatatcaacaaaacaagcagtagaggcaacatttttaaagcattacacactagaacatttagaagcggtgtttgaagaactaataagaaagcaggcagcagattatcagatattcgaaaacttaatcaaaaaaatcgaagtaaataaagcgtatttttatagttgtacatataatgaaaaggtcaaagtaatagaagaattactaaaaataactcaagcaaacgcaaccaacggagatttaaagctccttaaaatgactaacagagaaggccgcctaggcagtgtctcagttgcattagattttaagataataaatcaatctgttaccggactataccaatcaatagaagactacaacaactga

SEQ ID NO: 5301 - RNA, 4020 nt, synthetic construct
  misc_feature 1..4020: note = Cas9 variant
  source 1..4020: mol_type = other RNA
atgaaaaaagaatacactataggacttgatatcggtaccaatagcgttggctggtccgtcttgacagatgactacagattagtatcgaaaaaaatgaaagtagctggaaatacagaaaagtcaagtacaaaaaaaaatttttggggcgtacgactctttgatgaagggcaaacagcagaggcacgaagatcaaaacgaaccgcgagaaggagactagccagacgaagacaaagaatactcgaattacaaaaaatattcgcaccagaaatcctaaagatagatgaacatttcttcgcaagactcaatgagagctttttagttttagatgaaaaaaaacaatctcgccacccagtattcgcaactattaaacaagaaaaatcatatcatcaaacataccccactatatatcacctacgccaggcactcgctgacagttctgaaaaagcagatattagactagtatacttagcaatggcccacctcctcaaataccgaggtcatttcctaatagaaggtgaactaaacacagaaaactcaagcgttactgaaacctttaggcaatttctatcgacatacaatcaacaattttccgaggcagatgataaacaaaccgaaaaactggacgaagctgtggactgtagttttgtctttacagaaaaaatgtcaaagacaaagaaagcagaaaccctactaaaatacttccctcacgaaaaatccaacggatatctttcacaattcataaaactaatggtaggaaaccaaggtaatttcaaaaacgtatttggacttgaagaagcaaagttgcaattcagcaaagaaacatatgaagaagatctagaagaactactagaaaaaataggagacgattatattgacctcttcgttcaagcaaaaaacgtctacgacgccgtgttactcagtgagatactttcagattcgacgaaaaacacaagagcaaaattaagtgcagggatgataagaagatacgacgcacacaaggaagatctcgtactactgaaaagattcgtaaaagaaaacctaccaaaaaagtacagagcgtttttcggtgacaacagtgttaacggctacgcaggctacatagaaggccacgcaacccaagaagacttttacaagtttgtaaaaaaagaactcacaggaataagaggatccgaagtattcctaacaaaaattgaacaagagaactttttaagaaaacagcgtacatttgacaatggtgtaataccacatcaaatacacctgacagaattaagggcaataatagcaaatcaaaaaaaacattacccatttctaaaagaagaacaagaaaaattagaaagtttgttaacatttaaaatcccctattacgtcggaccgctggccaaaaaacaagaaaattctccattcgcatggctaatacgaaaatcggaagaaaaaataaaaccctggaacctccccgaaatagtagatatggaaggaagcgcggtacgattcatagagagaatgataaatacggacatgtacatgccccataacaaagtactccctaagaacagtctattatatcaaaaatttagtatttacaatgaattaacaaaggtacgataccaagatgaacgaggccaaatgaactacttttcctcaatagagaaaaaggaaatcttccacgaattattcgaaaaaaatagaaaagtaacaaagaaagacctacaggagtttctctacctcaaatatgacataaagcacgcagaattgagcggtatagaaaaagctttcaacgcgagctacacaacctatcatgactttctcactatgtccgaaaacaaaagagaaatgaaacaatggttagaagatcccgaacttgcatcgatgtttgaggaaatcataaaaacgctgactgtcttcgaagatagagaaatgattaaaactagattaagccatcacgaagcaacactgggaaaacatatcatcaagaagctaaccaaaaaacattatacaggatggggacgtctcagtaaagaattaatacaaggtataagagataaacaaagcaataaaacaattctcgattacttaataaacgatgacgacttcccacatcatagaaatagaaatttcatgcaactgataaacgacgacagtttatcattcaaaaaagaaataaaaaaagcacaaatgattactgacacagaaaacttagaagaaatagtaaaggaattaactggctcacccgcaattaagaaaggtatcttacaaagtctaaagatcgttgatgaaatcgtaggcatcatgggatatgagccagccaatatcgtagtagaaatggccagagaaaaccagacaacaggaaggggacttaaatcatcaagaccccgacttaaggccttagaagaatctttgaaggattttggatcccaactgcttaaagaatacccaacagacaattcctcattacaaaaagatagactttacttatattatttacaaaatgggcgcgacatgtataccggagccccactagatatccatcgcttaagcgattatgacatagaccacattataccacgatctttcacaacagacaattccatcgataacaaagtacttgtatctagcaaagaaaacagactaaagaaagacgacgttccatcagaaaaggtagtaaaaaaaatgcgatcgttctggtacgacctatattcaagcaaactaatatccaagagaaaattagacaacttaacaaaaatcaaattaactgaagaagacaaagcaggcttcataaaaagacagcttgtagaaacgagacaaataacaaaacacgtagcaggaatattacaccaccgatttaataaagctgaagacactaatgaaccaataagaaaggtcagaataataacactaaaatcagcactcgtaagccaattccgcaatagatttggaatctacaaagtaagagagataaatgaataccaccacgcacacgacgcctacttaaacggtgtagtagcattagcccttctaaaaaaatacccccaactagccccggagttcgtctacggagaatatttaaaattcaacgcacataaagcaaacaaagccacggttaaaaaagaattctatagtaatatcatgaaattttttgaatccgacacaccagtgtgtgacgaaaatggcgagatattctgggacaaaagtaaatcaatagcgcaagttaaaaaagtaataaaccaccaccatatgaacatcgtaaagaaaacagagatccaaaaaggcgggttttcaaaggaaacagtagagccaaaaaaagactcatcaaaactgttaccaaggaaaaataattgggaccctgccaaatatggagggttggggtcccctaacgtagcttacacggttgcttttacatacgaaaaaggaaaagcaagaaaacggactaatgccctagaaggaatcacgatcatggagagagaagcttttgaacaaagcccagtacttttccttaaaaacaaaggatatgaacaagcggaaattgaaatgaaactccctaagtacgcgctattcgaactggaaaacggtagaaaaaggatggtagcatcaaataaagaggctcaaaaggccaactcatttctactaccagaacacttagtaacactactataccacgctaaacaatacgacgagatttctcacaaagaaagttttgattatgtaaatgaacaccacaaagaatttagtgaagtatttgcaagagtactagaatttgccgggaaatacaccctagcagaaaaaaacatagaaaaattggaaaaaatatataaagaaaatcaaacagatgacctagcaaaactagcgtcaagctttgttaatctaatgcaattcaatgcaatgggagcccctgcggactttaaattctttgatgtcacaatacccagaaaaagatatacaagtctcacagaaatatggcaatcaaccattatacatcagtcaataacaggtctttacgaaacgcgaatcagaatgggaaaatga

SEQ ID NO: 5302 - RNA, 4023 nt, synthetic construct
  misc_feature 1..4023: note = Cas9 variant
  source 1..4023: mol_type = other RNA
atgaaaaaagaatatactatcggattagacataggcactaattccgtcggttggagcgtcttaaccgatgattatagactagtcagtaaaaaaatgaaagtagctggaaatacagagaaaagcagcactaaaaaaaacttttggggggttagactattcgacgaaggacagactgcagaagcgcgacgttcaaaacgtacggccagaagaagattagcaagaagaaggcagagaattttagaactgcaaaaaatcttcgcaccagaaatactaaaaatagatgaacatttctttgcaagacttaacgaaagcttcctcgtccttgatgaaaaaaaacaaagtagacatccagtattcgcaaccataaagcaagagaaaagttaccatcaaacatacccaaccatatatcatctacgacaagcattagctgactcatcagaaaaggcagacataaggctagtatatctagccatggctcacctgctcaaatacaggggtcacttccttatagaaggggaactaaatactgaaaactcaagtgtaactgaaacattccgacaatttctttcaacgtataaccaacaattcagcgaagcagacgacaaacaaacagagaaattagatgaagcagtggactgttccttcgtatttaccgaaaaaatgtctaaaacgaaaaaagccgaaaccttacttaaatacttcccgcatgaaaaatctaatgggtatctatcacagttcattaaactaatggtagggaatcaaggtaacttcaaaaacgtatttggtctagaagaggaagcaaaactacaattctcaaaggaaacctacgaagaagatttagaggaattattagaaaaaattggagacgattacatagatctattcgtacaggcaaaaaatgtatacgacgcagttctacttagcgaaattctaagcgatagtacaaaaaatacaagagcaaaactgtcagccggaatgatccgaagatatgatgcgcacaaagaagacctagtattactaaagagatttgtcaaagaaaacctcccaaaaaaatacagagctttcttcggagataattcagtaaacggctacgcaggatacatagaaggacacgccactcaagaagatttctacaaattcgtaaaaaaagaactaacaggaataagaggatcagaagttttcctcacaaaaattgaacaagaaaattttttaagaaaacaaagaactttcgataatggggtcataccgcatcaaatccatctaactgaactcagagctataatcgcaaatcaaaaaaaacattatccatttctcaaagaagagcaagaaaaactagaatctttattaacatttaaaataccctactacgtcggtcccttagctaaaaagcaagaaaattcaccatttgcatggttaataaggaagtcagaagaaaaaattaaaccctggaaccttccagaaatagtagatatggaagggagtgcagtcagattcatagaaagaatgattaatactgacatgtacatgccacacaacaaagtccttccaaaaaacagcctcctttaccaaaaattctcaatctacaatgaattaactaaagtaagataccaagacgaacgaggacaaatgaattacttttcaagcatcgaaaaaaaagaaatattccacgaactgttcgaaaaaaacaggaaagtaacaaaaaaagacctacaggaatttctctacttaaaatacgatataaaacatgcagaactttctggtattgaaaaagcattcaatgcatcctatacgacataccatgacttcttaactatgtcagaaaacaaaagagagatgaaacagtggttagaagacccagagctagcatcgatgtttgaagagataataaaaactctaacggtcttcgaagatagagaaatgatcaaaactagattaagccaccatgaggccacactcggaaaacacataataaaaaaactaacaaaaaaacactatacagggtggggacgcttaagtaaagaactaattcaaggaatacgagacaaacagagcaacaaaactatactcgactatctaataaacgacgatgacttccctcaccatagaaatcgcaacttcatgcaactcataaatgacgactcattatcctttaaaaaagaaattaaaaaggcacaaatgattacagacaccgaaaatctcgaagaaattgttaaagaattgactggaagccccgcaatcaagaaaggaatactgcaatcactaaaaatagtagacgaaatcgtaggaataatgggttacgaaccagccaacatagtcgttgaaatggctagagaaaaccaaacgaccgggagaggactaaaatcttccagacctcgtttaaaagccctcgaagaaagtttaaaagactttggatctcaacttttaaaagaatatccgacggataattcatctttacagaaggaccgcctatatctctactatttacaaaacggaagagacatgtatactggagctccactcgacatacacagattaagcgattatgacattgatcacataataccacgtagttttacgacggacaattcaatagataataaggtattagtgagcagcaaagaaaaccgactaaaaaaagacgacgtaccttccgaaaaggtagtcaaaaagatgagatcgttctggtacgatctatatagcagtaaactaatcagcaaaagaaaacttgacaatctcactaaaataaaactcacagaagaagataaagctggattcatcaaaagacaactcgtggaaacaagacaaattacaaaacatgttgctggaatactacaccaccgatttaataaagcagaagacacaaatgaacccataaggaaggttcgaatcataacactcaagagcgcattagttagccaatttagaaacagattcggcatctataaggtcagagaaataaacgaataccaccatgcccacgacgcgtacctcaatggagtagtcgctctagcattgttaaaaaagtatccccaattagccccagaattcgtgtacggagaatacctcaaatttaacgcccacaaagccaacaaagcaaccgttaaaaaagaattctattcaaatataatgaaattcttcgaatccgatacccctgtgtgcgacgaaaatggagaaatattctgggacaaatctaaaagtattgcacaagtaaaaaaagtcataaaccatcatcacatgaatatcgtaaaaaaaacagaaatacaaaaaggaggattcagtaaagaaacagtcgaacctaaaaaagactcgtccaagctcttaccaaggaaaaataactgggatcccgccaaatatggtggtctaggatcgcctaatgtggcctataccgttgcatttacgtatgaaaaaggaaaagcgagaaaacgcacaaatgcattagaaggcataactattatggaacgagaggctttcgaacaatcaccagtgttattcctaaaaaataaaggttatgaacaagcagaaatagaaatgaaactacccaaatatgcattatttgaacttgaaaacggtaggaaaagaatggtagcatcaaacaaagaagctcaaaaggctaatagttttcttttaccagaacatctagtcactttgctataccacgctaagcaatacgatgaaatttcacacaaggaaagttttgattacgtgaacgagcatcacaaagaattcagcgaagtatttgcaagagtactagaatttgctggaaaatacacactcgctgagaaaaacatcgaaaaattagagaaaatatacaaagagaaccaaacagacgatttagccaaactagccagtagttttgtgaatctcatgcaatttaacgcaatgggcgctccagcagattttaaattcttcgatgttactataccgagaaaaagatacaccagcctgaccgaaatatggcaatcaacaatcatccaccaatcaataacaggactgtacgagaccagaataaggatgggtaaatga

SEQ ID NO: 5303 - RNA, 4023 nt, synthetic construct
  misc_feature 1..4023: note = Cas9 variant
  source 1..4023: mol_type = other RNA
atgaaaacagattacttcatgggacttgatatgggcacaggtagcctaggttgggccgtaactgactctagctatcatttatgccgggctcacgggaaagacctatggggtgttagactctttgaaactgctcaaacagcagaagaaagacgagttttccgatgtaatagaagaagattagatagaagaaaaagaaggatccaattactacaagacatatttgcaccagaaatatataaaatcgatccaggtttctttcttagactcaaggaatcaagatatctccccgaagacaagaaaaatctcgaaggaaaaactcccgaattaccgtacgcattatttgttgacaaaaagtatacagataaagatttccataaagaatacccaacaatataccacttaagactgagactgatgcaagataggacaccagctgacgtcagattagtgtacttagcattacaccacctaataaaacatagaggacatttcttatttgctggaatcgaagcagataaagtaaccgacttcagtgcagccttctcagaattccttagaatagttcaggaacaagagcttgacatatcttttacacctgatgaagagagcagccaaataataaaagaaacactacaaaatactaacttcacaagatccaagaaatccacagaattaataaaggggctcaaagcaagcactggatgtgaaaaagctttactaaaactaatcagcggatgcaaggtcaaattaagcgcagtattcgatgaccctggatgcgacgcctatgagaaaccacaagtctgctttgcagaaagctcatatgaagattatgccgctatactagaagacgaacttgaggaccggtttattgtaatagccgcagcaaaagcactgtatgattggagtgtcttggtaaacattcttggagaagcgagcacggtaagcgaagcaaaagtaggcatctacgaaaaacacagacgagacttaaaatatttaaaacatttagttaaaacaaatctaacaagagaagattaccaagatttattcgtaaaggcaggcgccaaaaaaaacaactactgtgcatatattggaatgactaagaaaaataacaaaaaagtcgtactagaagaaaaacgatgtacaaaagaagatttttacgcttaccttaaaaaagaaatatacagtaaagtacaagaaaatccagaagcagaatatctactagaagaattagaaaaaggaacatttcttccaagacaggttagtaaagacaacggagtaatcccgtaccaactacaattcctagaactacaaaaaatactaaaaaatgcagttgagtatttaccgttcctaaaagaagaatccgaaaaaatccagcaaataatgacattccgtataccatattatgtcggcccattaaatggtaaaaaagaaggtcaaaataccttcgcatgggcagttagaaaaaataacgagccagtttacccctggaattttgaagaagttatagatacagaagcgagcgcagaacaatttattagaagaatgacaaataaatgtacttatttaccaggagaagacgttttaccaaaagaaagtctattatattcgaaatttatggtactaaacgaattaaataacctaagaataaatggaactaagatcagtgtagaactcaaacaagagctgtacgaaaaactattccagagatatagaaaggtatccgcaaaaaaattgcgtgactacctcgttagaaatgggataacagaaaaagatgcagaaattagtggcatagacggcgactttaaaggaacattaagagcatatcacgacttcaaagaaaaactaactggcgtagaactaacggaggccgaaaaagaaaccatcatcttgaatatcaccttattcggggaagataaagtactattaaaaaaaagaatgcaacgacttttacctaacctcacagaggggcaaaaaaaggcaatagtaacattaaactattcaggatggggcagattaagcagggaattcctcgaagaagtacaagcaccaaaccctgaatccggagaaatactctcaataattagagcgctatgggaaacaaatgcaaatttaatgcaactgctatctaatcaatacggataccaagaaatattagaacaaatgcgtgccgattggacaggacataaacttgattatcaaacggtagaagaactgtatgtatcacccgcagtgaagagacaaatatggcaaaccctacaagtagttaaagaattaaaaaaagtaatgggaggagaaccaaaaagagttttcttagaagtagccagagaaaaaatggagtctggtcgaaccgttagccgaaagaaacatcttaaagatctttatctatcatgcaaatcggaagaacgtaactggctagcagaacttgacagacatgaagagcacagctacagatcggaccgccttttcctatattatacccaaaaaggcagatgcatgtattgcgggaagccaatcgatctaggacatttatgggacgtaaatatgtatgatatagaccacatttatccacaaagcaaagtcatggacgatagtataagaaaccgtgtattaacttgcagaacatgtaatgcagagaagactgaccattaccctttaaaagctgagataagacaaaaaatgagaccattctgggatagtttaaaagccggcaacttcatagaagaagaaaaatggaaacgattaattagaagtgaagaattcaccagcactgaacttgctggttttatcgaaagacaactagtcgaaacaagacaatctactaaagcagttgccgatatcttgaagcaagcaatgccagaaacagaaatagtatacgtaaaagcaaaaaacgtcagtgcttttcgacaagactttaactttgtaaaaaaccgcgatgttaacgatttccaccatgcgaaagacgcgtacttaaacattgtcgttggaaatacatacttcgtaaaatttacaaaaaatgcatcttggtttatagaaagaaatccagggaggagctataacttaaaaaggatgttcaccagtgattacgatgtaatgtcaaacggagaaatagcatggaaagcaggaaactcaggaacaatcactacagtacgcaaaatgatgaaaaaaaatagcgtactattcacaagacgttccttcgaggtttccggaggtctatttgaccaacagcttatgaaaaaaggcaaaggacaagtatacgtaaaaagcggcgatgaaagacttagatcaatagaaaaatatggtgggtacaataaagctacaggtgcatatttcatgctagtagaaagcgaaggaaaaaaaggagttaaaaaaagaactatcgaatttgtaccactctacagaaaagcagaattagaagcatctgaagaaaaaatgctagaatatcttagaaccgagattggcttaaaagaaccacacgtactactgcacaaaataaagactgataccttgtttcaagctgatggtttcaaaatgcacttatctggtagaacaggaaaacaattagtatttaaaggtgcaaaccaatttttggtagctgaagattatgagcggttattgaaaaaggtgggaaaggtcacagaacaacttaaaacaaataaaaactacaaaattaatgattacgacggtataactgaagaaggattaaaagcgctctactcagaatttctatcaaaactgcaaaaagcaccatacggtaacagattaggaacccaagcagaaacactagagaacggaaaggaaaagttcgataaactatccttagaaaataagtgccaagtattgtcagagattttacacctctttcagtgtaacagctcagcagccgatctatcaaaactcggtggaccaggacacggaggaattcttgtactcagtaacgaaattacaaaatgcaataaaatcagtataatacaccaaagcccagccggaatatacgaacaagaaatagatctgaaaacactatga

SEQ ID NO: 5304 - RNA, 4023 nt, synthetic construct
  misc_feature 1..4023: note = Cas9 variant
  source 1..4023: mol_type = other RNA
atggagcaagaatattacttgggattggacatgggcacaggaagtgtaggatgggctgtaacagattctgaatatcatgtattacgaaagcacggtaaagcattatggggagtcagattatttgaaagtgcatcgacagcagaagaaagaagaatgtttaggacatcaagaagaaggctagatcgaagaaattggcgaattgaaatattacaagaaatatttgcagaagaaatatcaaagaaagacccagggtttttcttaaggatgaaagaatccaaatactatccagaagataaacgagatataaatggaaattgcccagagttgccatacgctcttttcgtcgatgatgactttaccgataaagactatcacaagaaatttccaactatctaccacctaagaaaaatgcttatgaatacggaagagacgccagacataaggttagtatatctagcgatacatcacatgatgaaacacagaggacactttctcttatcgggcgatataaacgagataaaagagttcggaaccacattctcaaaactactagaaaacattaaaaacgaagaattagattggaacctagaacttggaaaagaagaatatgcagtagtggaaagtatattaaaagacaatatgttaaacagatcgacgaagaaaacgagactaataaaagcattgaaagcaaaaagcatctgtgaaaaagcggtcctgaatttgctggcaggaggcacagtaaaattaagtgatatatttggtctagaagaactaaatgaaaccgaaagaccaaagataagtttcgcagacaacggctacgatgattatataggagaggtagaaaatgaattgggtgaacagttttatatcattgaaacagcaaaggcggtatatgattgggcagtattagtggaaatattaggaaaatacacaagcataagcgaagcaaaagtagccacatacgaaaaacataaatcagatctccaatttttgaaaaagatagtaagaaaatatttaacaaaggaagagtataaggatatatttgtaagtacatcagataaactcaaaaactacagtgcatatataggtatgacaaaaattaacggaaagaaagtagacttacaatccaaaagatgttcaaaagaagagttctacgatttcataaagaagaatgttctaaagaaattagaaggccaaccagaatacgaatatttaaaagaagaattagaaagagagacattcttaccaaaacaagtaaatagagacaatggagtaataccctatcaaattcatctatatgaacttaagaagattttagggaatctcagggataagatagatctaataaaagaaaatgaagacaaacttgtgcaattattcgaatttaggatcccttactacgtaggaccattaaacaagattgatgacggtaaagaaggcaaatttacatgggcggtaagaaaatcaaacgagaagatctatccatggaacttcgaaaacgttgttgacatagaggcaagtgcagaaaagtttatcaggaggatgacaaataagtgcacttatctgatgggtgaagatgtattacccaaagatagcctactttacagcaaatatatggtattaaatgagctcaacaatgtgaaattggatggagaaaaactgtcagtagaattaaaacaaaggctctacaccgatgtattttgcaaatatcgtaaagtaacagtaaagaaaattaaaaattatttaaaatgtgaaggtataatatcaggaaatgtcgaaataacaggaattgatggagactttaaggctagccttacggcttatcacgactttaaagaaatattgaccggtactgaattagcgaaaaaggataaagaaaacataataacaaatatcgtactatttggcgatgacaagaaattgctaaagaaaagactaaatagattatatccacaaataacacccaatcagctgaagaaaatatgtgccctatcatatacagggtggggaagattttccaagaaattccttgaagaaataactgccccagatccagaaacaggggaagtttggaatataataactgcactatgggagtcaaataacaatctaatgcaattactatcaaacgagtatagattcatggaagaggtagaaacgtacaatatgggaaaacagacaaaaactctttcgtatgaaaccgtagaaaacatgtacgtatcacctagtgtgaaaagacaaatctggcaaacattaaaaatagtaaaagagttagaaaaagtaatgaaagagagtccaaaacgtgtctttatagaaatggctagagaaaaacaagaatcaaaacgaaccgaatcacgaaagaaacaattaatagacctttacaaagcatgcaaaaatgaagagaaagactgggtaaaagaactcggagaccaagaagaacaaaagttaaggagtgataaattatacctatattatacacaaaaaggacgatgtatgtacagcggggaagtaattgaattaaaagatttatgggataacacgaaatatgatatcgatcatatatatccgcaatctaagacaatggacgacagtctaaacaacagggtacttgtaaagaagaaatacaatgcaaccaaatcagataaatacccattaaacgaaaatataagacatgaacgaaaaggattttggaaaagcctactcgatggaggctttataagtaaagaaaaatatgaacgtcttatacgaaacacagagctgagtcccgaagaactagcaggattcatagaaaggcaaattgtagagacgagacagtcaacaaaggccgtagcggagatattaaaacaagttttcccagagagtgaaatcgtatacgttaaagcagggacagtatcaagatttcgaaaagactttgaattattaaaagtcagggaagtaaacgatctacaccatgcaaaagacgcgtatttaaatatagtagtaggaaactcatattatgtaaaatttaccaaaaatgcgtcgtggttcataaaggagaatccaggaagaacatacaatttaaagaaaatgtttacaagcgggtggaatatagaaagaaacggagaagtagcatgggaagtgggtaagaaaggaacaatcgtcacagtaaaacagataatgaataaaaataacattttagttacaagacaagtacacgaggctaaaggaggactatttgatcaacaaatcatgaagaaaggaaaaggacaaatagcaatcaaagaaacagacgaaagattagcatccatcgagaagtatggagggtataataaagccgcgggggcgtatttcatgctagtagaaagcaaggataagaaaggaaaaacaataagaacgatagagttcatacccctatatctgaaaaataaaatagaaagtgacgaaagcattgctttgaacttcctagaaaaaggaagaggattaaaagagccaaaaattcttttaaagaaaataaaaatagatacactatttgatgtagatggatttaaaatgtggctaagcggtcgaacgggcgatcgtttattattcaaatgtgccaatcaacttatactagatgagaaaataatagtaacaatgaagaaaattgtaaaatttatacaaagaaggcaagaaaacagagaactaaaacttagcgataaagacggcatagataatgaagtgctgatggaaatatacaacaccttcgtggacaaactcgaaaataccgtatatagaataagactatcagaacaagctaaaacactaatcgataaacaaaaagaatttgaaaggttgtcactagaagataaaagcagtactttattcgaaattctgcatatatttcaatgccaatcatccgccgccaacctaaaaatgataggaggaccaggcaaagcagggatattagtcatgaataacaacatctcgaaatgtaacaaaatatcaattattaaccaatcaccgacaggtatatttgaaaacgaaatagacctattaaaaatatga

SEQ ID NO: 5305 - RNA, 4023 nt, synthetic construct
  misc_feature 1..4023: note = Cas9 variant
  source 1..4023: mol_type = other RNA
atgggagaagagtatttcttaggcctcgacatgggaactggatcattaggttgggcggtaacagacgataaataccaaattctaagaagacatggaaacgctctatggggtgtacggctttttgaaacggcaaatacagccgaagaacgaagaatgtttaggacaaaccgaagacgactagatcgacaggggtggcgaatcaagatactacaagaattatttgctgaagaaatttgtagggtggacccaggtttctacttacgcatgaaagaaagtaaatactaccctgaagacaaacgagatgcaaatggcgaatgcccggcactaccatacgctttattcgcagacgcacagtacacagataaagattatcatagagaatttcccacaatataccatctccgaaaaatgctgatggaaacagaaacaacacccgatattagactagtatatctcgccttccaccacatgatgaaacacagaggccatttcttattatctggagatatctcgcaagtcaccgaattccgtaacacgtttttacaaatgatagcgaacattaaaagcgaagaattagacttttctttagaaatagaggagacccaaatgggccaaattgaagctgtgttaaaagatcataaactaaccagatcggaaaaaaaaaggcgactgacacaaatattaaaacctgccaccgcgtgcgaaaaagcaatctttaccttactatcagggggaacagtaaaactaagcgacatatttggaaaggctgaattagatgaaggagaaagacccaaaataagcttcgcagataacggatacgatgactatagcgcctcagtggaagcagatctaggcgaacaatattatataattgaatcagcgaaagcagtttacgactggtctgtattatcagatatattgggcgatagcgtatcaatatcggatgctaaggtaaaactatatgaaaaacacaaaaaagatttagcttatctaaaaaaggtagtaagagaaaatctgccaagagaagtatacaatcaagtcttcgtaaacactgatgaaaaattatgtaactattgtgcgtatattggtatggcaaaaaaaaatggaaggaaagtagcactagaaggaaaaagatgcacaagagaagagttcgagagttttttaagaaaaaaaatagtaaataaaatcgaagacaaagaaatccaagagtacttatccgaagaaatcgaaaagggaacattccttccaagacaagtcactaaagacaatggagtaataccgtaccaaattcatttatatgaattgagaaaaataatcgacaacctcagtccaagaatgccttttataagagataacggagacaaaataatacaactgtttacctttagaataccatattatgtgggtcctctaggaaaaggagaaggaagcgaaaaattttcctgggcggtaagacgaaccgacgaagcgatatacccgtggaactttaaagatgtaatagatgtagaagcctcggcagaaaaatttatatgtagaatgacaaataaatgcacatacctatatggagaagacgtcctcccaaaagacagtccactatatagcaaatttatggtcctaaatgaattaaataatttaaaattagatggacaaagcgtctctgtggagttgaagcaacggatatatcaagaactattttgccatactagaaaagtgacacaaaaaaagctagtatcttatctagttagagaaggaatcactggaaaaaatgtagaaatttcagggatagacggagactttaaagcaagccttacagcgtaccacgattttaaagaaaaacttacaggagtagaattaagccagcaagaacaagaagaaatagttcgaaatatcgtactttttggtgaagacaaaaaacttttaaaacagagattggagggacggttcccacaattaacccaaaaacaaatatcggtcatagctacattatcatacaaaggctggggaaggttaagcagagaattcctagaaaatataactgttcctgcccccgggactggcgaagtatggaatataattacagcattatgggagacaaacgataatctaatgcaattattatacggcgaatatggctttcaaacagaaatcgaatgctttaatgcaaaagaaaaaaaaaaatcactctcgtacgaaacaatagaagaatcgtatgtttccccttcagtaaaaagacaaatatggcaaaccctacaagtagtaaaagaactcaaaaaggtcatgcgaggagacccgaaaagagtcttcatagaaatggctagagaaaaccaggaatctaaacgaacagaaagtagaaaaaaaacccttctagacctctataaaaattgtaaaaaagaagagcctgaatggattgcagaacttacagaacatctagagaaattggacgattcacaacttagaaaggataaattatttttatactatacgcagaaggggagatgtatgtattcaggggaaagaatagagctagaagacctatgggacaacactagatacgatatagaccatatctatccgcaatccaagacgatggacgactctgtagacaatagagtgctagtcaaaaaagaatataatgctaaaaaaactgacgtatacccaatagcagccgacataagaggaaaaatgagtcccttttggaaaaaactacttgacaataaactcatatcaaaaaaaaaatacgatagactagtaagaacagaagaacttacaccagaagagttagccggattcatagacaggcagttagtggagacccggcagagcactaaagtcgtagccgaaatcctaaaagaagcattcccagacacagaaatagtctacgtcaaagcaggaaacgtaagcaatttcagacatatgtttgatatagttaaagttagagagttgaatgacttacatcacgcaaaagatgcctatcttaatatagtagtaggaaacgcatattacgtcaaattcaacaaaaatgcagcctggtttataaaagaaaacccaggtcgctcatataatttaaagagaatgttcgattatgatataaggagaaataacgaggtagcatggttagcgggttcaacaggtacaataagccaagtgaaaaacatggtatctaaaaatcacatattagtgacaagaaagagctacgaagtgaccggaggacttttcgatcaacaactgatgaaaaaaggtaaaggccaagtacccgtaaaaacgtcagacgaaaggcttggaaacattgaaaaatatggaggatacaataaagcttcaggtgcttattttatgttagttaaaagtaaaaataaaaagggcgaagaacaaagaacaatcgagtatgtacccatatacttaaagcattatatagaagagtcaaaagaaaatgcgttagactatttaaaaaacgaaaggaaattaaatgaacctgaaatactacttgataaaataaagaaagacacactatttagagttaacggattctacatgtgtttatccaaacgaacaggcaaacaattagcatttaaaggagccaacgaactactattaccagaaccagaaaccttattattaaaaaaaattactaaatatatacagcgaagaaaagagaataaagatctaaaactcacaaaacaagacaatattactgaaaaagaactcctagaactttacgatgtatttaccgagaagttaaatcactctgtatacgctgtatgtctcggaacacaaggtaaaactttagtccaaaaaaaaccagcatttgtagcactcccagtcgaagaaaaatgtattgtactgtctgaaatactacacttattccagtgccaatcgggaagtgcaaatctaaaactaataggaggaccagcatctgcaggaatactatatcttaactctaacatttctgacgcgggagaaattttaataatcaatcaatcaccatcaggaatattcgaaaaaagaatagatttgctacgactctga

SEQ ID NO: 5306 - RNA, 4023 nt, synthetic construct
  misc_feature 1..4023: note = Cas9 variant
  source 1..4023: mol_type = other RNA
atgaaaaaagaatacacaatcggcctagacatcggaaccaatagcgtaggttggtcagtcttaacagacgattatcgcttagtaagcaaaaaaatgaaagtagcaggaaatactgaaaaatcttctacaaaaaaaaatttttggggagtaagactttttgacgaaggccaaacagctgaagctagaaggtcaaaaagaaccgctagaagacgcctagcccgacgaagacagagaatacttgaactacaaaaaatattcgctcccgaaatcttgaaaatagacgaacacttttttgcaagactaaacgaaagctttcttgttcccgacgaaaaaaaacaatccagacaccctgtatttgctacaataaaacaagaaaaatcttaccatcaaacctaccccacaatatatcatctaagacaagcattagcagatagctccgaaaaagcagatatccgattagtatatttagccatggcacacttactaaaatatcgcggacactttttaatagaaggtgaactaaacacagaaaactcttccgttacagaaacattcagacaatttttaagcacatacaaccaacaattttccgaagccggtgataaacaaactgagaaactcgacgaagcggtcgattgctcatttgtattcacagaaaaaatgagcaaaacaaaaaaagcagagacattattaaaatatttcccccacgaaaaatccaatggatatctgtctcagttcataaaactgatggtagggaatcaaggtaacttcaaaaacgtattcggtctagaagaagaagccaaactacagttcagcaaggagacctacgaagaagaccttgaagaactactagagaaaattggggatgactacatagatttattcgtccaagctaaaaatgtgtacgacgctgtcttattgtctgaaattctatccgactctacaaaaaacacaagagcaaagctcagtgctggcatgatcagaaggtatgatgcacataaagaagatctagtcctactaaaacgatttgtaaaagaaaacctaccgaaaaaatatagagccttcttcggcgacaattccgtaaacggatacgccggttacatagaaggtcacgctacacaagaagctttctataagttcgtaaaaaaagaattaacaggaatacgaggatcagaagtgtttctcacaaaaatagaacaagaaaactttctacggaaacaaagaaccttcgacaatggtgttatacctcatcagattcacctctcagaattaagagccataatcgctaaccaaaaaaaacattatccctttttaaaagaagaacaagaaaaattagaatctttactaacttttaaaataccgtattacgtaggacccctagcaaaaaaacaagaaaactcaccattcgcttggttaataaggaaaagtgaagagaaaataaaaccctggaacttaccagaaatagtagatatggaagggtcagcggtaagatttatcgaaagaatgataaacacagacatgtatatgccccataataaagttttgcctaagaactccttactttaccagaaattttcaatttacaacgaactaaccaaagtacgataccaggacgaaaggggacaaatgaactacttctcaagcattgaaaaaaaagaaatctttcatgaactatttgagaaaaatagaaaagtaactaaaaaagatcttcaagaatttctatacctaaaatatgacattaaacacgccgagctcagtggcatagaaaaagccttcaacgcatcatacacaacctaccacgattttctaacaatgagcgaaaacaagagagaaatgaaacagtggttagaagatccggaactagcatcaatgttcgaagaaataataaaaacactaaccgtttttgaggacagagaaatgataaaaactagactcagccaccacgaagccacactaggtaaacatataattaaaaaattgacaaaaaaacattatacgggttggggaagactctcgaaagagttaatacaaggcatacgcgacaaacaatccaacaaaactattctagattacctcataaatgacgatgactttccccatcatcgcaacagaaacttcatgcaattaataaacgacgactcactatcatttaaaaaagagataaaaaaagcacaaatgataaccgatacggaaaatctagaagaaatcgttaaagaactaacaggctccccagctattaaaaaaggaattttacaaagcttaaaaatcgttgatgaaatagtcggtataatgggctacgaaccggctaatatcgtcgtagaaatggctcgagaaaaccaaactactggcagaggattaaaaagttcccgacctagactcaaagcgttagaagaatctctaaaagacttcgggagtcaattactaaaagaatatccgaccgataattcatcactccaaaaagatagattatacttatattatctacagaacggaagagacatgtacacaggcgccccactagatatacataggctcagtgactacgatatagaccacataatacccagatcatttacaacagataactcaatagacaacaaagtacttgtttcatccaaagagaatcgtctaaaaaaagacgacgtaccatcagaaaaggttgtaaaaaaaatgagaagcttctggtatgatttatactcatcaaaattgatctcaaaaagaaaactcgacaacttaacaaaaatcaaattaaccgaggaagacaaagcaggatttataaaaaggcaactcgtagaaacaaggcagatcactaaacatgtagccggcatcttacatcacaggtttaataaggccgaagataccaacgatccaatcagaaaagttcgaataattacccttaaatctgcactagtttcacaattcagaaacaggtttggaatatacaaagtacgtgaaattaacgagtatcatcacgcccatgatgcatacctcaatggcgtagtcgcactcgcattactaaagaaatatcctcagttagccccagaattcgtttatggcgaatatcttaaatttaatgcgcataaagccaacaaagcaacagttaaaaaagaattctattcaaacattatgaaattcttcgaatcagataccccagtctgcgatgaaaacggagaaatcttttgggataaatcaaaaagtattgcacaagtcaaaaaagtaataaatcatcaccatatgaatatagtcaaaaagacagaaatccagaaaggcggttttagcaaagaaacagtcgaacctaaaaaagattcatcaaaattattaccgagaaaaaacaactgggatccggctaaatacggaggcctcggttccccaaacgtagcatacacagtcgcattcacttatgaaaaaggaaaagcacgcaaaaggacaaacgcattagaaggaattacaataatggaaagagaagcattcgaacaaagtcccgttctattcttaaaaaataaaggatatgaacaggcagaaatagaaatgaaattaccaaaatatgcactttttgaactggaaaacggcaggaaaagaatggtagcatccaataaagaagcccaaaaagccaactcatttctactaccagaacaccttgtcacattattgtaccatgccaagcaatatgatgaaatatcacataaggaatctttcgactatgtcaacgagcatcacaaagaattttctgaagtgttcgcccgcgtactagaattcgccggcaaatatacattagccgaaaaaaatatagaaaaattagaaaaaatatacaaagaaaaccaaacggatgatttagccaaactagcctcatcatttgtaaatctaatgcaattcaatgcaatgggcgcacctgcagactttaagttttttgatgtaacaatacctagaaaacgttacacatccctaacagagatttggcagtccactataatacaccaaagtattactgggttatatgaaacaagaataagaatgggcaaatga

SEQ ID NO: 5307 - RNA, 4023 nt, synthetic construct
  misc_feature 1..4023: note = Cas9 variant
  source 1..4023: mol_type = other RNA
atggaacaagaatactatctagggttagacatgggaacaggatcggtgggatgggcagtaactgacagcgaatatcatgtgttaagaaaacatggtaaagcgctatggggagtaagattattcgaaagcgcatccactgctgaagaaagaagaatgtttagaacatcacgcagaagactagatcgtagaaactggagaattgaaatattacaagaaatatttgcagaagaaatatctaagaaagatccaggtttctttttacgaatgaaagaatctaaatattaccccgaagataaacgggacattaatggtaactgcccagaactaccatacgcactgtttgtagatgatgactttacagataaagactaccacaagaaatttcctaccatatatcatttaagaaaaatgctaatgaacacggaagaaaccccggatatacgattagtctatctagcaattcatcatatgatgaaacaccgaggacacttcttactcagtggcgatataaacgaaataaaagagttcggaacaacatttagcaaattactcgaaaatatcaaaaacgaagaactagattggaacctcgaacttggtaaagaagaatacgccgtagtggaatcgattctaaaagataacatgctaaacagaagcacgaagaaaaccagattaataaaagcactcaaagcaaaatcaatctgcgaaaaagctgtactcaacttactcgcaggcggaacagtgaaactgtccgacatcttcgggcttgaagaattaaatgaaacagaacgtccgaaaatttcattcgccgacaacggctatgacgactacataggcgaagtagaaaatgaactaggagaacaattctacataatagaaaccgcaaaagcagtatatgactgggcagtattagtcgaaatactaggaaaatacacatccataagtgaagcaaaagttgccacatacgaaaaacacaaaagcgacctccagtttctcaagaaaattgtaagaaaatatctaacgaaagaagaatataaagacatattcgtatcaacaagtgacaaactcaaaaactatagcgcatatattggtatgaccaaaataaatgggaagaaagtggatctccaaagtaaacgatgtagcaaagaagagttctatgattttatcaagaaaaatgtacttaagaaacttgaagggcaaccagaatatgaatatttaaaagaggaactagaaagagaaacgttcctacctaaacaagttaacagagacaatggagtaatcccataccaaatacacctctacgagctaaagaaaatactgggaaatcttagagacaaaatagatttaataaaagaaaatgaagacaaattggtacaattattcgagttccgcataccatactatgtaggaccattaaacaaaatcgacgacggtaaagagggaaaattcacgtgggcagtgagaaaaagtaatgagaaaatatacccttggaacttcgaaaatgtagtggatattgaggcttcagcagaaaaattcataagaagaatgacaaataaatgtacatacttaatgggtgaagatgtcctacccaaagatagtttactatattcaaaatacatggtcttaaacgaattgaacaacgtaaaattagatggagaaaaactaagtgtagaattaaaacaaaggctatatactgacgtattctgcaaatatcgaaaagtgacggtcaagaaaatcaaaaactacctaaaatgtgaggggataatatcaggaaatgtagagataactggaatagatggcgattttaaagctagtctcacggcatatcacgatttcaaagaaatattaactggaaccgaactagcgaagaaagataaagaaaatataataaccaatatagtactattcggtgatgataagaaactactcaagaaaagattaaacagactctaccctcaaattaccccaaatcaactaaagaaaatctgcgcactatcatatactggatggggtagattcagtaagaaatttcttgaagaaataacagccccagatccagaaaccggcgaggtttggaatataattacagctctatgggagagcaacaacaacttaatgcagttactaagtaacgaatacaggtttatggaggaagtagaaacatataacatgggaaaacaaacaaaaactttaagttatgaaactgttgaaaatatgtatgtcagtccgtcagtgaaaaggcagatatggcaaaccttaaaaatagtaaaagaattggaaaaagtgatgaaagaaagtccaaaaagggtctttatcgaaatggcacgagaaaaacaagaaagcaaacggacagaatcgaggaagaaacagctcattgacttatataaagcatgtaaaaatgaagaaaaagactgggtaaaagaattaggagaccaagaagaacaaaaacttcgatccgacaaattatatctgtattacacacagaaaggccgatgcatgtacagcggcgaagtaatagaactaaaagacctatgggataatacaaaatatgacatagaccatatatacccacaatcaaaaaccatggatgactccttaaataatagagtattagttaaaaagaaatataacgccataaaatcagataaatatcctctaaatgaaaacatacgacacgagcgcaaaggattttggaaatccctcctagacggtggatttataagcaaagaaaaatacgaaaggctaatacgtaatactgaactctcaccagaagagttagcaggattcatagaaaggcaaatagttgagacccgacaatcaacaaaagctgtcgcagaaatcttaaaacaggtattcccagaatcagaaattgtatatgtaaaagcaggaacggtaagtcgatttcgaaaagatttcgaactcctaaaagtaagagaagttaacgacctacaccacgccaaagatgcatatttaaatatagtagttggaaatagttattacgttaaatttactaaaaacgccagttggttcataaaagaaaatcccggaagaacatacaatctaaagaaaatgtttacatcaggttggaatatagaaaggaacggagaagtagcctgggaagtaggcaagaaagggacgatagtcacggtaaaacagataatgaataaaaacaacatcctcgtaacaaggcaggtacacgaagcaaaaggaggactatttgaccaacaaataatgaagaaaggaaaaggtcaaatagccattaaagagactgacgaaagactagcaagtatagagaaatatggaggatacaataaagcagcaggcgcctacttcatgttagttgaatctaaagataagaaaggaaaaacaataagaacaatagagttcatacctctctacttaaagaacaaaatagaatctgatgaatcaatagcattaaatttcctcgaaaaaggaagaggattaaaagaaccaaaaatccttttaaagaaaataaaaatagatacattatttgacgtagatggctttaaaatgtggctttcaggaagaacaggagatagactcctattcaaatgcgcgaaccaattaatactagatgagaaaataatagtaactatgaaaaagatagtgaaattcatacaaagacgacaagaaaaccgagaactcaaattatcagataaagacggaattgacaacgaagttctgatggaaatttataatacgttcgtagataaacttgaaaacaccgtttatcgaataagactttcagaacaagcaaaaacacttatagaccgacaaaaagaatttgaaagactttcattagaagacaaaagtagtacactattcgaaattttacatatatttcaatgccaatcaagcgcagcgaacttaaaaatgataggagggccaggaaaggccggaatcctagtaatgaataataatatctcaaaatgcaacaaaatctcaattataaaccaaagtcccaccggaatatttgaaaatgaaattgatttactaaaaatctga

SEQ ID NO: 5308 - RNA, 4026 nt, synthetic construct
  misc_feature 1..4026: note = Cas9 variant
  source 1..4026: mol_type = other RNA
atgaggttccaaaacaagaaaacgggagattactttgtcggtctcgatatagggaccaatagtgttggttgggctgtaactaatgaaaaatacgaaatattaagagctaaaaatcatagaatgtggggctcaagattgttcgaagaaggcaaaacagccgaagaacgaagagtacacagagcaggtcgccgtcgcttaaaccgacgaaacgatagattaatgatcttggaagacctattcgcggaagaaataagtaaagtagacaaagcgttctaccaaagactacatgaatcacaataccgacaagaacataaaacggttagcggaccgtacttcctatttaacgacaaagaatttactgacgaagactaccatattgactacccaactatataccatttacgagtcgctttaatgaaagccccagcaaaagatgtacgcttattattcttagcaattcatcatataataaaatatagaggaaacttcttacacgaaggcgaaacattcaaaacaacaggtggactcactgatatattacaacgtgttctagcatgcaatgagttcagtggtttaaaacaacacatcgatgacaccgctttagttaaattgctaaccaataaaggtattacaagaagcgacatagcaaaacaaatctcagaactcgcaacagataaactctacagaaagcaagccaaagcatttgcctcgctagtacttggcctaaaagcaaacttggatgatttatttaacgaaccagaatacaaagaattagactcagaaattaggaccgtggaattttcaggcaaagaatattgggaagaacgagacaagtatgaaccatacttgggagaatctctcttcgctctggacggatgtaaaacattatacgatacattactattatcaaatataaaacccgatggaaaatatttatcggaagcaaaagtagaaacatttgaaaaacaccacgaacatctggaatcgcttaaagacttattaaaatcaaacaaagcactatacaatcgagtattaagagatgacgaaaagaatttaaataattatataacatatattggtaaaagtgaatttaacaaaagatgtagtcgagacgaattttataaattccttaaacaaacaataaaagatataagcgacaatgaaaataaagctgaaattgtacaattaatggaactcgattcattccttccactattaagggtacgagaaaatggtgtcattccttaccaaattcacgaagaagaattagaacaaatattaaatgtttcctcagaaaaatacccatttttgaacaaagcggacggctcaggattcaccatcgcgcagaaaattctaaaactccttaccttcagaataccatacttcgtaggtcccctcaacccagcacataaagatagggacaacgggttcgcatgggtagtaagaaaagcaccaggtaaagtttacccttggaatttcgaagacaaagttgatatatccgcttcagcaaccgcttttatagaaaacttaaccaacaaatgcacatacttgataggagaagacgtacttcccaaatacagcttagcatatagtaaatttagcctactaaacgaattaaataatctaagatacgacggcaaaccattatcatatgaaacaaaacagagctttataaaggattgtttcgaaaaagaacaccgtaagatgaccgagaaaaggatacgagaatttttaaaacatttaggaggaacagacggtaaaggagcattaacaggactcgacgtagatatcaaatcagatcttaaatcttatcgagatatggtacggatattgggcgacggattcgacgaaaccatggcagaacgaataatacgttatgttacactatttggtgaagctaagaaagtattattaagtacactagaaatagaatttggagacgacttgtctgatacacaaaagaaacaaatattaaaactacaatatagagattggggaagactatcagctaccctactaaaaggtattaaaggggtcgccggagataatccagaatgctccatattagaatgcatggaacaacaaccgttaaatttaatggaagtgttatcatcacataacacttatttggcagcaattgaggagttcaataaagaaagaactgaacccactgacattgtagactataaattagtagatgacctttacatttcgccagctgtaaaacgctcggtttggcaaacgctcagaatattagacgaaataacaaaactcagaggctccgtccctaagaaagtatttgttgaagtagctagaacaaatcgtgcagagaaaaagaaaaccgatagtagaaaagaaagattattacagctatacaaaacaataaaagacgaaggaaggaactggacagaagaaattaaacaaagagatgctggggatttcaacagcaagaaacttttcttgtactacacccaacaaggccgatgtatgtactcaggtgagaaaataaccagtattggtgacttatttacgagcaaatatgatatcgatcatatatacccaagatcggtcactaaagataactcatgggacaacttagtcttagtcaaagcagaactaaaccgcgaaaagaaagacatttacccaatcgaaaaagacacacaggacagatgcataagcctatggaaacagcttctcgaacaaggactcatatcagaaagaaaatacgaaagactggtcagaacaaccccactaacagcagacgaactagcagactttgtgaataggcaactcgtagaaacaaaccaaagtgtaaaagcagttaccaatttattaaaaagactgtacccagacaccacaatatgctatgtaaaagccgaaaatgtatccgacttcagacaggaaagagaatttgtgaaacttagatcactaaatgcacaccaccatgcaaaagatgcctacctcaatatagtcgttggaaacgtataccatgaaaaatttactaacaacccacgcaactttattaaaaatgcacggtcagacaagaaaagaccttacagcctaaatcacatgtttgattatctcctacaagtaggtaataaagaaatatggaatcccaaaactgataataatctcgtcaagaaaatgatgcgaaataatgatgtacaagtaactagaatgctcgtagagcaaactggcgcactgtacgatgcaacaatatacaaggcttcagtgacaaaaagcgaatcatatgtaccactaaaatcatccgatgccattttatcagatgtaaagaaatatggaggcttcacatcaatcaaaattgcatattattcgatattcaggttctacaagaaaaactcagaagaatttgagacacatataataagcatacctgtattaaaagcaggcacactcaatagcaaagaagattatgtagcttacggagaagagataatgaataaacaaaaattcgacagagtagagctagtttataagaaattatgtatgaactcactcgtacgaataaacggtgttatgtattatctaggagggaaaaccaataactcactttatatagattcagcaatcagcctagtactgccagacaatatagcaaagaaaataaaagccgtagaaaaatatatagcacgtgtcgcagaaaacggcaattataaaccacagccagaccaagtctcacctgagttcaatatgattatatataaggcattaacagagaaaatgaaacaacccgcattcgtaggattgaaaacaaatcgggaaaatgaactggaaaaagaaaccacaataacagcctttatagcaatgacactaatagaacaatgtaaaatgctaatggaaatactaaatctactcacacaacagaaaacaacatatgctctaaaaccaatcggtgtgtcagcatcaagatctacactaggaatgaatataacaggtttaagcgaatttacaataataactcaaagtgtcacaggtttacaagaaaaagaaataagaattatctga

SEQ ID NO: 5309 - RNA, 4026 nt, synthetic construct
  misc_feature 1..4026: note = Cas9 variant
  source 1..4026: mol_type = other RNA
atgtggggatcccgactattcgaagaagcatccacagcccaagaccgcagagaacacagaagcaacagacgacgtctagaaagacgaaaatatcgtctggacctgttagaagaactatttgtagaagaaataaacaaaatagatccagaatttttcattagactaagggaaagtaaatttcatttcgaagatagatcacttaaaaatacatttatactttttaacgacaaaatggaaggaggttacaacgacaaagtattcttttcaaaataccctacaatataccacttaagaagtgcactaatcaatggaaacaaagaagacgtcagagcagtgttcctagccattcacaatatactcaaaaaccgaggacatttcttactagctggaaacgatataaacatttcactatccctgaatgatacgttaacagatttattcgaatatctaaaaatacacctaggaatagaagtagagttcgaaaataaattaaaagacatcgagaaaatagccctagacaaaaatctatcaaaaagcgataaacagaagaaaatagtacaactactagaaacagactataagaaacaattagctgatgtattcaaactatcattaggtctgacagcaaacatggaaaacatatttggcaaagaaaacgaacaaggcttagaatttataaatgccgaaaataaaatcaagaaaatacaattcgacagttcatacgaagaaaatattgcagaatttgatcaattctacggagaatatttcgaaataatagacatttgtaagaaaatatatgatgcaatatctctctctcaaatcctagtagacggtaaaggcctctcagaaagcaaagtgttatcgtacgaaaaacacaaagaggacttaaaactactcaagaaagtgctaaagaacatagacaaagcgtatgataacaaaggagaagacagattagtatacaaagttcttaaagaagacaaagataaaggaacgaactacgtaaattacagtaaattatcaaataacggaacagcaactacaaaagaagagttctacaaattcctgtctaaaaacctggatcttaagaaatttggaaaactaaacaaagaagatatagaaaccttagattacataaactcagaaatactattaggcagattcctacctctacaaaaagagaaaatcaacggagtaataccatatcaattacaaatgaaagaacttacccaaattctaaacaatgcaagcaaatacctaccattcttaaacaaaatagaagatggaatgactgttaaagacaaaataatatctttaattaaattccgtataccatactatgtcggtccgctcaacgaatataacagaatcgaaaacggaaacggttttgcatggatagagaaaaagaaaaatgagaaaatctttccctggaactttaacgacgtcgtcgatatagaaaaatccgcagaaaaattcattaacaacttgacaaataaatgtacctacataaaagaagaaaccgttctacccaaaaacagtataatatattcaaaatttatggttcttaatgaactcaacaatttacaatacggaaacaagaaactagacatagaactaaaaatgaaaatgtatactgacctttttcttgaaaagaaagacaatagaaaagtaacagagaaaagaatccttgaatatttcagaataaacggcataaacgatggaaaagaaaaactaaccggactaaacaacgaaatacatgcagacatgaaatcctaccgagacatgtgtgaaataatgggagaaaacttcaacataaatgtcgcagaaaatataatcaactggataaccgtatttcacggtgagaagaaaatacttattaataaaatcaaaaatgtatacggcaaaatgttcaacgacgaacaaatctcaaaactatccaaactaaactatagtgattggggacgactcagcaagaaactactcacagacataaaatgttatatagatgcagacggtataaatttccctgtatcaatcctggaagcaatggaagtctccaacaaaaacctaatggagttactctcaaacaaatatgagttcatatcatgcatcgacgacataaacaacaaatacttcggagatagggacatatctgcaagcgaactcatcgacgaactatatgtatcaccagcagttaaacgaggtatatggcaatcagtacgcattttagaggaaatagtaagcatcataggacacaaccccaagaaaatattcatagagatgacccgacacaatgaagaaaaagttcagaaatcatcaaggcgtcacaatcttgaggaactctataaagccatccgcaaagacccagaatacgtagaactgatcaaagaatttgatagcactactgacacagattcattcaaaataaagaaattatatctatatttcatgcaacttgggaaatgtgcatattcaaaagagaaaatcgacttcgacaaattatttactgattcctacgacattgaccatatctacccaagatctaaaacaaaagacgactctatacataacaatctagttttagtcaaagcaaaatataatagagagaaaactgatgtatacccaatcgatataaatatccagaaaaatatgaactcattttggaatttcctttacaccaagaaattcatcacagaagaaaaatataaacgcttgatacgtacaagcgacctaacagatgaagaattggcaaaatttataagtagacagctagtagaaacgagccaaagtaccaaagcaacagccgaagtactgaaacaaatatatggagacagtgacatttgctacgttaaagcagaaaacgtttcagatttccgatatggaagctcccgtcaaaaagataaaaatgatatacaaaaactatttgttaaatgccgtgaagttaaccatttccatcatgcgaaagacgcgtatttaaacattgttgtcggaaacgtgtacgatgtaaaatttaccaaaaaccccgtcaacttcatcaagaaaaacaaaatgggcaacaaatcgaattattctctgaaccacatgttttgtttcgacgttgaacgaaacggatacaaagcatgggattcttccgaaaccataaaaacagtaggcagaatgatgaaatcaaacgacgtgagaattacgaaacatgtccacccaacaagaggagaactgtacgatgcaaccatatacaaagcaaaaattgcaaaaactggctcatacatgcctttgaaatcaagcaaaaacaccccactgagcgatgtaacaaaatatggaggatacacaaaaataaaaatcgcctattactccgtatataagtacaagttcagtgacaaaaacctcatcaaaaccgaaataagactgataccaatcccaatatacctaagcaaaaacgacgatgacataaaagaatacgtcaaaaattacctaaacgacagggttaattcaaaattaatagacttcacaaaaatctacgataaattatacgttaattcactaataaaaataaatggatatttatattaccttggcggtaaaacaaatgatagagtctggatagataacgccgtatcaatagtcttggatgacaagatagagtacctaataaaaaggatatcaaatgatataaaatatgggtacgaaataaacgtgagtgatgacgaactaatggacatctatgaatcactcgcagaaaaagcgaacaaaaagatattttacaacagactttcagacttcgaaaagatattctcaaatatggatgtcaaaaagaaattcgtcaagctagagaaaaacgacaagtgcagggtattactccaattacttaacgtattaacagacagccaaacaacatacaaactggagatggtaggattgaaacattcaaggagtaacataggaatgaaaatctcaaacttagaagagttcaaagtaataaattccagtataacaggactctattcaaatgaaatagatattttaaatatatga

SEQ ID NO: 5310 - RNA, 4026 nt, synthetic construct
  misc_feature 1..4026: note = Cas9 variant
  source 1..4026: mol_type = other RNA
atggaaaaagattactacttaggactggatatgggatccggatcagcgggatgggcagtgactgacgatcaatatcacgtactaagagctcacggaaaagcaatgtggggtacgcgcttgttcgaaagcgctaataccgcagaagaacgtcgaataaatagaacagcacgaagaagactaaaacggagaaaccaaagaatagaatggttacaagaaatatttgcggaagaaattaacacaaaagactctgggtttttccggcgaatgaaagaatcgagatactgggcagaagataaacgagacgaaaatggaagttgcccagaaatgccatacagcctattcatagatgaagactttacagataaagaataccatgaaaaattccctacaatatatcatttaagaaaatatttgatgacaacagaagaaacaccaggaataagattagtctacttagcctttcaccacatgatgaaacatagaggacactttttacttaacggaaatatagaagaaatacgaaaatttcgaaaaaccttcgatcaattcttagaagtagtcagaaacgaagaaatgggattcgcaggcgaaatagaagaagaaacatataagaaaatagaaatgactttgaaagacgtaaatttaactcggtcagccaagaaaacaacattaataaagagcttaaaagttactagagttgaagaaaaagaactactagcattaataagcggatgtacggtcaaactatcaaatatatttaatgataaatccttagatgagacggaaagaccaaaaatcagttttgcagacgctggcttcgacgactatgaagcagagatacaaagtaaccttaacgaaaaatactacatcatagaaagcgcaaaagctgtatacgattgggctgcattagcagatatattgggggaatacagttgtataagcgaagcgaaagttgcactatacgaaaaacatcataaagacctcaaaagattaaaagacctagtaaggaataacatctcttcagaagtatataaagaaattttcgtcgacgtcagtggaaaatacaaaaattattgcgcctacatcggaactacaaacattaatggcaagaagaaagatttcgaaggcaagaaatgcacaaaagaggatttctacgcctatctcaagaaatcagttatagaatgcataaacgatagcgagaaaacagactggctcaaactggaattagaaaaaggaaacttcctcccaaaacaattgaccggcgaaaatagtgtaataccctaccaagttcacctttatgaactcaacgcaataataactaacctccaagaaagaataccattacttaaaagagacggagagaaaattcgacaaatattcacatttcgtgtaccatattatgtcggcccattaaacggaataagcatagatgggaagaaaacaaactgggtaaaacgaaaagaaggtgtgatttacccttggaacttttcagacatagtggacgaagaaagctcagctgaaagtttcataaggcgaatgacaaacaaatgtacataccttatacacgaagacgtgctacctaaatattctttactatatagcagattcgaagttctcaacgaattaaataatgtcaggttaaacggggaactattaagtgtagagctaaaacagaaaatatacgaggatgtatttcaacgttatagaaaagtcacgcagaaacgacttaaacgatacctcctaacagaaggaataatagacgaaaacacagttataacaggcctagacggcgatttcaaaggtagtttaactgcatatcacgatttcaaagaaaaactcaccggattaaatctaactgaacgtgaaaaagaagaaataattttaaatatcacgctattcggggatgcgaggagcttattaagaaaacggataggaaaaatatgcagtcaactatcagacaaacaaaaagaaaatcttagcaaacttagctatcaaggctggggtagattgtccaagaaatttttaaatggtatagcgatcagcgtccaaggagaagaagaatggacaattattaaagcactctgggaaactcaagataacctgagtcaactcatgggtgcaaaatatacatttagaaacgcagtagaaaaagagaacggagaactcgaaaacagagaaattagttatgaaacagtaaaagacttatcaataagcccatctgtaaaaaggcaagtctggcaatcacttctaatagtgaaagaaatatgtaaaatccagaagaaacctccacgaaaagtattcgtagaagtagcaaaagagaaaactaacagtggtaggacggaaagtaggaagaaaagacttcaagacttttataaatattgtagcaaatacgaaaaagaactatacgatgaaagcatccaaaataaattagaaaaatgctcagaatcagatctaagatccgacaaactattcttatactacatgcaaatgggacgatgtatgtatactgggcaacccatcgacttcgatgaactctggaacaaccaaaaatatgatatcgatcatatctacccacaaagtaaaaccatggatgattcaatagacaacagagtcttagtaaaaaggatctcaaaccaagagaaaacagatgtgtatcccataagagcagatatccgagaaaagagaagaggtttttggaaagaactcaaaaacgttggcctaattagtgaagaaaagtataaacgactaacaagagctactgaatttgaaccagcagaactagcaggcttcatctcaagacaattggtagaaaaccgacagaccacaaaggtagtcgcaagcattttgaagcaagccatgccggacaccgaaatcgtatatgtgaaagcacgaaccgtatctgaatttcggcacaaattcaacttcataaaagttagagaaatgaacgacttccaccatgcaaaggatgcatatctcaacgttgtagtgggaaacacatacctagtaaaatttacaaaatcacccgtaaattttattgagaaccactcaaaccgtagctacaatctaaagaaaatgttcacagatggaagagtagaacggaatggcgaaatagcatggatatccggagaaaatggtaccataggcacagtaagaaacataatgaagaaaaacaatattctcgtcacgaggagagcacacgaggcgacaggcgggtttttcgaccaacaactaatgaagaaaggaaaaggacaagtgcctgtaaaaggtagtgatgaaagactgctagacattgaaaagtatggaggatataacaaagaaacaggagcatacttcgtcttagtcgagagcgacgagaagaaaggcaaaaagaaaagaacaatagaatatgtaccgataagactcaaaaagcaactagaaaacaatagaaaagcactagaaaactacttatgtgaacaaagaggactaacaaacccagtcgtattaatcgacaagataaaaatggattctttattccgtgtagatggcttcttcatgtggctatccggaagaaccggaaaccaattactattcaaatgtgcgaatcagctagtcttgtctaccgaagacgaggcgacattaaagaaaatagtaaaatttgtaaaccgacgaaaagaaaataaagagataaaaatatacgaaagtgataaactaaacgaagaaatgttaaacagactatacaacacattcctttacaaacttcaaaattcaatatatggaaaccggttaggcgagcaagctaaaacactatctagtaagaaagaaaattttgacaaactgcagattgaagaaaaatgcctagtcctatacgagattttacatatgtttcaatgtcaaagtgcaacctccgacctacaactaatagagggaccaggcaaagcaggaacactaaggttaaattcgaatataactaaatacaaaaacatcaatatcatcaaccaatcaccaacgggaatatacgagcaagtaatagacctacagaaaatatga

SEQ ID NO: 5311 - RNA, 4026 nt, synthetic construct
  misc_feature 1..4026: note = Cas9 variant
  source 1..4026: mol_type = other RNA
atgggcaaaggttattacgtaggcctagacatgggtactggaagtgtaggatgggcagtaaccgatgaatcataccaaatactgcgacgccacggaaaagccatgtggggagttagattgtttgaaagcgcaaaaaccgctgaagaaagaaggatgttcagaacaggaagacgaaggttagacagaagaggttggcggatagaaattcttcaagaaatatttgcggaagaaatatcccgagtagatccaggcttctttcttcgaatgaaagaaagcaaatactacccagaagataaaagagatatacaggggaactgtcccgagctcccttacactttatttgtcgacaaaactttcacggacaaggacttccataaaaaataccccacaatctaccatttaagaaaaatgttgatggaaacagaagacacaccagatatgagattagtctacctagcgctccaccatatgatgaaacatagaggacactttttattgagcggagatatcagccaagtaacagaatttaaaaacaccttcaaccagttcatagaaaatataagaaatgaagaaatggactttgaaattgaattagacgaaagcgccgtgcagatgatagaggaaacattaaaagataaaaacctcacccgatctgccaaaaagtctaaattagttaaaggtctcaatgctaaaaatgtccgagataaagcattcttaacgcttttatcaggaggaaccgtgaagttatcagatctattcggaatggaagaactaaacgaaggtgaaaggcccaaaataagtttcgcagacaatggttacgaagaatatgccgctgtggtagaaatggagttaggagaattatattatatagtagaatcagctaaagccgtttacgactgggccatcttgtcagatatcctaggaggctcaacatcagtaagtgacgccaaagtccgagcatatgaaaaacacaaagcagatttgaaatacttaaaagcagtagttaaagaatattttcctaaggaagtgtataatgcagtatttgtagaatcatccgataaactgaataattatccggcgtatatcggaatgacaaaaaaaaatggaaaaaaagtcagcctagaaggaaaaagatgctctagggaagagttcatggattttctgaaaaaaaacattgtggttaaattaccagatgaggaggcaaaaatgtatctgcaaagtgagctcgaaaaagatagtttcctacccaaacaagtaaacaaagataacggagtaataccataccaagtacataaatatgaattaaaaaaaatactagataacttaggggataaaattcccttcctaaaagagaatgcagaaaaaatagagaaattgtttagttttagaataccgtattacgtgggaccactaagaacaggtaatggagaaaattccaaatttgcatgggcagaacgaaaatcaacagaaaagatatatccgtggaactttgaaaacgttattgacgttgaacaatcagccgaaaacttcataagaagaatgacaaacaaatgtacctacttaataggtgaagatgttctaccgaaagatagtctactctacagcaagtttatggtattaaacgaattaaataatttaagacttgacggacaaaaaatatcagtcgagctaaaacaaaaaatatatagagatgtattttgtagatcacgaaaagtaacacaaaaaaagttaaaatcgtacttaataagggaagggatcgctggaaaaaatgtagaactaactgggatagacggagactttaaaggatcgctaacggcatatcatgattttaaagaaaaactaatagacgttgaactgacccagaaagaaaaagaagagataatattaaacattgtgttgtttggagacgacaaaaaactcctgaaacaaaggcttaaaaaaaaattcccacaattaacggaaaagcaaatcaatacagtaacagccttatcatacaaaggatgggggagactttcaaagaaacttctggaagaagtcactgtacctgctcccgagactggagaagtatggaacataataacggcattatgggaaactaatgacaattttatgcaactacttagcaaagaataccaatttagtgatagaatagaagagtttaacgaagaaaaagcagatcctgaagtatcatatcagacgatcgaagatctttatgtaagtccagcagttaagcgacaaatttggcaaacgttacaaataattcaagaaatagaaaaagttatgggtgagaagccaaagcgtgtttttgttgaaatggcccgcgaaaaacaggaaaacaaaagaacagaaagtagaaaaaagacgctatcagatctatatacaaaatgtaagaaggaagaaccagaatggatagaagccttatgtacatctctagaaaaacatgaagaacatcaattgagaagcgacaaactatatttatattatacacaaaaggggagatgcatgtactcaggggaaccgatagatctagaagacttatgggacaatacaaaatatgatattgatcatatatacccccagtcgaaaaccatggatgactctctaaaaaacagagttctagtaaaaaaagaatataacgcaaagaaatcggacacatacccgatagcggccgatatacagaaaaaaatgatgcccttctggaagtccttactaactggaggtttcattcctaaggaaaaatacgatcgattggtcaggaataatccactagatgcaaacgaactagcaggattcatagagcgacaaatcgttgaaacgagacaaagcacaaaagctgtagcagaaatattaaaaaaaatactacccgatacagaaatagtatatgtcaaagcgaaaacagtatcaaaatttagacaagacttcgatttcataaaagtgcgagacatgaacgatctgcaccatgcaaaagatgcctacctaaatatcgtcgtaggaaatgtatactttgtaaaattcactaagaatgcagcttggttcgtgaaagaaaatccaggcaggacatacaacctcgaaaaaatgtttatatgggacgtagctagagacggagaaatagcatggaaggctggaaaaagtggaagtattgtacaagtaagagcaatgatggaaaaaaatcacatcctagttacacgtcgaagttacgaagtaaagggagggctatttgatcaacaaatattaaaaaaaggaaagggacaagtaccagtgaaggaatcagatgagcgactcagagacataggaaaatacggaggctacaacaaagctgccggcgtatactttatgctagtaagtagtaaagataaaaaggggaaagaacaacgaaccatcgaatttgtaccaatatacttgaaagatagagtcgaaaaagatatggaaagtgcaagaaattatttgatggaagaaaggggattacgagaacctaagattcttattaagaagataaaaatagatacattattcaaagttgacggattctatatgtggctaagtggaagaacatccaatcaattaatttttaaaggcgcaaatcaacttattttaagtaaagaagatatgaaaacattgaaaaaagttgtaaagtacatacaaagacaaaaagaagacaaaaatgtaaaaataagtatgcgagacggaataactgaagaagaattattaaaactttacgaaacgtttctagataaaataagacatagcatatacggagcaagactatcttcacaggaaaaaacactggtaaacggaaaagaaaagtttatagacttatcagtagaagcaaaatgtcaagtattatacgaaatactccatttattccagtgccaaagcggagccgcaaatctaaagatgattggaggacccgcatcagcaggaattttagtaatgaataataatattagtaaatgtaaaaacatcagtatagtaaatcaaagcccaacaggaatatatgagaaagagatagatctactaagagtatga

SEQ ID NO: 5312 - RNA, 4026 nt, synthetic construct
  misc_feature 1..4026: note = Cas9 variant
  source 1..4026: mol_type = other RNA
atgacacaaaaagtgataccttataatattggacttgatataggcacaaattccgttggctgggccgtaacggacaacgaaaacaaattgttgcatataaaagggcacaacgggataggcgtacgtctcttcaaagaaggccagagtgcggccgaaagatgcggcttcagaacaacaagaagacgtctcagtagaagaaaatggcgattaaggttacttaatgaaatatttgccgacaaaatagcaaaagtagaccccagcttctttgcaagacttaaacaaagcaatgtttcaccaaaagatcccaacaaaacaatgtttggaaatattctatttgataatgggaaccttaacgacaaatcttttcacgatgaatataaaacgatatatcatttaagacaatcaataattgaccacccagaaaagaaatttgacataagactcatttatctagcaatgcatcatataataaaatacaggggacattttctcaaccaagccaatgtacaagatttcaaaggcggaaaaatagacctagaagaatcattcaaagatcttaatagcatctttgaaaaccagggccgagatctaaggctagtcacagaagatgcaaataaatacgtaaaagaattatcagacaactctaaaactcgaaacgatcgacaaaaagagctatcaaaagtcttgtacattcctatagacaaaaactccgacaaaaataataagaaagtcactacagaaataataaaagcaatacttggaatgaaagcaaaattcgatgtaatcttcggcattgatgccgagaacgctaaagaatggagtctaacctttaactcagatgattttgacgacaaaatagaaggcttgtctgcgcaaatgacagatgaagccggagaaattctattaatccttaaagaactatacttcgcattaaatctaagcgacatcttaaacaactcagtgactgataaaaatgcaaaaaccctatctgaagccatgattaatagatatgatgaccacaaagaacagttaacaatgttaaaacaagtgatcgataattcagacaagaaacatgctaaagcactcaaagctgcttactccgcatacattgatggagaaaataataagaaaattagctttgaggatctccgaaaacgaatccagaaaaatttagataattcagaaacatcaaagaaaatcaacgacctcctagaacacgattactttcttcctaaacaaagatccaaagaaaacggcgccataccacaccaactccaacaacaagagctcgataaaataatcgaatcacaaaaacattattatccctttctcgctgagctcaatcctaacgagaaaagatcaagacaagctaaatacaaacttgacgaactcgtagcgtttcgcgttccatactatgtcggacccatggtaaaagcaacagaaaacaaccaaagcaataacggaaaatttgcttggatgattaaaaatgacaacatatcagataaattaaagaaagaagaaataactccatggaactttgacaagaaagtagaccgtacggaaacagcaacaaaattcataacccgaatgacgacaacagacacataccttataggagaaccagtacttcccaaaaactccctgctctaccaaaaatttgtagtattaaatgaactaaataacttaaaaataaacaaacaaccaataacaccagaacaaaaacaatacgtatacgaacacgttatgaaacaaaccaaaagagtaagtctgaagaaaattgcagatgcactcgttattaaaggagactatccctacgcaccagaaataacgggaaccaccgatcagaaaaacatgaataacggattaagtacatatatagacctcgcaaaaattttcggagacgaattagatgatatcgacagaaaagaagacttcgagaaaattatcgaatggtctaccatttttgaagaccaacacatattcgcgctaaaactcaaagaaatcaaatggctcactgaagatcaaagaaaacaagttgtcaaactaagatatcaaggctggggaaaactaagtaagaaattactagccgatttagtggacgataacggtcaacgcataatcgacctactttgggactcaaaacaagatttcatgcaaattgtaaaccaaaatagcttcaaacaagcaatagcagaacacaatggagcacatcttgaagaaaaagatctaaaagatatcataaataacctatacacatcccctcaaaataagaaagctatacgacaagttatactcgtagtagacgacataatccgagcagtaggttacgaaccggtaaatataatgatggagttcgcacgagaagacagtaaagaccacaggctaacaaatagtagatcacgccaattagaaaaagtctataaagatataactaattcatggttcgacgatgataacgtaaaagacgaacttaaagacaaaatcaaagataaagccaaatttactgacagattatacttatacttcacacaagggggtaaagacctatatacaggagaacccctagacatagacaatttatccaactaccaaatagatcatatacttccacaatcgtttatactagacaattcgctagacaaccgagtgctaacctctaaaataaataatcaaataaagaaagacaatctaccaggcgaatttttcgggtcaaaaatgcataacttctggaaacacttaaaagaacttcacctaatctctaacaagaaatactacaatctaacgctaacacccaacagtatatctaaattcaataatcaaggtagatttattaaccgacaactcgtagaaactcgacaagttataaaactagcagcagaaatcctccacaatagatactcagaagaaaatggcacaaacatcgtcacagttaaagcgaacctcacacaccatatgagagaaaaattcaacttttacaaaaatagaaacgtcaacgattaccatcatgcctttgacgcctacctcgcagcatttgtaggtaattggctattacaacaatacccaaaactcaaaccctacttcgtatatggtgacttcgctaaaacagaaattgataacctaaaatcctttaacttaatatacaaatttgaacaagcacatcaacttaacgaagaagacggtaaaattgccaaagatacagatgcactcctaggctacatgaaaaacgtctaccattttaagaaaatgcttgtaacaaaagaactggaaaccaatcacggtaacttattcaaacaaaccctatacccgagccatggtaaaatgaaaaacctcatcaacccaaaagaaaaccgctcatctgacatatatgggggctactcaagcgaaacaggcgcctatgtttcactaattaaagtctttaagaaaaacaaaatagaaaacaaaataataaaaataccactactatacatcgataaactgaaccgccaagcaaacgcaaaacaatttatacgcaatttcataataaaagacgactccaacaaattcgacatattaagcgagaaaatatttttaaatcagctagtaatagacggagatgaactcttcactatatccggatcaggagatcgacaaaatgcacaacaactaatactatcagacaaatctcttaaaattctatccaaaaacataaacgtaatatccaaaaatgatcttataataatattcaacgaaattatcgatgatatatgtaaatacatgaaaatgtacgaagtagaaaactcagacgaaactaaagcaaaattcgaagaaatcaacgataaagaccgaatgttaaaaataatcaatgacctcttattaggccttcatgccaatgcctcaagatcaaacctttcgtccataggattgtctccatcattcggcagatttttctcaggaaacgcaggaataaaattatccgaaaacgccaaatttatttaccaaagcccaacaggattattttctcgaaaagtgaaaatatcagacctttga

SEQ ID NO: 5313 - RNA, 4032 nt, synthetic construct
  misc_feature 1..4032: note = Cas9 variant
  source 1..4032: mol_type = other RNA
atgacatattatttaggattagacatgggaacatcgtcagtaggttgggcagtgactgacgaaaattacaatttaatacacaggcatcggaaggatctatggggaataagggagttcgaagaagctaagacagcagtagaacgacgtacacaaagaatatcaagaagacgaagacagagagaagtagcgcgaataggactattaaaagattactttcatgacgagatacaaaaagtagatccaaatttttaccaacgactagacaatagtaaatacttcccggaagataaagaagaggtagtcaaaggcaaaaatggaatattcgcagatgaaaactacactgacagagactatttcgcagaatatccaacgatattccatttaaggagggaattgttgaatagcaaagagccgcatgatgtaagattattatacctcgccttactcaatatgtataaacacagagggcactttttaaataccacactaggtaccgacggagaaaacagaaaactttcagatgtatacagagattttgtggtcaaaactgaggaagttctcggacttacattcccacaggaaactgataacggaaaaatgcaagagataatgtgttcgagagagttctcgagaaagagaaaagcagaattactatgcgcgctactagaaatagataaaaagcaaaaacaacaagtagcattaattgaatgcgtattaggattagataagtcagttaaacaaatgtacggtacagcagtccctgatgattttgacaaaagcgtaaaagtcaatttttccgacagttcattcgaagaaaaagtcagtgaagttgaagaactgctcgatgaggagaaatatgaattaattttgtgtatgaaagaactgtacgatacagcagtcttaaatcaaataatgggagattgtaattatctcagcgaagccagggtacaagaatatgagaaacataaagaggacctgaaattgctgaagaggacagtaaagaaatatggaactgcagaagaataccaatttcttttcagaagctcagagaaggcttcctacaacgcatatgtccattctgtaaattcaggcgaaaagattagacgaaacatggatggaagatccagagacgatctctatacagtactcaagaaaatgctcaaaaattatccacaggaagatgccgactgtaaatatattctagaagaaatagaaaaagaacaatttttaccaaaacaattagtctccgataacggcgttattccgaaccaaatacactataaagaaatgaagaaaatcttagaaaacgccgaacaatacttacatttcttacgagaaaaagacgaaagtggctacactgtcgccgaacgaatattaaaattatttgcttttcaaattccatactacataggacccaccagcgaaaaatcagggaaaaacggtggaaacggttgggtagtaagaaaagaacaaggtcaagttttaccatggaatatcgaagagaaaattgatatgaaagcaacttcagaaaccttcatatcaagaatggtaaggcgttgtacatatctcagtgacgagatggtcttaccaaaagcctcattggaatacgaatcattctgtgtgttgaatgagctaaataacctaagaataagaggagtaaaactaccaataacagtaaaacaagacatatataaagatttatttgagagagggaaaagagtaaccagaaaacaaatagtaaactatcttaaaggtgtaggaattttacaagaaggtgaagaagacgaacttaccggtatgatggacacctttaactcatcactagcttcatacggtaaattcaaatcaatactaggcgagaaaatacaagaagacagttgcaaaagaatggttgaacaaatcatattttggtgtacaatatatggcgacgcaaagaaattcctaaaagaacaacttgaagaaaaatatggagatgtcctaaccagagaacaaataaaaagaattttaggatttaaactaaaagactggggaaacctttctaagaaatttctagaactaaatggatgcgaccgaaatacaggtgaagtaatgtcactaatacgaatgctatgggaaagcgacgacaacttaatggagcttttaaaagactcaagctatacatatcgagccgaattagaagaacaacaagaaaaacttaccaaaactctcacagaaatatgtccagaagacctagaaggttattatttttcagcacccgtcaaacggatgatatggcaaacactattgattctgaaagaagtcgaaaaagttatgggagagcccccgaaaagagtatttgttgaaatgacgcgggaacatgatgaacgcagggaaatgaaagattcgagagggaagaaattccaagaattgtacaaaaacataaaagatgaagaacacaactggaaagcggaaatagaagatgccgagaaagacggaaggatcagaagcaagaaaatgtatttatatctaactcagagagggcgatgcatgtacacaggaaatcctatagatctagaagaattattcacaaccaaatacgacatagaccatatttacccacgacacttcgttaaagacgacaatttagacaataatttagtacttgtggagaaagagaaaaatgcacacaaatcagaccaatatcctctaggcgatgacatatacacgggtcgattgagctggtggaaagaattacacagagaaaaattaatcaacgacgaaaaatataaacgccttacagggagagcaccattttcagatgaacaaaaagcaggatttattgcaagacagctagtagaaacatcacaaggaaccaaaggagtcgcatcaatacttaaagaagtattaccagaaacgacaacaatagtctacgctaaagcaagaaacgtatctgatttcagaaacaccaacgaattactaaaagcgcgatcagtaaatgatttccatcacgcacaagacgcatatttaaacatagtggtaggtaacgtctattatgtaaaatttacaaataaccctctcaattttgtaagaagcggtgaaggatacaatctagatggtgtatttcgcaaaaatgtcataagaggccaagaaaatgcatggatagtaaaaccagagaaaggagagaaaatgacactggaaactgtcaaaagagtgatggctaaaaatacgcccttattaactaggctatcgtttgaaggacgtggaggattagcaaaccaaacactctactcagcaaaagaagcagcaggcgaaggttacgtaccattaaaaagtagtgattcaagactacaagacgtaactaaatacggaggatttacttcggtgactaccgcatactttattctagtagagcatgatatgaaaaagaaacgcgtcagaactatagaaagcgttcccatactttggaaagagcggatagaaaaagaatctggccaactagaaatttattgccgagaggcattaggcctagtaaacccagacataagggttcgaaaaatactgattcaatcattagtaaagaaagatggattttacatgcacctaagcggaaaaacaggtaaccgattcataatgagaaacgcggtagaattatgtttgaaacaagaatggataaactatagtaaaaagctagaaaaagaaggatgtgatgagtcaatcacaaaagagaaaaacgaagaattatatgaaattttgaaggagaaacatattaacggaatatacagaaaaaggccaaacccaatgggagagaaactgcacataagacaagaaacgtttagaatgttaactttagaggaacaaaagaaagtactactcagtttactcaatctaacaaaaataggacctgtcgaagccaacctggaattgataggggaatcagcacacaccggcaaaatgctaataagcaaaaacataacagaagtaaaggaattttacttaattcatcaaagtgttacaggcatatatgaaaagcaagtaaacctactaacggtatga

SEQ ID NO: 5314 - RNA, 4032 nt, synthetic construct
  misc_feature 1..4032: note = Cas9 variant
  source 1..4032: mol_type = other RNA
atggctaccaaaaaggaatacaacataggtctcgatatcggaactacttctgttggctggagtgtagtagaaacagacaatcaaaaagtaatgagaaaaggaaataaggcattatggggagtaagactatttgaggaagccacaactgcagagtcaagaagaatgcaacgaagcacaaggcggaggtatgatagacgaagagaacgcattaaactacttcaagaggaattttcggaagaaataaacaaagtcgacaagaacttctttcaaaaactcaaggagagtaagtatgtagaaaatgataaaataaataaaaaaatcgtactaacaaaagaagaaaaacaggaattaaaggactatcaaaataaatataaaacaatctatcacctaagagatgaactcataaacaatcctgaaaaaaaagacattaggctcgtatacctagcaatacatcatataatcaaatatagaggaaactttctctatcaaaatgccaactttaatatagacaacctagacataaaggacaagctaaatgaactattttccatcctaagcaacaacatacaagaattagaaataccagaagactacataaacattattgacttcgacgaactagaagctgacttactaaaggacaccaagaacgatgtcaaggctctactcatagataatctaaccgaattaactaataaaagcagcgcgacagaattcggtaaattaatggtaggaaataaaggaaatataaacaaattattaatgctagaaacagacaacaaaatcgagatatcattttcaggcacagactacgatgacaaatacgaagaataccaagaagcactaggagaaaatatagaaatcttagatatattgaaacaaatatatgactgtattttcctcaagaaaatattcaaaggaaacaaaaacactagcataagttcactaatggtaaaatcatttgaacagcacaagaaagatttaaacttccttaaagaactatttaaagacaacagggaactgtacaacgaaatattcagaacaaaaaaggatctatgtttatacgaaaaatatatcacgaataaaatagattgcgatgaattcagaaaggaaataaacaaattgctagaatcactgttcagtgacgaaaacataaaacaaaatctcctcgatgaatacaaccttgaagtcaaagaacgaatagaaaacggtactttcttacctagaataactacaaccgataatggcaaatacccctaccaactcaacaaatcagagctaataaaaataatagaaaaccaaggcaaatactatccattcctactaaataaactaaatgacaacaagacttataaaatagtaaaattactggaattcagaataccctactacgtgggaccactagtttcagaaaaaagatcagaaaatagctggctagaaagaaaaatcaataacgtaaaaataaccccatataatttcgatgacgtagtagacaaagaaaaaacagcagaaaagtttattaagagaatgataagtcactgtacgtaccttctagacgaatacgcattggcaaacaacagcatattatacagcgaattcaaagtaatgaacgaattgaaacaaataagagtaaacgacagaaaattagaactaaaattccaacaacaaatactagaagacttctttaaaaagacatccggtacaataactgaacggaaattcaaaaactatttaatcagcacaggggaatactcaatggaaggtggcaacttcagaataacaggctactcagctgacggaaaattcgcaaataacatgcaatcatatgtagattttttcggtgaaaacggaatattcgcggatacagactataacctagaaaatgcagaagaaattatagagtggataacaatattcgaagacaaagacatacttgaaaaaaaagtcagagacaactactcaaaactaaacgaaaatcaaattaaaaaagtgctagcaaagaaatactcaggatggggatcactctcaaaaaaattattgaaaactaaatactataaagataaagcaacagaactatataaaagtattttagatctcatgtacgagaccgacaaaaatttcatgcaaataataaacgacgacaaatataacttccaagaaatgatcaaaaaatttaacaacaaggaggaaaataaaaaactaaactactccattgtcgaagaactcgcaacaagtccagctacgaaaagaggtatttaccaagcattaaaagtagtagaagaattggtagactacataggatacgaaccaaaaaatatatcaatagaaatggcaagatcagaagaagaaaaagttagaaaagatagcagaaaagactatataaataatctatacaaaggttgcaaagattctatagaaaactataaaaagcttaagcatgagctagacagtcatgagatcacatcacagcgattatttctatacttcatccaggaaggaaaatgcttatatacagggacaccactgaacattgaggacatcgaaaaccaatcattatacgaaatagaccacataataccaagatctcttataaaagatgactctatagacaacaaagctttagtacttaaagaatgtaatcaagataaaaaggcatcatatgtattgccatcaaaatttaggaacagcaaacaaaaaacctggtggaaacatttgaaggacaacggattaatgtcggcaaaaaaatttcataatctgataagagaaaaatacaacgaggaagacataaacgggtttatcaacagacaattagtagaaacaagacaaataactaagcatgtagcgaatatactcaataatctatacaaagatactaacgtaatatatctgaaagcagatttatcgcacaactacagagaaaaatacgacttattcaaattcagagatataaatgactaccaccacgcacacgacgcctatctggcggccgtacttggagaatacaaagaacgcttcatgaagagaaaaataaacttcgacatggtaaaggaattgaacagtaaaatagtagaaatggatgaaggaaaaaggagaaaccttcgtttcggctacgtcatcaatagtctagatgaaaacttaaacgatatagtccttaaaatctcagaaaacctcgtagataatgaaaccggagaagtcctctttgatgcacacgaatttaacaaacgagttgaagacaccctatacagaaatgacatactaatatcacgaaaaacagaaattcgtacaggccagttttataaagaaacaatatataaaaaaggtaaggggacaataccaataaaattcggaatgcctacagacatatatggcggctactcaaatactaatgcaaggaaactcatgctaatagaatataatgagtctaaaatgaaaattataggactaccgatggcacttgcggttagaaacaacgatgcagaaataaacgactacatcaagacacaaatcaaccttaagaaaaacagtacctttaagattaaaaaatgtagcatccctttcgaaacagaaataatttacaacaatcaaaatgtattcataaaaggttacagcattggtcacaaaaattgcgaaatctcaaatgcaatacaacttaaaatagccaaagataaaatgaaacattggaaatatgcactacaatacctattaaacgacaaaaaacaatacatcgacttcgcagagaaatatgtaaatgaaatatacgacttcctaataaacctagatctattcccgctattcaataaagaattagacaaaattaaaaacaaagtgaactttgaagatctagcactcgaccaacaaaaaaaaattactaaagaactatttaaaatgctacattgcaactcagtaaacgcgaacctctcagaattcggccttggagacagaatgggacgactctcaggatacaacattacagatggaatcattatctcaaaatcagtaacaggaataagggaatccagatacgagttctga

SEQ ID NO: 5315 - RNA, 4035 nt, synthetic construct
  misc_feature 1..4035: note = Cas9 variant
  source 1..4035: mol_type = other RNA
atgagccaaaacaacaataaaatttacaatataggactcgatataggagacgccagtgtgggatgggcagtagttgatgaacactacaacctcttaaaacgtcatggaaaacacatgtggggcagccggctatttacacaggccaacactgctgtggaacgaagatcatcaagaagcactcgacgaagatataataaacgaagagaaagaatccgactgttacgagaaataatggaagatatggttttagatgtcgacccaactttcttcataagattagcaaacgtatcatttttagatcaagaagacaagaaagattatcttaaagaaaattaccacagtaattataatctatttattgacaaagatttcaacgacaaaacttattacgataaatatccaacaatataccacttaagaaaacatttatgcgaaagtaaagaaaaagaagacccaagactaatctatctagccctacaccatatagtaaaatatcggggaaattttctttacgaaggtcaaaaattctcaatggacgtatctaacatagaagataaaatgatagacgtactccgacaattcaacgaaattaacctatttgaatacgtcgaagatagaaagaaaatagacgaagtattaaacgttttaaaagaaccactaagtaagaaacacaaagcagaaaaagcattcgctctattcgacacgacgaaagataataaagctgcatataaagaactgtgcgcagcactagcaggcaacaaattcaacgtaacgaaaatgctaaaagaagcagaactccacgatgaagatgaaaaagatatcagctttaaattcagcgacgcaacgttcgacgatgcatttgtagaaaaacaaccacttttaggcgattgcgtagaatttatagatctattacatgacatatacagttgggtcgaactgcaaaacatactaggaagcgcacacacaagcgaaccaagcataagcgctgcaatgatccagcgatacgaagaccacaaaaacgatttaaaactgctaaaagacgtaatacgaaaatacctcccaaagaaatacttcgaagtgtttagagatgaaaaatccaagaaaaataattactgcaactacatcaaccatccgtctaaaacaccagttgacgagttctataaatatatcaagaaactaatagagaaaatagatgaccccgacgttaaaacaatattgaataaaatcgaactggaaagttttatgcttaaacaaaattcgcgaacaaacggagctgtcccatatcaaatgcagctagatgaattgaacaaaatactagaaaatcaaagcgtatattattcagatctaaaagataacgaagacaaaataagatcaatattaacgttcagaataccatattatttcggtccattaaatataacaaaagaccgacaattcgattggattatcaagaaagaaggtaaagaaaatgaaagaatactaccatggaatgcaaatgaaatagtagacgtcgacaaaactgctgatgagttcattaaaagaatgagaaacttctgtacatacttccccgacgaaccagtaatggctaaaaatagtttaacagtaagcaaatatgaagtacttaacgaaattaacaaactcaggatcaacgatcatctcataaaacgtgacatgaaagacaaaatgcttcatactctttttatggatcataaaagtatatcagcaaatgcaatgaagaaatggctagtcaaaaaccaatatttttctaacacagatgacattaaaattgaaggatttcaaaaagaaaatgcatgctcaacaagtctaaccccatggatagatttcactaaaatctttggaaaaataaacgaaagtaattatgactttatagagaaaattatctacgacgttacggtattcgaagacaagaaaatactacgaagaagactcaagaaagaatacgatttggacgaagagaaaatcaagaaaattctaaaattgaaatacagcgggtggagccgacttagcaagaaactactgagcggaatcaaaacaaaatacaaagatagtactagaactcccgaaacagtattagaagtaatggaaagaacaaatatgaacctcatgcaagtaatcaacgacgaaaaacttggattcaagaaaacaatcgatgacgccaactcaacatcagtatcaggtaaattctcatatgcagaagtacaagaattagcaggctctccagcaattaaaagaggaatctggcaagcactactaatagttgacgaaataaagaaaataatgaaacacgaacccgcacacgtatatatagaatttgcaagaaatgaagatgaaaaagaaagaaaagatagtttcgtcaaccaaatgctgaaactatacaaagactacgatttcgaagatgaaactgaaaaagaagcgaataaacatttaaaaggcgaagatgctaaatccaaaattagaagcgaaaggcttaaactatactacacacaaatgggaaaatgcatgtacacaggaaaaagtttagacatcgatcgactggacacataccaagtagatcacatagtaccccaatccctattaaaagacgattcaatagacaataaagtgctagtactatctagtgaaaatcaaagaaaactagatgacttagtaattccaagcagcataagaaacaaaatgtatggcttctgggaaaaactatttaataacaaaatcatctcgcccaagaaattttattcactaataaaaaccgagttcaacgaaaaagatcaagaaagattcataaatagacagattgtagaaacaagacaaataacaaagcatgtagcacaaataatagataaccactatgaaaacacaaaagtcgtaacagtacgggcagacttaagtcatcagttcagagaacgctatcatatatacaaaaaccgcgacataaacgacttccaccacgcccacgatgcatatatagcaacaatactcggaacatatataggacaccgctttgaatcgttagacgccaagtacatttatggagaatataaaagaatttttaggaaccagaaaaataagggcaaagagatgaagaaaaacaatgacggatttatactaaactcaatgagaaacatctatgccgacaaagacacgggtgaaatcgtctgggatcctaattatattgacagaataaagaaatgtttctactacaaagattgcttcgtaaccaagaaactagaagagaataatggtacattctttaatgtgacagtcctgccaaatgatactaactcagacaaagataatacattagcaacagtcccagttaacaaataccgctcaaacgtaaataaatacggcggattttcaggtgtcaactcattcatcgtcgcaatcaaaggcaaaaagaagaaaggcaagaaagtcatcgaagtaaataaattaacaggcattccattaatgtacaaaaacgctgatgaagaaataaaaatcaactatctaaaacaagcagaagacttagaagaagtacaaatcggaaaagagatcctaaagaatcaattaatagaaaaagacggaggcttatattacatagtagcgccaacagaaattataaatgcgaaacaactaatattaaatgaatcccaaacaaaattagtatgtgaaatctacaaagcaatgaaatataaaaactacgataatttagattcagagaaaattatagatttatatagattactaataaacaaaatggagctatactacccagaatatcgaaaacaactcgtcaaaaagtttgaggatagatatgaacaactaaaagtaatatcaatagaagaaaaatgcaatataatcaagcaaatacttgcaacactacactgtaacagctcaatcgggaaaataatgtactcagatttcaagattagtaccacaataggaagattaaatggtaggaccattagtttagacgacataagttttatagcagaaagcccaaccgggatgtacagcaagaaatataaactatga

SEQ ID NO: 5316 - RNA, 4035 nt, synthetic construct
  misc_feature 1..4035: note = Cas9 variant
  source 1..4035: mol_type = other RNA
atgaagaaaacaaacccatacatactatcacttgacattggaacagcttccatagggtacgcatgcatggacctagacttcaatatattaaaataccacgacaaagacgcaatcggcgttctaacattcgaaggagctgatacagcagcagaaagaagaggttttagaacgagtagacgaaggaaaaacagacgaataaaaaggctaggactattgcaagaagttcttgctccattagtcaaaaacccaaactactatcaactactaaaccttcataaatggaaaaactccaacgaagacttcaaacacagatcactgagtgaagttctcaaaatactgggtaaaaacccaaaaacgtatccgacaatatatcacctacaacaagacatacaaaatcacccagagaagaaattcgaaccggaactaatatttttagcattgtaccatttagtgaaatacagagggcacttcttattcaacaatctatccttcgataaaggaaaaacagtagacaatgaagcccaactttctgaactcctagagcaataccaatctataaatccgtacgaagattcaatatcaaataaagatattaacgtgatcgtggacacccttaaagacgaccaactaacacgaaacgacaaaagtaaagaacttaaaaggaatgttagtaaaacccatgcagaactgtttaaaatgctcgtagggctaaaattcaaacaaagcatactattcgaaaacatggaaaatgctgaagatataaaagaatcagcaacagggtccgatgccatatcactaagcgacgactactatgaaaatctatcagagttcttaacagacgaacaacttaatttcatagaatccgcaaatacattctttatgggaataatgctagatcgtatccttaaaggagcaaccagcatatccgcagctaaagtacgagactacaaaatatttaaaaaccaactaaaaattatcaaagacatagtataccaaaacaaatacgacaaatatcacgaatttttcgttacatccaaagaagacatgagagcatatcaagaaaatccggacgcaaaaacctttggaaaattaagtaaatttgaccaatatcttatacaccctaaagatcaatacgcaaaactaatgaaagatctaaaaggaatcgtgcccaagaaatatacggaagtgctaaatttaatcgacgagcagaaatttcttgtagtacaaaatacaacagataatgcaagcataccctatcaaaataacgtattcgaagccgaaaatatcttgaggaatcaacaaaaatactatccagagataactgaagaaatgatcgggaaagtaatcaatctaatcagtttccgaataccttactatgtaggacccctgacaaacaaaaacggacaaagtgacttcgcatggatgataagaaaaagtgacgaacaaacactaccatggaacttcgataaagtaatcgacaaatcaaaatctgcagaaaaattcataagacgaatgacctcaaaatgcacatatttattagaagaagacgttctaccgaaacacagcctcctctatcaagaaatggaagtactaaacgaattaaataatgtacaattacggggcgagaacgagcccaaacatcgaatacaccgtctagatcccaaagtaaaacaatttatatatcacaatctatttcagaaaaagaaaaatgttacacacaaagacctcatcacgttattacaaaattcagaacacagaaacactcttaacaaaacttcgggacaaaaattaaaagtcttcggaacacaaaatgattcaaaatttgcctcaaaattgagtacttacaatgatatgaaagccatattcggttcagttgaaaacaaaagacaaatgatagaagaacttgtactatggataaccattttcgaggacaaagcaattctaaaacagaaaataggagaaaaatacccaaatataacagaaaaacaactaaatcaaatagtaaaactaaattacagcggatggggtcgcttaagcgaaaaactattaaccaaagaagtaaatggacgatcgttaatcgacctaatgtactccacagaaaacaacttcatggaaataatcaccgataaaactttaggattcgattgcttcatcaaaaacagcaataaagtcaaaaacgcgaaaatttcttacaaagacgtagcagaattgagaacatcgccagctctcaagaaaggaatctggaatgccataaaaatggtacgcgaaataagcgatttattcggagcaccagagaaaataataattgaatttgccacagaagaccaagtaaaaggaaaaagacaaaaatcccgatctgaactctgggacgaccttgtcaagaaaaataacttaaaacgaaacaagaaattcaaaggcttatttgaagaacttaaagcctacccagacctagatttttctaatccaaaattatggctatacatacaccaaaatggtaagtgcatgtataccaagaaacctatagatttagaacggttaatgtcagatacaaacaatcagctatatgaaatagaccatatcctaccacggacttttgtaaaagacgattcaataaataataaagtactcgtaatccaaagcgcaaaccagaagaaatcaggagacaaaatgcctctcgaaatattcgataaccacgtgctagtacccttttggaaaatgttatatgaaaacgatctaatatcatcctccaaactgtctaaacttatgaagaaagagttcaatgacctagacaaagaaggatttattcaaagacagctagtggagacacgacaaataatttcacacgtaagtgacttcttaacagaagagtacccaagtacaacggttgtacccatgaaggctaacgtagtttctgaattaagaaggaaatttgacatcccaaaaatcagacaactaaacgattggcatcatgcggttgatgcctacctgaacggattcgtataccaagcagcaagagtcttctacccaaaggtaaacctatttgagttcaatttcaaatgggagaaagtcagagaaaaatggcgccaactaggagagttcaccgaaaataacaagaaaagagagttcttcctattcaaaagaatggaaaattatgtaaacgaacacggagaagggatgatttccaaattaattttcgaccttgataatttcaagttcaactactcaagaaaagtggaaagcactgaatcggctttctacaaacaatcggcatttagccccaaaaacacaacagcacaatacgattcggacaaaaataaaacagcaatatataaagaaatgaaaaacaaaagaggaatcgtagtatcctacacatacgtaaagaaagaccaagaactaataggatacggagtttttaacgaaactgtattcgaatatgtcaacaacgcagacgtagacatgaatacaagagcattaaagatagtacgaaaggcttttccaaaattagacataaagaaagcacaatacttattttcgattaacaaaggagacgcattactcgtaaacggacatccatttctgtttgtatcagcaaaagaacgaattaacggaaagcaactagagtttgacataaatatgcaaagaaggctcaagaaagccttgcgaccatataacaaaatgaccgaacaagaaaaagtaggagtttataatcaatttgcagaaaaagttgtccaagaatatgaaaacagccttggtgcaaaaacaagaaacgaaaaattagaattaatacgaaatcaattcaacgagagtgacaaatctaatgaagcactcatccagtgtattcttgaagtcctcaagatgaccaaagtctctgcagaacgatcagttaaactaaaaataagatgggggtcacaaacacctaatacactaatagacataaacaataaagcaaaaataatgtataatagcataaccggcctcaagcaaacacgactaaaatcaatatataagctagccgaaagcaaaaacgaactttga

SEQ ID NO: 5317 - RNA, 4035 nt, synthetic construct
  misc_feature 1..4035: note = Cas9 variant
  source 1..4035: mol_type = other RNA
atgaataaaaattactacattggactagacatgggtacaaattcagttggttgggctgtaacagatcaagaatacaacctaattaaattaaaaggaactcatgcatggggagctagaatatttcaagaagcaaaagacaaaaaaggtaccagagcaatccgatctagccgtaggagaatggacaggagaaaataccgcatacacttacttaatcaactattcgcacaagagatacaagccatcgacagtaccttcttcataagactcgcatattccgcatattgggaagtcgacaaaaaagacaaaggaatcggacgaaatatactgtttaaaacaaaacaagaagaatctcaattctacaagaaataccctacaatatggcacctacgaaaaagccttcttgaaaaccagccagatgctttctctgatcttagatacgtctatctcgccttccaccacatcatgaaatacaggggcaactttctccatgaaggggagattaaaacaaatgaactacaggtacagcaaatcgaacaactcaatcaatttttaataaacaaatataaagagatatacgacaatgatgtagaagaaagaactttcatagcaaaccaccagatagatgcactaaaagaaatactattaaacaaaaacacaaataaaactacaaaagagaaagaaattaaaaaactattcgactacgcagattgtgaaagcttagaaccatatatctcgtgtttcagcaaactcgccgttggaggaaaatttgatctttccaaactgggatatgaaggcaatattcaattctcagacccgtcatttgaagagaaagcctcaatccttcaagacgatttccgtctaattgctatagcaaaagaaatgtacgattttgtcatactaaacgatttattgaaggatcaacccaatctatcaactgccatggtacacgtgtacgagactcaccgacaagacctcaaaaaattaaaagacataataattgatattgacgctaacaaaggtctccaaaacaatgatcgttggtattttaaactattcaaagataaaaacgcacctaaaaactattccgcattcattcacaaaaacagtaatcaaaaacgaccaagcatagatgaattcaacgacgaaatcaaaaaaatactcatcgaacacagaaacgacgtatcacttgaaaaacaagatgacttaaaaatgttatttgaaaaagtagaaaataagactctcttaaaaacaatagccatacaaagtacatcagttataccccaccaactacacctcgatgaacttgaaaaaatcatagataacgcatctaccaaatacccatttctatcaaacataagagacaaactcgtattgttatttacattcagggtaccatattattatggtccactaaatgataaaagcccctattcaaatgtagagagaaaacagttcgccacagttacgccatggaacttcgacgagatatttgatgaaaacaaaacacgagaaaaattcatgaaaaaactcactaacaactgcacctacttaagcggcgaaactgtcatgccaaaaaaggccctagcctacgaagattacctaatatacgatagactaaatgtcctactagtaaacggagaatacctatctctacaagaaaaagaaaaaatataccactacctcatatcaagacccaaaaccacactcgaccaattgaaaaaagaactagctaaatggcacaaccaatcaccaattgacatcatcttcagcaacatacacgaagaaattccattcgaagcatcatcgcacgcacacctcatgaaatcatttgatctcgaaaagcaaaaagaagaattagaaaggtacataactctagccactatatacgcagatgacaaaaagtccctcaaagaactactcaaaaacgaatctttactcgacgagaaccaaaagaatgtaatcttaaccctcccaactaaaaagtgggcaccactaagttataaactactccagaatatcgtatacacagacgactatggtgtagttcactcaatcctcgacataatgaaagaaacaaaccaaaatttccaaatggtactccataacgagcaataccactttaaagaactaattgaacaggaaaaccagaaattcacacaagaaaaaacgatcgaagacctaatagaagaaaaattagaatcaataccttctctaacccaacgcagtatcagacaaacactactcatcatagacgatataatcaaagccagccaccaaaaagtaccagagaaaatatttatagaagtcaccagaaacaacgatgataaacgaaaaggtcaagacggtaatcaattagcacgcgataaagaattgaaccgttttttaacaaacttactcaaagacgaaaaagcaaaccaattctgcgacgtctcacaactattaaaggacttagaagaagtcgataaagtaaaattaaaaggaaagcacatatatctctactttaaacaattaggcatagatttgtataccggaaaaaaaatagtcctaaaccaactcctaacctctacaaaatacgacacagaccacataataccccagtctttaataaaagacgattctctagacaacctagttttagtagaaagagaggttaacctaaaagtaaaaggaaatcactatcccgttccatcacgaatccaggatgaacaaaaaaaactctggcacttccttctccaaaaaaaggcgataagcgagaaaaaatacggaaatctcactagaacatcaaaaattaagctcgaagaagtcgaagacttcgtcgctagacaaattaacgtcatcaattattccaacgttataataagagacatactcaaactaaaatacccacacaccgacataatattctcaaagtcccaatacccatcattcataagaaagcaccttaaaatcgtcaaaaatagagacgtaaacgacgcacaccatgcagtcgacgcctatctaaacgtagtatcaggaaatctattatcaacaactttttcaaaagcttatatcagaaaaaaatatatccaaatacaggatggcgaaaaagaaacattcaacatggagacaattctcgaaaattactttaaaaacaatgaaaaccaactaaagataaaaacaaattgccttagacgagacgctttaataacctttaaggtagactacttcagcggtgagttttacggacaaacaagactaccaaaaggaaatgaaaatctgatacccataacactaaacgaagataaccccatgtcagacacttcaaaatatggtggttataccaacttagcgcaagcttacctatttgcagtttcgtatcaagaagacggagaaatgaaaaaagcaatactaagagtaccatatctatatgacacactatacaaaaatgattcggataaactactttcaaaagttcttgacaatcccaaagcaacaaacattcaaatcctcagaaagatacacctaaaccaaaaaatccgttttaacgatggtatatatttattatatacaaatgaaaaagacagaaacaaatataaaatggcgtatcaaaactatatagacaacgattacttatactacctccactgggcaaacaaacatttagaagaacttttagataatcaggagaaacaaacctttatatataactccaaaaacgatcaatttgaagtatcaaaagcaaaaaacaaagaaatctttcaataccttctccaaaaaacaaaggctaaagtctatgacacatgcaactatatagtaaaagcacgagaaactaacatagaaatcttcgagcaattaacattaaaagaacaaataacgatgatcaaccaatggattaagatgatgtctagagactgcgaaaaggttaaattcgatgcaaggtttactaatttttcaaactgccttctacgcctctcaaataacataaacccaaaagacagcataaccattatttatgaatcacctaccggattattcaagcacgaagtaaaaatatga

SEQ ID NO: 5318 - RNA, 4035 nt, synthetic construct
  misc_feature 1..4035: note = Cas9 variant
  source 1..4035: mol_type = other RNA
atgaagaaaaccaatccatatatattatcattagacataggaacagccagtattggctacgcatgtatggacctagacttcaacatattaaaatatcacgacaaagatgcaataggtgtactaacattcgaaggagcagacacagcagcagaaagaagaggtttcagaacgagcagacgaaggaaaaatcgaagaataaaacgcctcggcttattacaagaagtacttgccccactggtcaaaaatccaaactactatcaactactaaacctacacaaatggaaaaactccaacgaagactttaaacaccgctcactctcggaagtactcaaaaccttgggcaaaaacccaaaaacatacccaaccatatatcatctgcaacaagatatacaaaatcacccggagaagaaattcgaaccagaattgatattcctagcgctttatcacctagtaaaatatagaggccactttttatttaataatctttcattcgacaaaggaaaaaccgtagacaatgaagctcaactttccgaattacttgaacaataccaatcaataaacccatacgaaggatcaatatttaacaaagacatcaaagttatagtagatacattaaaagacgatcaactcacgagaaatgataaaagcaaagaactgaaacgaaatgttagtaaaactcatgctgaactattcaaaatgttagtcggtcttaagttcaaacaatcaatactattcgaaaatatggaaaacgtagaagacattaaagaaagtgccaccggaagcgacgcaataagtctctcagacgactattatgaaaacttatcagaatttctcacagacgaacaattaaattttatagaatcagccaacaccttctttatgggaataatgttagaccgcatcctaaaaggcgctaccagcatatcagcagctaaagtacgggattacaaaattttcaaaaaccaattaaaactcatcaaagacatagtatatcaaaataaatacgacaaatatcacgagttctttgtaacaagcaaagaagatatgcgagcctaccaagaaaatccagacgcaaaaacatttggaaaactatcaaaattcgaccaatatctcattcacccaaaagatcaatatgcaaaactcatgaaagacttaaaaggaatcgttcccaagaaatataccgaagttcttaatctaattgacgagcaaaaattccttgtagtacaaaatacaacagacaatgcatcaataccctatcaaaacaatgtattcgaagcagaaaatattctgagaaatcaacaaaaatattaccctgaaattacagaagaaatgatcggaaaagtaataaaccttatttccttccgcattccttattacgtagggcccctcactaataaaaatggccaatcagattttgcatggatgatacgcaaatcggatgaacaagcactaccctggaattttgacaaagtaatagataaaagcaaatcagctgaaaaattcatcagacgaatgacaagcaaatgcacataccttttagaagaagacgtcttaccaaaacactcattactttaccaagaaatggaagtactaaacgaactaaataacgttcaattacgtggggaaaacgaaccaaaacacaggattcaccgcctcgacccaaaagtaaaacaatttatctaccacaatctattccagaaaaagaaaaacgtaacacacaaagaccttattacactactgcaaaactcagagcatagaaatacactaaacaaaacgtccggacagaaactgaaagtctttggaacccaaaacgattcaaaattcgcatcaaaactatccacatataatgatatgaaagcaattttcggatcagttgaaaataaaagacaaatgatagaagaactcgttctatgggtaaccatctttgaagacaaagcaatactcaaacagaaaataggcgaaaaatatcctaacataaccgaaaaacaactcaaccaaatcgtgaaattaaactactcaggatggggaagattatctgaaaaattactaacgaaagaagtaaatggccgctccttaatagacctaatgtattccaccgaaaataacttcatggaaataataacagataaaaccttaggattcgactgttttatcaaaaactcaaataaagtcaaaaacgcgaaaatatcttataaagatgttgcagaactccgaaccagtccggcattaaagaaaggaatatggaatgcaattaaaatggtccgcgaaataagcaatttattcggagccccagagaaaataataatagaatttgcaactgaagaccaagtaaaaggaaaaagacagaaatcacgtagtgaactttgggatgacctcgtcaagaaaaataatctcaaacggaacaaagagttcaaaggattatttgaagaaatcaaggcttatccagatctggatttttccaacccgaaattatggctctacattcatcaaaacggcaaatgtatgtacaccaagaaaccaattgacttagaacgactactttctgacacgaataaccaactatacgaaatagaccatatcttacctagaaccttcgttaaggacgattccataaataacaaagtcttagtcatacaatctgccaaccagaagaaatcaggagacaaaatgccccttgaaatattcgataatcatgtccttgtcccattctggaaaatgctttacgagaatgatttaatatcctctagcaaactctctaaactaatgaagaaagagttcaacgatcttgataaagaaggatttattcaacgccagctagtagaaactagacaaataatctcacacgtatcagacttcctaacagaagaatatccttctacgaccgtcgtacccatgaaagccaacgtagtgtccgaactcagaaggaaattcgacatacctaaaatacgacaattaaatgattggcaccatgccgtagatgcctacctaaacggatttgtataccaggcagcacgagttttctacccaaaggtaaacctatttgaatttaattttaaatgggagaaagtacgagagaaatggagacaactaggagagttcactgaaaacaacaagaaaagagagttctttttatttaaaagaatggaaaactacgttaacgaacatggtgaaggaatgataagcaaactaatcttcgaccttgacaactttaaattcaattacagtagaaaagtagaatccacggaatcagccttctacaaacaaagcgcattctctccgaaaaatacgactgcccaatatgactctgacaaaaataaaacggcgatatacaaagaaatgaaaaataaacgcggcatagtggttagttacacatacgtcaagaaagatcaagaacttataggctacggcgtattcaacgaaacagtatttgagtacgtaaacaatgcagacgtagacatgaacacgagagccctcaaaatagtaaggaaggcctttcccaaacttgacataaagaaagtacagtacttattctcgatcaacaaaggcgacacgctcctagtaaacggacaccccttcctattcgtaagcgcatatgaaagaataaacggcaaacagttagaatttgacatagctatgcaaagaaaaataaaacaagccttaagtccatacaacaatatgacagaacaagaaaaagttgaattttacaaccaattcgcggaaaaagttatagaagaatttagaaattccattggactacaaagtagagaccggaaagttaatctgatcaaaaaccttttcaacaatacagaaaaatccaacgattccatgacccaaagcatcttagaagtattaaaaatgacgaaagtctcggcagaaaggtcaaaagaactcaaaataagatggaacggacaaaccccgaacactttcattgacactaaaaacaacgcggaaatacaatataaatcaatcactggactgaaaacaacaaaaccaaagagtatattcaaactagccgaaagcaaaaacgagctttga

SEQ ID NO: 5319 - RNA, 4038 nt, synthetic construct
  misc_feature 1..4038: note = Cas9 variant
  source 1..4038: mol_type = other RNA
atgaaaaaaccatatagcatcggtttggacataggcacaaactcggtaggatgggctgtagtaacagacgactataaagtacccgccaagaaaatgaaagtactaggaaacactgacaaatcacatataaaaaagaatctactaggagctctattattcgattctggaaatacagccgaagaccgccgactgaaaagaacagcaaggaggcgatacacaagaagaagaaatagaatcctatacctacaagaaatcttttccgaagaaatgggaaaagtagacgactcattcttccatagacttgaagattcatttttggtaacagaagataaacgcggcgaacggcacccaatcttcggaaatctagaagaggaagtcaaatatcatgaaaatttcccaacaatataccacctacgacagtacttagcagataatcccgaaaaaaccgacttaaggttagtatatctggcgctcgcacacataataaaattcggaggacattttttaatagaaggtaaatttgacacaagaaataatgacgtacaaagattattccaagaattcttagcagtatacgacaacacattcgaaaacagctcactacaagaacaaaacgtccaagtggaagaaatactcactgacaaaatatcaaaaagcgcaaaaaaagacagagtactaaaactattccctaatgaaaagtcaaacggaagattcgcagagttccttaaactgatagtcggtaatcaggcagacttcaagaaacacttcgaattagaagaaaaagcaccactacaattctccaaagatatatacgaagaagaactcgaagtattactcgcccaaattggagacaactacgcagaattgttcttatctgccaaaaaattatatgactccatacttcttagtggaattctcacagtgacggacgtatctaccaaagcaccactaagcgcgagcatgatacaacgctataatgaacatcaaatggacttagcacaactcaaacagtttatacgccaaaaattaagcgataaatataacgaagttttttctgacgtttctaaagatggatatgcaggatacatcgatggcaaaacaaaccaagaagccttctataaataccttaaaggactactaaataaaatcgaaggtagtggttacttcttagataaaatagaacgggaagatttcttgagaaaacaacgtacattcgacaacgggagcatcccccaccaaatacatttacaggaaatgagagcaatcattcgccgacaagcagaattttacccatttctcgcagataatcaagacagaatagaaaaaatcctaacgtttagaataccatattacgtaggccccttagctagaggcaaatccgacttcgcatggctgtcaagaaaatcagcagataaaatcaccccatggaatttcgatgaaatagttgataaagaatcaagtgtagaagcatttattaatcgaatgacaaactacgacctatacttgccaaaccagaaagtacttccaaaacactccctgctctatgaaaaatttactgtttataatgaactcactaaagtgaagtacaaaacagaacaaggcaaaaccgcattcttcgatgccaacatgaaacaagaaatatttgatggagtattcaaagtatatcgcaaagtcaccaaagacaaacttatggatttcttagaaaaggagttcgacgaatttcgaatagtcgatctaacaggtcttgataaagaaaataaagcgtttaacgcttcctatggaacttaccacgatctacgaaaaatattagataaagatttcttagacaacagcaaaaacgaaaaaatactggaagacatcgtacttactctaactctcttcgaggacagagaaatgataagaaagagattaaaaaactactctgacttactaacaaaggaacaactcaaaaaacttgaacgaagacactacacaggttggggtagactctccgcagaactgatacacggtattagaaacaaagaatcaagaaaaacgattttagattatctaatcgacgatggaaattcaaacagaaattttatgcaactcattaatgacgatgcactctcctttaaagaagaaatagctaaagcacaagttataggagaaaccgataatctaaatcaagtcgtgtctgacatcgctggttccccagcaattaaaaaaggaatactacaatcgctaaaaatagtagacgaactcgttaagataatgggacaccaaccagagaacatagtagtagagatggccagagaaaatcagttcacaaatcaaggcagaagaaactcacagcaacgattgaaaggattaactgactcaataaaagaattcggaagtcaaatactcaaagaacaccccgtagaaaattctcagctccaaaacgatagactctttctttactacctacagaacggccgcgatatgtacacaggagaagaactagatatcgactacctgtctcaatatgacatcgaccacataattccgcaagcattcattaaagataacagcatagacaatagagtactaacctcttccaaggagaacagaggaaaatcagacgacgtaccgtctaaaaatgtagttagaaaaatgaaaagttattggtctaagttactaagcgcaaaactaatcacccaaagaaaattcgacaatttaaccaaagccgaacgaggaggattaacagatgacgacaaggcagggttcataaaaagacaattagtagaaacaagacaaattacaaagcacgtggcacgaatattagatgaacgcttccatacagaaaccgatgagaacaacaaaaaaatccgccaagtaaaaatagtgacactgaaatccaacctcgttagcaacttccgaaaagaatttgagctatacaaagtgagagaaataaatgactatcaccatgcccatgacgcctacttaaacgcagtaataggaaaagcactactaggtgtctatccacaattagaaccagagtttgtctatggagactatccacacttccatggccataaagaaaataaggctacagccaaaaaatttttttactcaaacatcatgaacttcttcaaaaaagatgatgttaggaccgacaaaaacggtgaaatcatatggaaaaaagatgaacacatatcaaacataaagaaggtattatcttacccacaagtcaacatagtaaaaaaagtcgaagaacaaaccggcggattcagtaaagaatcgatactcccaaaagggaacagtgataaactaataccacgaaaaaccaaaaaattttattgggatactaagaaatacggaggatttgacagtccaattgtcgcctattcaatcttagttatagccgacatagaaaagggtaaatccaaaaaattgaaaaccgtaaaagcattagtaggagtaacgataatggagaaaatgacctttgaaagagatccagttgcattccttgagagaaaaggatatagaaacgtacaagaggagaacataattaaacttccgaaatacagtttattcaaactagaaaacggaagaaaaagattactcgcaagcgcacgagaacttcagaaaggaaatgagatagtgttacctaaccatttaggaaccttattgtaccacgccaaaaatatccataaagtagacgaacccaaacatttagattacgtcgacaaacacaaggacgaatttaaagaactgttagacgtagtcagtaattttagtaaaaaatatacacttgcggaaggcaacttggaaaaaataaaagaactttacgcacaaaacaatggcgaagacctaaaagagttagcatcatcgttcataaatttactaacattcacagctatcggtgcacctgctacatttaaattttttgacaaaaacattgatagaaaacgatacacatcaacaaccgaaattttaaacgcaacactaatacatcaaagcattacaggtctatacgaaacaagaatagacttaagtaaattaggaggcgactga

SEQ ID NO: 5320 - RNA, 4038 nt, synthetic construct
  misc_feature 1..4038: note = Cas9 variant
  source 1..4038: mol_type = other RNA
atggaaaattacaacattggactggacataggaaccacaagtgtaggctgggctgtagtgaacgatgcaactaacaaagtaatgagaaaaggcggtaaagcactctggggagtacgattatttgacccagccgtaactgccgaagatagacgagcaaaaagaggcacaaggcgaaggtacgatagacgccgagaacgaataaaactattacaagacgaatttaaagacgaaatcaacaaagttgactcaaacttctttctaaaactggaagaaagcaaatatacatccaaagacattaaaaataaaacagtactaataagcatggaagaagaaaaggccataaagaaatataaccaagaatacccaacaatataccacctaagacaaaaattaatgaactccaacgaacaaatggatatcagactggtgtatctcgcaatacatcacataattaaatacagaggaaactttatatatgaaggtaactccttttcggtaaataacttaaacatagacaataaattgaaagaaatatttttatcgctatcggaagacgtagatgaactcgatatatctgaagaatgtattaacaatataaactacaaacaattagcaaacatatttaacgaacaaagtaaaaacgatctaaaagtaaaattaacaagtgaattaactagctattcactgaataaaaatttcatatccgagttctgtaaactaataataggtaacaaattctcggctaagaaattattcaatcttgaaacagacaacgatgtttcactttcatttgacggaaccgattttgaagacaaagcaggagaccttgaatcactactcaatgactatctagaagtattagaacaactaaaagaactatacgatatggttttcttaaagaaaatattcggaggctcaaaagaaacaacaatatccggactaatggtagaaagatacaaccagcataagaaagacttaaaactcctaaaagatacgttcagttctgataggaaaatatataataaaatatttagaagtaagaaagacatcaaagatgataaagatatgtgcctctacgacctatacatacacaataaactagaaacaacagacttccttaaagaaattaagaaatacgtaaacaccgataatttcatcataacagatgaagacttcctaaaaagactagaaaacaatgaagtactaccaagaataacatcaaaagaaaacggtaaatatccctatcaacttaataaagacgaactcgtatcaataatagaacatcaaggaaaacactacccctttctacttaacaaaacagacgacggcatatataaattagttcgccttttagaatttagaataccctatttcgtaggacccctagtatcaaaagatatgagtgaaaatgcttggatgctcagaaacgaaggtatgcaaggagtacatataacgccatacaactttaagaaagtaataaatttagataaaactgcggaaatctttataaaaagaatgataagccattgtacatatctacttgatgaagaagcactaccaaataactcaatcctatattcggagttcaaagttttgaatgaactgaaacaaatcaaagtaaatggcgaacaccttacgaaagacgaacaacacaaaataatagaagaattattcatgaaaacatcgggaacgatcaccgaaaataaattcagagaatttctacttaacacactagactacaacttttacgaaaacgaactcaaaatcaccggttattcagccgactgtaaattcgcaaataacatgcaaagttacatagacttcttcggagaaaacggaatcttcgaaggaacatcatataatacaaatgacgcagagaaaatcattgaatggataactatattcgatgataaagatatcctcaaacgtaaagtagaaaacgaatatccagaactaaaaagtaatcaagtgaaaaacatcttaaacaagaaatattcaggctggggaaggttaagcagaaaattactattagatctaagagtattagacaaagaaactgatataccaaaatcaatcatggacctcatgtacgaaactgatgagaatttcatgcaaataataaacaatgacaaatataacttccaaaaactaattgctaaagaaaacaaaattgagaatacaagcaacgacttatcgtacgacgtagtagaaaatctagccaccagcccggcaacaaaaagaggtatctaccaggcgttaaaagttgtcaaagaaatcacaacatatatgggctacgaacctaaaaacataatggtagaaatggctagaggagatgaaaagaaaatccgcaaagacgatagaaagaaatatctacaaaaattatacgacaacataaaagacgaagtagattcaaactacaaaaatctcaagaaagagctcgcgaaagaagagaaaatagataccgacaaactctatttatattatttacaggaaggcaaatgtttatattgcgggaaaccaataaacgtagatgacctaaataccaaaaactcactatacgaaatagatcacatattaccaagaacattgatcaaagataacagctgggacaacagagtgctagtgtgccgaggctgcaaccagaagaaagcggccagtctagtactcccaaaagagttccgaaacgattataccaaatcaatatggataagacttaaaaacaacaaactaatgagtaacaagaaattctacaacctcacgagaaaaagttatagcgaagaagatataaaaggatttataaataggcaacttgtcgaaacgagacaaataacaaaacatgtagccaacatactcaattgcttctacccaaaaaccaaaatagtctacctcaaagctaatatatcgcattcatacagagataaatacgacctattcaaattcagagacataaatgactatcaccacgcacatgatgcgtacttagcagccacactcggtagttatcaagaaaaatacctacattatgacctggactacaataaaattaatgagttcaatgaaaaattgattaaaaatgaagactacaaacggttacattatgggatagtagttaacagccttgatgaagaatttcagtcagcctttgcagaaattgcaccacgtttgattaacgaagaaacaggtgaattactattcaatgccaagaaatttaatgatctcgtcgaagacactctatatagaaatgacattttaataagcaggaaaacagaaatcagaaccggcaaactatacaaagaaacaatatacaaaaggggtaaaggtaacataaaaataaaagaaaatatgcccactgaaacatatggtggctactcaaacatggaaacatcatatttaacgctagtgaaatatggtaataaaacaaaactgataggaataccaatgtcaatagcaaacaacaaagatgtaaaagttaaactagattttatcaaagaacacctagacctcaagtccctcgacaacatagtgattttaaaagataatataccgtatgacgtctctataaattacaaaaaccaagacgtttacgtcaaaggatactcaacagccaacaaaaactgtgaactttccaatgcacaccagcttaaaataaagaaagatatgatgaagaaatgcaaatacgtgcttaacaaagtatataaaaacaaatacgatgatataacaaacatggacatagaaaacgctataaccttcataaactacttatttgaaataaaaatagagttcccactcttcagcaaagaaataactaaaatacaagacaacatcaatttaacagaatgttccttcgaacaactagccaacatcattaaacaactgctcataatctaccactgcaatagcaaaaacggaaatctaaaagaatttggactgagtgatagaatcggtaggctttcaggagctaacgtaacaggcggggacttcatattcacttcagtgacaggactcaaagagaaaactgcatcctacgatggagaatga

SEQ ID NO: 5321 - RNA, 4038 nt, synthetic construct
  misc_feature 1..4038: note = Cas9 variant
  source 1..4038: mol_type = other RNA
atggtcgaaaaatatggaataggacttgatatcggaacctcaacactcggatggacgagcgtagacgaaaacggtaaaatacaaagactaaaaggacaaacagcactcggaacaagattgtttaacgagggccaaacagcagaagagagaaggggctttcgtacaacaaggcgtaggattcaaagacgaagatggagattacgattattgagagaaatattcgacgaaccaattggtagtgtagatgcaggattctttgctagacagaaaatgagctctttgtcaccccaagatgatcgattcgaagacacttacagattatttaacaaccaaaccgacaaggctttccatgacgagtaccccacgacatatcacctacgacaagctctaatgaactcagaccgtcaatttgatattagagaaatctacttagctatccaccacatagtaaaatacagaggtaatttcttaagatcaggaaaacccgccgactttaaaacaggcaaattagaccttaaagaaaaattcgaagaaataaatgccgactggcaaacattaataagtgaagacgctccacaacttccagttgatgatttaacgacaataaaagcagtattagtcgatggttcgcgtagtcgtagcgatcgacaaagaggtcttgtaaaactctggatggccaacgaaactgtcgagaaaaactggaaaccagtcatgactgaattagcaaaagcaatactaggcttaaaaacaaaattatatctgctaacaggactagatctaccaaaagaagaccaaaaagcatggacattctcactggatacacttgaagatcaccaaggcgacatagactcatttttcgatgaccatgcccaacaactaatagatagactagctgaactaagagctatgatacaattaacggaaattatcccaagcggattaaatttttcacaaagcatggttcaacgttacgaagcacatagaagtcacctggaaatgtacaaacaatacgctctagatcaaacagatcccaaacgcacaaaagctctacgtgctgcatacaacgcatacatagatcaacacgaaatagcagacgatttttacacagccgttaaacgagttaccaaagacgatcaatcagaaacggctgaagaaattaatagattaatagggcttgaacaattcatgcctaaacaaaggacaaaagaaaacggcgtaattccctatcaagtacatcaacaagaactagatcaaattatagctcaccaaaagaaatactaccctttcctagggacagaaaacccagtaatagaccatagagagagccaaccctatatgttggatgagcttgtatcatttagagtaccatactacgtgggacctatggttgcagcaaatccagaactaaaaacaactgaaaatccgttcgcatggatgataagaaaagctcaaggtgagataacgccttggaacttcgatgaaaaagtagacagaaaagggtcagcaacagcgttcatagaacgaatgaaaacaaccgacacatatttattaggggaagatgtattacctcaacaaagtctgctttatcaaagatttatggtattaaatgaattaaataatataagaatagacgacgaactattaacaaccaaccaaaaacaatgggtattcgacagagtattcaaagggaagggaacgatatccgctaaacatttgcaagacgcactaaaacaccatggtgaaactgacgggcttccgaaaatctcaggtctagcggatccaacaaagtttaattcagcacttacaagttaccgagattttcaaaagtggttacccaatgacatagacagaaaggatcgtacagctgacattgaaaccataataaattggagtactgtctttgaagacactcacatatttgtagaaaaactaaaagaaatagaatggctaacagctgatcaaagaagacgtatagctagcaacagataccgaggctgggggagactctctaaacatctacttaccgaaataaaagatgagcagggactatcaataatggaccaactttggagaacccagcacaacttcatgcaaatagtacacgaaccagactacgcaaaacaaatagaggctgcaaatacagtcggcatggccaaacaagatattggaacagtaataaatgatctatatacctctccacaaaataagaaagcaattaggcaagttttagccgtagtcaaagatatccaaaacgcccatcacggagttgcgccgagttggatatttatggaagcagcgcgcggagcagatcaaaatccacaacgaagcagacaaagacaacgacaattacaagatctatacgccaaaactgcagccgatctcgtcgacacagaagtacaacaggaattaactgataaaatcaaggataaagcaaactttacggacagactaatgttatacttcttacaaaatggacaggacatgtattcgaaagaaaaattaaatatagacagattatcagaatatgatatagaccacatacttcctcaagcactaattaaagatgacagtctcgacaaccgcgtattggtacatcaaagtattaatcgtaacaaatctgatacattcgcatcagaaaaatacggagcaaaaatgcaaggggcctggcatcaatggcgagcagcaggtctaatttctgcaagaaaattacgaaatttggagatgagacctgatgaaatcagcaaatatgcaacgggttttattcgtagacaattagtagaaacacgacaagtcataaaacttgttactgaaatactatcccatcaatataatccagaagaaaccaaactcgtgtcagttaaagctgggttaagtcatgagttaagaagagaagcaggcttacccaaactacgagatttaaacgactatcatcacgccattgatgcatatttagcggcaagaataggaacatatttactgaaacgatatccacgattagagagattctttgtatacggacaatttcaaacgtcaaggctagacttaagacgttttaacttcatacatgatttagttaaaagcaaacaaggtgtcattgttgatagcgatacaggtgaaatcttatgggatagacaaaaagatatagattatatcaaacacctcatgggtctcaaacacttacttgtaactcatgaagtatatgactcagcagcggaaatgtacgcccaaacaatattcaaggcctcggataatgactcaaaagtactcattccgacgaaaaatgatagaccgacagccatttacggtggatacacaaagaggagaaatggctacctagctatacttaaaataactgagaagaaagccgaaacgtacagagtagtcggtgttccaacattgtacatgtctcaactagcaaccgctagatctcactcagtggaagctgaaaaagcacttctaaagagcttgatggcacctgagattctctccgaaagtaaagttgtctcattcgaagtcgtagtctcacatgtccatcttaatcaactcgtaagagataccgttttcggtcccgcacattatttcggacttggcccattcagatacgtcagaaattttcatcagctagttctaccatttaaagatcaagaaatcttggttaaaagaacacctacagatgaagaactaaataccgtattcgaagacatatgttggcaagtcgaaaattacttcgcagtttttgatataaacggattcagaaatgcattaaagaaaagtatagacaaattcgaacagttaccaatcgaaaatgtgtttaaagataagaaattagtcactcaaggcaagaaagaagtactagcttttgtgatgcaaggactacatgcaaacgctagttaccgaaaccttaaagtctcactcggtataaaaacacccctaggacaattacaattaacaaaattcatgttatcaagagatgcagaattaatagatgaatcaccaaccggattatttcgacgaattagacgcctaaaagacttatga

SEQ ID NO: 5322 - RNA, 4038 nt, synthetic construct
  misc_feature 1..4038: note = Cas9 variant
  source 1..4038: mol_type = other RNA
atgggtaataaactaaggaatgtagacgactactatttaggcctagatataggaacagaaagcgtaggatgggctgtgacagataaatattacgtaattccaaaattcaaaggaaacgccatgtggggagtgcatctcttcgacgaaggggaaacttcagtcaaacgaagaggcttcagaagcgcaagaaggagaacacaacgaaaaagagaaagactcgcactcctcgaagccttatttgatgaggaaatttgcaagaaagactgcacgtttttcagaagattacatgaatccgacctatggcccgaagacaaaagtggagacgacaaatacgcagtcttcgcagatgagaattacaccgacaaagattttcacaaagaatatccaacaatttatcacttacgctacgaattaattaaaaacaaggaaccacacgacgtaaaacttgtgttcttagccctacatcatatcataaagaatagaggacattttctattcgatagtctcagttcagcagaagactttaacagtgcatacgagacgatgtgcagctacttatcagacaatgaaatacaactaaattgcagcgatatagaacagtttaaagcgattctaaaagatagaagacaaggaaaaatagaaaagaccaaaaatctagcgtcattattcggaataacaaagaaatccgatccggtctcatacgcagttatggctgtacttagcggatcgacagttaaaatgtgtgatctttttggagatgatgaattaaaaacggtagagaaaaacaatatatcatttgcttcaggatacgaagaaaatgaagaaatatacgccagcgtattaggcgacaggttcgaattagtaaaaatccttaaagccgtatatgactgggctgtattagcagatatcttagatggaaagaaatatatcagcgaagcaaaagtagcagtctacgaaaaacataaaaacgacctaaaaactttgaagaaatatgtaaaaacttatttacctgaaaaatacaatgaaatatttaaaatatcagatggaaagaaagacaactacgttgcatacagcggacatataaaagaatctggaaaaaccggagaactaaagaaaacctgcaactcagaaaacttttgcgcatatttgaagaaaactctaggtaaaaatgccgacctatcatataaagaaatgttcgacgaaattgaaaataaaactttcatgccgaaacaagtcacaaaatcaaatggagtagtacctatgcaagtaaacgaagaagaactaaaagctattttagataacgcaaaagattatctctctttcctaaacagttgtgatgaaaatggagtgagtgtgtatgataaaatcatcaaaatatttgaatacagaataccatattatgtcggacctctaaatacacacactgaaaacagctggttaaaaagaaaagacggtgttaaaatatatccatggaacttcgacgatgtggtcgatatagactcatcagcagaaaaattcattaataacctaacatcaaaatgtacttatctccctgaatgtgatgtcataccaaaatgcagtttattatattcaaaatttacggttcttaacgaaataaacaatttaaaacttaatggagaagacataccagttgaattgaaacagggaatctataaagatctctttatgacaagaagaaaagtaaccgtaaaacagataaaagattacctaaaggctagaggatgctacgacaataacgacgtcctctcaggtatcgatacaactgttaaatcgtctctcaaaagctactttgatttcaaaggcttcgaatctctaacctttgatgacaaagagtcaattattgcatcaagcgtaatattcggggatgacaagaaactcctaaagaaaagactcaagaaactttttcctgagaaattaactgatgaggatatcaagaaaatatgcaaactaaaatatacaggatggtcaaggctatctaaagaatttctgtgtgatgttgaatttacttacaagaaaacaggagaagtaatgaacgtaataaccgccttatgggaaacaaattacaaccttatgcaaatcttgtatagcgaagatttctgttgcgatggagatgaaaagaaaaacctaaacgacaaattagacgaattatcatataccggagaccaacatagcttaagaaaagctgttgatgcactatatgtatcaccaaaagtaaaacgaccgattctaagagccttattaattgctaaagaaatagagaaaatacaagaaagaccacccaagaaaatatttgtcgaagtcgctagaggaattgacaatcgagaagaaaggcacagggattctaggaaaaaccgactaatggaactatacaaaaattgtaagaaagaagcagaaaaattctgcccctactttgatgccctatcaaagaaattatcagacgaagacgaatcaaaactccgccgagataaactttacttctattacatacaattgggtaaatgcatgtatacaggagaagaaataagcctaggagaactaatgaacggaaacggtagatttgatatagaccatatctacccaagatcaaaaattaaagatgacagccttaccaataaagtcttagtaaataaaactgtaaacaacaacaaaacaaacgtatacccaatagacgcagcaatacaatcaaaaatgagcccatattggcaaatgttacgaagcagcgggctaataagcgaagaaacatataaaagacttactcgaaaaacacctttaacagatgacgaattaagtgcattcgtatcacgacaacttaccgaaacccaacaatcaactaaagctgtagctcacattctagaacaactatacccaaaaccaaaaacagagattgtatatgtaaaagcagccctcgtacacgcattcaggcagtcgaatgacatgttaaaatgccgtgaagttaatgacttacaccatgcgaaagacgcttacctcaacatagtagtaggaaacgcatataatgtaaaagtcacgcataacaaagtgaactttattaaaggtctacaaaacaacgataaaggctatacggtcaatccagaaaaatttttctctcatgatataccaggtgcctggtcagttaaagattcaatgaatactgtacgaagatttatgaataaaaacaatatcaggtatacaagatttccaaggaagaaacaaggcggattatttaaaattaaccccctcaagaaaggaaatggacaagtcccattaaaggcttctggagcacgtagctgcattgaaaaatatggcggatacgacaaagcaacatcagcatattttagttatgtcgaatatacagataagaaaggaaaagcagtaaggcaaatgttcccagtaaacctatacgaagtaaaagagtatgaagcggatatgcaaggtttcgtgacctctagaatagctgaagcaagtaacgttaaaatcttgattccatgtgtaaaatatgatgcctgcatatcatttgacggttgtcgaatgttcataaccaagaaaaccggaaatagaattggatacaaacctggaatgcaactcgttctaggctacaaatatgaaaaatatatccgtaacatcgaaaactacttgactaaacataaagacagagaaatcataccacgagacaacataagcgcagaagaaaatattgaactctatgatatcctaaccggaaaaatgctaaacaccgtattatcagtaaaattttctggaattgggaagaaactagagaaaagaagggaaaaattcgtgttatgtagccctgaagaacaatgctgcgtattaaacgaaatattaaaaatcctacatgcaaacgtactaagcggtgacctcagcctgattggagaaagtcctaacaccggcacaatgaaaacgaacgcaaaattctcagaaataaaagatgtacatagcattaaactaataaatcaatcagtaactggtttatttgaacaagaaatcgacttattaaaatga

SEQ ID NO: 5323 - RNA, 4038 nt, synthetic construct
  misc_feature 1..4038: note = Cas9 variant
  source 1..4038: mol_type = other RNA
atgggcaaaccatatagtataggcttggacatagggactaacagcgttggttgggcagtagtaacagatgattacaaagtgccagccaagaaaatgaaagtactcggcaacacagataaacaaagtatcaagaaaaacctattaggagcattactttttgattcgggagaaacagcagaagcaactagacttaaaagaacagcaagacgaagatacacaagaaggaaaaaccgtctaagatatttacaagaaatattcaccggagaaatgaataaagtagatgaaaatttctttcaacgacttgatgactcctttttagttgacgaagacaaaagaggagaacaccaccccatatttggcaatatcgcagccgaggtaaagtaccacgacgactttccaaccatttaccatttaaggcgtcaccttgcagacacatccaagaaagcagacttaaggttagtatacttggcattagcacatatgataaaattcagaggccactttctatacgaaggagatttaaaagctgaaaatacggacgtgcaagccttatttaaagacttcgtggaagaatacgacaaaacaattgaagaaagccacttaagcgaaataaccgtagatgcattatctatcttgacagaaaaagtatcaaaatcatccagactggaaaacttaatcgcccattacccgacagaaaagaaaaatactctctttggtaacttaatcgcactcagcttagatctacatccaaactttaaaacaaactttcaactttcggaagacgcaaaattacaattctctaaagacacatacgaagaagacctagaaggatttttaggcgaagtaggtgacgaatacgcagatttatttgctagcgccaaaaacctttatgatgcaatcctattgtcaggaatactaacggtggacgacaatagtaccaaagcaccactatccgcatctatggtaaaaaggtacgaagaacaccaaaaagacctgaagaaactaaaagatttcataaaagtaaacgcccccgaccaatacaatgccatatttaaagataaaaataagaaaggttatgcttcctacatagaatccggagtaaaacaagatgaattttacaaatatttaaaaggaatattacttaaaataaatggtagcggagatttcctagataaaatagacagagaagacttcctaagaaaacaacgtacttttgacaatggatcgataccccatcaaatccatctccaagaaatgcacgcaatactacgaagacaaggagaacactatccattcctaaaagagaaccaagacaaaatagagaaaatacttacctttagaataccctattacgtcggccctcttgcaagaaaaggctccagatttgcatgggccgaatataaagcggacgagaaaataactccctggaacttcgatgacatcttggataaagagaaaagtgcagaaaaatttataacaagaatgacacttaatgatctatatcttccagaagaaaaagtattaccaaaacatagcccgttatacgaagcatttacagtctataatgaactcacaaaagtaaaatacgtcaacgaacaaggagaagccaaattctttgataccaatatgaaacaagaaatattcgaccacgtatttaaagaaaatcgaaaagtaacgaaagacaaacttttaaactatctaaacaaagaatttgaagaatttagaattgttaatctaactggcctcgacaaagaaaacaaagccttcaactcatctctaggcacataccatgacttaaggaaaatcttagacaaatcattcttagatgataaagccaacgagaaaacaatagaagacataatacaaacactaacattattcgaagacagagaaatgataagacaaagactacaaaaatattcagatatattcacaaaagcacagcttaagaaactagaacgacgtcattacacaggatggggaagattatcttacaaattaataaacggaattagaaacaaagaaaacaagaaaacaattctagactatttaattgacgacggatatgcaaacagaaacttcatgcaactaataaacgacgacgccctatcatttaaagaagaaatagcacgtgcacaaataatcgatgatgtggatgacatagcaaatgtcgtccacgatctcccaggatcaccagcaatcaagaaaggaatactccaaagcgttaaaatcgtagatgaattagtaaaagtaatgggacacaatcccgcaaacatcattatagaaatggctcgagaaaaccaaaccaccgataaaggaagacggaactcacaacaacgactcaaactactccaagactcacttaaaaacctagataatcccgtcaacatcaaaaacgtagaaaaccaacagcttcaaaatgatcgactatttttatactacattcaaaatggaaaagacatgtatacaggtgaaacgttagacattaataacctctcgcaatatgatattgatcacataattccgcaggcttttataaaagataactcattagataacagagttttaaccagaagtgacaaaaacaggggaaaaagcgacgacgtaccaagtatagaagtagtacacgaaatgaaatcattttggagtaaactgttatctgtgaaattaatcacacaaagaaaattcgataacctaacgaaagccgaacgaggcggactaacagaagaagataaagctggtttcatcaaaagacaattagtagaaacaagacaaataacaaaacacgtggcacaaattctagacgaaagattcaacacagaatttgatggaaacaaacgaagaatacgaaacgtaaaaatcataacactaaaatcgaatcttgtgagcaacttcagaaaagagttcgaattatataaagtaagagaaataaatgactatcatcacgcacacgatgcctatctaaacgccgttgtaggaaatgcattattattaaaatatccacagctcgaaccagaatttgtatacggagagtaccctaaatataactcttaccgaagtcgaaaatctgcaacagaaaaatttttattttattctaacatactcagatttttcaagaaagaagacatacaaacaaacgaagatggggaaattgcctggaacaaagaaaaacatataaaaatacttagaaaagtcctttcatacccacaagtaaacatcgtcaagaaaacggaagaacaaacaggaggcttttcaaaagagtcaatactgcccaaaggggaaagcgataaactcatcccacgtaaaaccaaaaattcatattgggaccccaagaaatatggaggatttgactcaccggtggttgcttattcaatacttgtcttcgcagatgtcgaaaaaggtaaaagcaagaaactccgtaaagtacaagacatggtgggaatcacaataatggagaagaaaagattcgagaaaaatcccgtagacttcctggaacaaaggggataccgaaatgttaggctagagaaaataataaaattaccaaaatatagcttattcgaattagaaaacaaaaggcgaagactactagcctcagctaaagaattacaaaaaggaaacgaactcgtaatcccacaaagattcactaccctactatatcattcatatagaattgaaaaagattacgaacctgaacatagggaatatgtagaaaaacacaaagacgagttcaaagaattactggagtacatatcagtctttagcagaaaatacgtcctagctgataataacttaacaaaaatagaaatgctatttagtaaaaacaaagatgcggaggtatctagcttagcaaaatcctttatttccttactaacttttactgcattcggcgctcccgccgcatttaatttcttcggagaaaacatagacagaaaaagatatactagcgttacagaatgcctcaatgcaaccttaatacatcaatccataactggcttatatgagaccaggattgacctatcaaagctaggcgaggattga

SEQ ID NO: 5324 - RNA, 4038 nt, synthetic construct
  misc_feature 1..4038: note = Cas9 variant
  source 1..4038: mol_type = other RNA
atggatcaaaaatacagcataggcttagatataggtaccaattcagtaggctgggctgtagttacagatgactacaaagtgccagccaagaaaatgaaagtcttaggaaacacagataaacaaagcatcaagaaaaatttactaggagctctgctattcgatagcggagaaacagcagaagcaactagactaaaaagaacagcacgaaggcgctatacaagacgtcgaaatcgactaagatatttacaagaaatatttgcagaagaaatgaataaagtggacgaaaacttctttcaaagactagatgactcatttctagtcgacgaagataaacgaggggaacgccacccaatattcggaaatatagcagcagaagtaaaataccacgacgatttcccaaccatatatcacttaagaaaacatctagcagacatatcacaaaaagcagacctaaggctagtatacttagcattagcacatatgataaagtttagaggccacttcctaatagaaggacaattaaaagcagaaaataccaacgtacaagcattatttaaagacttcgtcgaagtatatgacaaaaccgtagaagaatcccatttaagcgaaatgaccgtagatgcactttctattctaacagaaaaagtatcaaagtcaagacgactagaaaacctaatagcacactacccagcagagaagaaaaatacattatttggaaatcttattgcattatcattgggcttgcaacctaacttcaaaaccaactttcaattgtcagaagatgctaaactgcaattttcaaaagatacttacgaagaagacctggaaggattacttggtgaaataggagatgaatacgctgacctattcgcaagcgctaaaaatttatacgatgcgatacttctatcagggatactaacagtagatgacaacagtacgaaagcaccactttcagctagcatggtaaaaagatatgaagaacaccaaaaggatctaaagaagctcaaggacttcattaaagtgaacgcacctgatcaatacaatgcaattttcaaagacaaaaataagaaagggtacgccggatatattgaaaatggagtgaagcaagacgaattttacaaatatctaaaaggaatactattacaaattaacggatcaggagattttcttgataagatagaccgagaagatttcttgcgaaaacaaagaacattcgacaacggatctataccacaccaaattcacttacaagaaatgcatgcaatccttagacgccaagaagaacactacccattcttaaaagaaaatcaagacaagatcgagaaaattctcacattccgaatcccttactacgtagggccattagctagaaaaggatcacgtttcgcatgggcggaatataaagcagacgagaaaattacaccatggaatttcgacgatatactagacaaagagaaaagcgccgaaaaatttataactagaatgacactaaatgacctatatctcccagaagaaaaagtgctaccaaagcactccttattatatgaaacattcacagtatacaacgaactaaccaaagtgaaatatgtcaatgaacaaggagaagcaaaatttttcgatgcaaatatgaaacaagaaatattcgatcacgtattcaaagaaaataggaaggtcacaaaagataaattacttaattacctaaacaaagaatttgaagaatttagaattgtaaacttaacaggccttgataaagaaaataaggcatttaactccagtttgggtacctatcacgacctcagaaaaatactcgataaatcatttcttgatgataaggcaaacgagaaaacaattgaagacattatacaaacccttaccctatttgaagatcgagaaatgataagacaacgattgcaaaaatattcagacatattcacaaaagctcagctcaagaaattagaaagacgacactataccggctggggacgattatcatacaagttaattaatggcatccggaataaagaaaacaagaaaacaatcctcgattatctaattgatgacggatatgcgaatagaaattttatgcagttaatcaatgacgatgcactctcatttaaagaagaaatagcaagggctcaaattattggggacgtcgacgacattgcaaacgtagtacacgacttaccaggctcgccagcgatcaagaaaggtatactgcagtcagtaaaaatagtcgatgaacttgtaaaagtgatgggacacaatcccgcaaacataataatagaaatggctcgagaaaaccaaatgacagataaaggaagaaggaacagccagcaaagactaaaactattacaagacagcctcaaaaatcttgataatccagtaaatattaaaaatgttgaaaaccagcaactgcaaaacgaccgattatttttatattacattcaaaatggaaaagacatgtacacgggtgaaacgctcgacataaataatctatcgcaatatgacatagatcacattataccacaggcttttataaaagataattcactagacaaccgcgtcttaacaagatccgataaaaataggggaaaatcagatgacgtaccatcaatagaagtagtacatgaaatgaaaagtttctggtccaaactgttatcagtaaaattaataactcagagaaaattcgacaacctaactaaagcagaaagaggaggcctcacagaagaagacaaagccggcttcattaaacgacagcttgtggaaacacgacaaataactaaacatgtagcacaaatattagacgaacgctttaatactgagttcgatggaaacaaacgccgaatacgaaatgtaaaaataattacactcaaatccaatttggtctccaacttccgcaaagagttcgaactttataaagtcagagaaatcaatgactaccaccacgcacatgacgcatacttaaatgctgtagttggaaatgctctactactaaaatacccacaacttgaacctgagttcgtttatggcgaatatccaaaatataattcatatagaagccgcaaatcagcaacagaaaaattcctgttttattcaaatatccttagattcttcaagaaagaagatatacaaacgaacgaagatggagaaatcgcatggaataaagaaaaacatattaagatattaagaaaagtactctcatacccacaagtaaacatcgtcaagaaaaccgaagaacaaaccggaggatttagtaaggaatcaatacttccaaaaggagaaagtgacaaattaatcccaagaaaaaccaaaaactcatactggaatcctaagaaatacggcggatttgacagccccgtcgtagcatattcaatcctagttttcgcagatgtagaaaaaggcaaatcaaagaaattaagaaaagtccaagatatggtaggaattacaataatggagaagaaaagatttgaaaaacacccagtagactttttagaacaacgtggatacagaaacgtaagactagagaaaataataaaactgccaaaatacagtctgtttgaactagaaaacaaacgacgacgcctcctagcttctgcacgagaactccaaaaaggcaacgaattagtcatcccacaaagatttacaactctactataccattcctaccagattgagaaaaattacgaacccgaacatcgagaatatgtagaaaaacacaaagatgagttcaaggaattactagaatacatcagtgtatttagcagaaaatacgtcttagcagacaacaaccttacaaaaatagaaatgctattttccaagaataaagacgcagaagtttcctctctagctaaatccttcatcagcttattaactttcactgcattcggagctccagctgcatttaatttcttcggagaaaacatagacagaaaacgctacacatcagtcacggaatgtttaaacgcaacactaatacaccaatccataactggactatatgaaaccagaatagacttatcgaaattaggggaagattga

SEQ ID NO: 5325 - RNA, 4038 nt, synthetic construct
  misc_feature 1..4038: note = Cas9 variant
  source 1..4038: mol_type = other RNA
atgaagaaagaatactcaatagggctagatataggaacaaattcagtaggatgggcagtaataaccgacgattataaagttccagcgaagaaaatgaaagttttaggcaacacagacaaacaaagtatcaagaaaaacctactaggagccctactatttgacagcggtgaaacagcagaagcaacccgcctaaaacggactgcaaggcgtagatatacgaggaggaaaaacagactgcgttatcttcaggaaatctttaccgaggaaatgaacaaagttgacgaaaacttcttccaaagactagacgattcatttctagttgaagaagataaacaaggctcaaaatacccaatattcggtacgttaaaagaagaaaaggaatatcacaagaaattcaaaacaatataccacctccgagaagaactagccaatagcaaagaaaaagcagatttgcgtctcgtatatcttgcacttgctcacatgataaaattcagagggcattttctctacgaaggtgacttaaaagccgaaaacacggatgtacaagctctattcaaagatttcgtagaagaatacgataaaacaatagaagaatcacatttatcagaaataactgtagacgcattaagcatattaacagaaaaagtaagtaaatcctccagactcgaaaatctaatagcacattacccaacagagaagaaaaacaccctatttggaaacctaattgcactatccctaggcttacaaccaaacttcaaaaccaatttccaactatccgaagacgcaaaattacaatttagcaaagatacctacgaagaagatttagaagaactcctaggagaaattggggatgaatacgcagacctctttgcgagtgctaaaaacctctatgatgccatactgctatccggcatattagcagtagacgacaacactaccaaagcaccactaagcgcaagcatggtaaaacgctacgaagaacatcaaaaagatctcaagaaattaaaagatttcataaaagtcaacgcccccgatcaatacaacgcaatctttaaagataaaaacaagaaaggatatgcaggatatattgaatcgggagtagaacaagacgaattttacaaatacctaaaagggattctactaaaaataaatggaagtggtgactttttagacaaaatcgattgcgaagacttcctacgcaaacaacgaacatttgacaacggtagcataccacaccaaattcatcttcaagaaatgcatgcaatattacgacgccaaggggaacattatccttttctaaaagaaaaccaagataaaatagagaaaatattaacattcagaataccctattacgtaggtcctttagcccgaaaaggatcacgattcgcatgggcagaatataaagccgacgaaaagatcaccccttggaactttgatgacattctcgataaagaaaaatcagccgaaaaattcataacaagaatgacccttaacgatctctacctaccagaagaaaaagttttacccaaacatagcccactctacgaaacttttacagtctataatgaattaacaaaagtcaaatatgttaacgaacaaggcgaagccaaattctttgacactaacatgaaacaagaaatctttgaccacgtttttaaagaaaaccgaaaagtcaccaaggataaactattgaactatttaaacaaggaatttgaagaatttagaatagttaatctgaccggccttgacaaagaaaataaagcgttcaacagttcattaggcacataccatgacctaagaaaaatcttagacaaatcctttttagacgataaagcgaatgagaaaaccatagaagacataatacaaactctaacactatttgaagacagagaaatgattcgacaaagactacaaaaatatagcgatatattcacaaaagcacaactaaagaaactagaacgaagacactatacagggtggggacgcttaagctataaattaatcaatggcatacgcaataaagaaaacaaaaagacaatcctagattatttaatagacgatggatacgcaaaccgaaattttatgcaactaattaatgacgacgctctatcattcaaggaagaaatagccagagcacaaataatcggcgacgtagacgatatagcaaatgtagtacatgacctaccaggatcaccagcgatcaagaaaggaatcctacaatcagttaaaatcgtggacgagctagtaaaagtcatgggacacaatcccgccaatataattatcgaaatggcaagggaaaaccaaactacagacaaaggcagaagaaattcacaacaaagattaaagttattacaagactctctcaaaaacttagataatccagttaatatcaaaaacgttgaaaaccaacaactccaaaatgacagactcttcttgtactacatacagaatggaaaagacatgtatacaggtgaaactctagatatcaataatctatcacaatacgacatagaccatattattccacaagcctttataaaagataattctctagacaatagagtacttactagatctgataaaaacagaggtaaatcggatgatgttccatcaatagaagtagtacacgaaatgaaatccttttggagcaaattactaagcgttaaattaattacgcaaagaaaattcgataatctcacaaaagctgaaagaggcggcctgacagaggaagacaaagctggattcataaaaagacagctagttgaaaccagacaaattacgaaacacgttgcacaaatcctagacgaaagatttaatactgagtttgacggagcccaacgacgaataagaaacgtcaagataatcacccttaaatcaaaccttgtctcaaatttccgcaaagagtttgagttatacaaagtacgagaaataaacgactatcaccacgcccatgatgcctacctcaatgcggtagtaggaaacgcactattacttaaatacccacaattagaaccagagttcgtatatggagaatatcccaaatataacagctatagaagtagaaaatcagccacagaaaaatttcttttctactcaaatatactcaggttctttaagaaagaagacatacagacaaacgaagacggcgaaatagcatggaataaagagaagcatatcaaaattcttagaaaagtcttatcatatccgcaagttaacattgtcaagaaaacggaggaacaaacagggggcttctcaaaggaatcgattctccctaaaggcgaatccgacaaacttatcccaagaaaaaccaaaaattcctactggaacccaaagaaatacggcggattcgactctcccgtagtggcatattcaatcctagtattcgcagatgtagaaaaaggaaaaagcaagaaactcagaaaagttcaggacatggttggcataacaataatggaaaagaaacgattcgagaaaaaccccgtcgatttcctagaacaaagaggatacagaaacgttagactagagaaaataataaaactaccaaaatattcactatttgaactagaaaacaaaagacgaagactactcgcaagtgcacgagaattacaaaaaggtaacgaactggtgataccacaacgtttcacaacactattataccactcataccaaatagagaaaaactacgaaccagaacacagagaatacgtagaaaaacataaagacgagttcaaagaactcttagaatacataagtgtattttctagaaaatatgttctcgccgacaataacttaacaaaaatagaaatgttattttcaaagaataaagatgctgaagtaagtagccttgcaaaatcattcatatcgctgctcacatttacggctttcggagcaccagcggcgttcaacttctttggtgaaaacatcgaccgtaaaagatacacctccgtcacagaatgcctaaatgccacattaatacatcaatcaataacagggttatacgaaacccgaattgaccttagcaaactcggagaagattga

SEQ ID NO: 5326 - RNA, 4041 nt, synthetic construct
  misc_feature 1..4041: note = Cas9 variant
  source 1..4041: mol_type = other RNA
atgaatcaaaccaaaaactatgacataggcctagatattggcgtaggaagcgttggctggacaataaccgactcccaatctcaaaaagtactcaaagtaaaggggaaacaaggtattggcgtacacctgttcaacgaaggccaaacagcagaagaacgacgtcaatttagaacaaacaggagaaggctcaagagaagaaaatggcggctccgactacttcgagaactattcgatgaacccatatcctcaatcgacccagaatttttcgctcgtcttaaatactttaacgaatcaagcaaagaccccaaaaataagggttatcagccacagctacacgacgacttaaaagatgtggacttttacagacaatatcccacaatatatcacctacgacacgcattaatgacccaaaaagaaaaattcgatataagagacatatatctagcaatacaccacatcgtcaaatatcgcggccacttcttaatgaacggacatagcagtagtttttctgttgcccaaacagattggaaagcggacctcactaaactatttgaactaatccaagaaaccagaactaacttagacttttcgttcgacctaacagaaatagacaccataaaatccctactatttgacaagaacctatcgagaaatgacagacagaaagaaatagtaggactgatcaacaataattcccagctagacaagaaagacaaagcactgactaaacagctagtagaatcagtcgtcaaaggaattgttggaatgaaaactagaactgacatactcctaggctacgaagttgataacaaagaacaatcaaaggcttggaacttctcaatcgatgaactagacgaccaaatggcaactattgacccagcccttagccaaaattcacaagcacatgatataatcacattgatccaaaaactatatatgacagtacaattagcgcaaatagtacccgaaggccaatctgtttcagaaatgatgatcaatagatacaacctatacgccgaacaactacagcaactcaaagattacaagaaaataaacttagaaacaggcctattactaagagaagcatacgacgaattgatgaccaaagccttgactgctgctcctggaaaaacgatacacgatacgttttataacaaagtcaagaaaatcctcaaagatcaagataacaaacaagctctatcaataaaacaagccatagaagactctaattatctaatccccctccgaattaaaagtaatggcgtcattccatatcaattgcaccaaagagaattagacgcaatcatagaaaaccaaaaagaattttatccatttcttgcaacccccaaccctgtagatggacatcaagaagccttaccctacaaattagatgaattaatcggctttaaagtaccctattacgtaggaccaatggtagaccctgaagtagactccgaccaaaatttcgcttggatggtacgtaaagagaaaggcgaaataactccctggaattttcataacaaagtagacataacacaatccgcagacaattttataaaacgaatgaaaacgacagatacatatttaattggcaaagacgtcctacctcaaaattcacttttatatcaaagatataccgtattaaatgaattaaatggcataaaagtcgcaaataagaaactaaccatagaacaaaaacaacgactttacgaccaactctttaaaaagaagaaaactgtcaagaaacaagatatcttaaacaacctcgtcgcagcaggagaaatacacgaagatgacaatttaacaggactgtccaacggtacaacatttaacaacaatcttggatcctatatagactactgcaaaattatcggacaagataaactagaagatgcaagtaaacaagcagatattgaaagaataattgaatggtccacgacatttgaagacgcaaatatatttctgacaaaactagcggaaatcaactggttaacagaagatcagcgccaaaaactatcgcaaataagataccgcggatggggccaattctctaaaacccttttaacagacatcaaagataacaaagacaatagcatcattgacaacctaatgtcaactaagaaagtattcatgcaaattataaacgacacaacaataaaacagaaaattgatgactataaccaatatcacctaaatcacgcagacctaaaagatacaatcgctaacttgtttacctcgccacaaaataaaagagcaataaaccaaacactattagtcattgaagacataatcaatgcagtcggacacaaaccaaatcgtatcttcatagaatcagctaaagacaatagaaacgccaaaaatcaactaacacaatcaagactaaaacgcatagtaaaacaattcgaagacaataaacagcacgttgatcaatcagtatatgaggagcttaaacaactagacgacggatcacatgcatccatcgacgaccgattattgctctactttctacaaaacggcaaagatatgtatacaggacagcccattgacattagtcaactatcaacaagtcaataccacattgatcatatactaccccaagcaaaagtaatggataatgcactagacaatagagttttggtatctagcaaagcaaacaccgaaaaatcagacagattcttaagcgaaatacctcaattccaacaacgttctctatgggcagaacttgaaagaatgggcttcctaacgaaagcaaagaaagaacgacttctaatgacctcagatgaatttaaacaaaactcagtccgattcatcgccagacaacttgtagaaacacgtcaaataattaagctcgtcaaccaactaattatacaagaacaccccgaggtaaagctagtaaacatcaaagccgacctgacaaacgcctttagaaagaaatttaatttcgtgaaaaacagaaacgcgaacgactatcatcacgcctttgacgcctacctcacaagtttaataggatcacacctattgaaatcgcatcccaaatgggaaccactattcgtttatagcgattatgataaaataaaattcgataacgccccacaaggagtaaatataatgaaagagttcgaacaatcaaaacttgcggacgaaaatggagaaataatctggaacaaagatgaaatgatggcatacttggaacgactatataactcacgccaaatacttataacaaagaaagtctacgcacgacatggcaacctattcaaacaaactatctttaaagctggcgaaagtgacaacctcataccagtcaaaaataatcgttccgacatagccatatacgggggttacaaatcaaaacaagtttcctactatgctctcatatcactacataacaagaaaagacagaaacgcctagtagcagtatatttgatagacatacaaaaattacaaaacttaaacgaatcagactatttcaaaacactgcatactatcataaaagaacgacacaacatcaaaccagaatttgacatactagcagataaaatataccaaaaccaactaataatagataataaaaacggctccaacagaccattccgaatcgaaggagacttcaaaaatgatcgacaactgtatttgccccttcaataccaaagatggctagcctcaaaagaaccaactgacgaaaaactaaatagaatattcgatcacatctgcgaacaactcgccgattattttccattatttgccggaaatgcatgcgacaaacttctcgacaatagagataaattttaccaactatcaataaaaagcgagttcaacgacaaaggcaaactaatagcagaaggaaaactatcagtaatagataaattactcgtagcaatgcacgcagactcgcgaaatagtaatctagcagtgattggactaagtagttcatggggcagattcaaacttcacggaggaaatgaagctataggcacatctgtgcaattaatacaccaaagtccaaccggcttattcaaacgaatacaacgattcaactga

SEQ ID NO: 5327 - RNA, 4041 nt, synthetic construct
  misc_feature 1..4041: note = Cas9 variant
  source 1..4041: mol_type = other RNA
atgttatcagcaggggtaatgttaggtgatgtctcagcactcaagtcaagtagaaattcactgtttcaaaaatctaagaaattaatagaaaattcatcatctgacctcactaaagtcgattatagcaaaatgcgagaaatactattatcaattcgtaacatagccataagattcttcaataatgaagattttaaagaaagcgattattataaagagttcccaaccatatggcatttgaggaaaaacctaatggaatctgataaaaaggctgacataagattagtatacctagcactgcataatatagtcaaataccgaggaaactttttacaggaaaataataaagacctaagagcagctaacgcaaacgctggtgcagcagcaatagacttatctaatgcactagaagaatacttctcactgcatgaagatgaatctgcattgacctgtgtacccaatgtagcagacttacaaatgaccttagaacaaccaggactaagaaacggagaacgattagatagaatagtcgcagcactaaatatgccagacagagctagagcaaaattattcgctaaggcttgtataggtcaaaaagttgaatttagcaaattggcccttggaatggagaaacaagaaggcacgaatgcatacatatgggatgacgataaatacgacgaattagtagctctatgcccagaagacttcttcccagtactcgaaacacttaaaaacgcttacagtgcctatgttttaagcgacttattagcaggaaaactatcgatatctgcttcgttaatagattcttacgagcaacaccaaaatgacttgaaaatcgtaaaagagctagttagagaatacttaggacaaaaggaatacggacgtttattcagaggaccgaaatttgcaaacggagactacaatttcaataaagtcgcaaagccatcatacacaagctacatactaggcgaatcactgtgcaacaaacagggaacaacaagagaagaattagtcaaagaactgaaacgtgtattcgatgattgtagcgcgatacaagcagataaaagataccagaaaataaaacaacgcttagaagatgatccaaaattcctgatcaaacagaaaactagggcaaacggagctattccttatcaattacacctagaagaaatgcatcaaataatagaaaaacaaggaaaatattatccatttctggtagaacaacaagatcttatagaaaaacttgttagctctcggataccctattatgtaggcccattaaacggaggacatgatccaaatcatccctatcctaccaatccaatagaccccaaacggaaattcgcctggtcagtccgaaaaccaggtatggaacacgaaaaggcttacccatggaatgtagatgaggtcatagactccgaagaaacagcggaacgctttattagaaggatgacaggaacttgtacatatctctatggggagcctgtagtaccccgatgttcattattatacgaagaattttgcgtattaaatgaattaaatggtgcaagatggggagagggaaatggcgacactcatagatttgatagtagcgatagaacagaaatattggaacaactatttaagaaacgaaaaagagtaacacacaaagcaatagctacatggctagagattaatcacggtgtaacaaatgtaaaaatttctggtacacaagctgaaaatgcatttgaaagcaaacttagctcatataacgatttctgtaatttgctgggagttgacggtctagaagatgtttgcccattaacaaaagatgatatagaacaaataatactatgggtaactgtctttgaggataagaaattattattacaaaaacttcaaagagcatttggagataaattgtcagaaaaacaaatagcatcaataatgcgcaaaccttatgcagggtggggacggctatcttcaaaattattgacaggtattaaaagagaaaccccattcggtagaatatccattctagacgttatgagggacggcgacccacgacctggccaccatttggatgcgatgaattttatggaaatactaagagaaaaagacttcggatttcaggatagaatagatgaaataaataaagagagaactaaggaaagtgggctcctcctgtcagtagaggatctaccaggaagccctgcattacgaagaagcgttaatcaggcaatgcacatattgaaagaaatcgtatcaattgctggcaaagaaccaagccgcatagtaatagaagttacgagagacccagacgaagagaaaaggggacatcgcactgatacaagatataaacaattaagcgaagcattagcagcgatcaaaacggacatagtacaatttgactcatcactactagcagaactcaaggaaagaaaggacagtctggattcagaacgtttaatgctctattttcagcaatgcggaaaatctctatatagtgggaaaccactagacataaaccgattaagtgaataccaggtcgatcacattatcccacaatgttacataaaagacgatagtttagacaataaagcccttgtatttgcaagcgaaaatcagataaaattggatagcttgttactagacaaatcaataattagatctcaaaaagggagatggcaggaactccacagggcaggcttaatatcaaacaagaaatttcgaaacttaacctgcactgaaatatcagacagaatgatgaaaggattcataaacaggcagttggtagaaacatcacaaatagtaaaatttgtgcgacaaatgtgtgaacaacgctatgaatcctccgaagtgatctcactgagagccagtctgagccataacctaagagacagatgtggcttcataaaatgtagagagctgaatgattatcatcacgcacacgatgcctacctagcttgtcaaattgcaagattcatcggaattagatatcccagatggcaggacggaatatcaagagaatttataaataagtacatcaaacaattagtcaagaaaggaaaaagctcaggcaaattctttgcaggaaaatctggatttataatagattcattcatgcatgacggctttgatcgagaaaccggcgaaatatttcgtgatggatgggacgcaactttcgaaataacgagaatgcgaagggtattaggatataaagattgcttcataacaagaatgccagaagaacagacaggagcctactgggaagaaacaatatactcaccattggacgcgaaaaacgggaaaaacttgcaaatacccttaaaacagtcaggaaaggaaggatatttggatccaaagaaatacggaggaacaaacaccgcttttaatgcatatttctttgcatttgtcgcaaaagatgcaaggggaagggacaaatatttctttgaaggtgtaccggtttatttagcaaaacaattgaacgaacaaccacaaatattagttgattttgctaatagcatagctgcgactaagaaatgcagcacagcaaaaatactaaggtctaaagttcctttaaggcaaaaattcctcttagatggtacaagtttctatttaggcggacgaactggcaataaaaatgtgatactaagcggcgtagagtttgcatgcggtattgacatggcaaaaatgatagatactgcgataaaacacccggaggaattatctcaaaaagaattaatatctataatacaaatgttagcagacacaattgaaagaaattcggatagacaagcaagccttataaattttagaaggtttgacgataaattaagaaatatcgatgcaatcgctgcatccagaataataaagaatctactcaattctatgaatggggttaaacagagctgcgatctatcagatttaggaggtagcaaacaatcaggttttatgcaaagtaatatagcaactctattcgaaagaattacatggtgttattcaagtattacaggaatgttcgaacaacgagtgagtttcgaagatctgaaaaacggaatctga

SEQ ID NO: 5328 - RNA, 4041 nt, synthetic construct
  misc_feature 1..4041: note = Cas9 variant
  source 1..4041: mol_type = other RNA
atgaaaaaaagaaacagagaggaatactacgtaggactggatataggaacgtcatcagtaggctgggccgtggcaacaccagactatcgtataccgaaattccgcggtcacaaaatgtggggatcaagactttttgccgaaggaaaacgcgcagcagaacgaagacaatttaggacaaacagaagaaggctagcaagaagacgagatcgactccaaattctggaagaattatttgctgaagaaatggctaaagttgataatacatttttcatgaggttaaaagaaagtaaattcttcttagaagacaaaacagtcaaagagaaacatatcttattctcaactgacaagttcgacgcagatcgtttttacaaagacaatcccaccatatatcacgtcagaaaaagactcatggaagaggaacctcaagatatacgagaattatttcttgcagttcaccacatattgaagtacagaggccactttctgttcgcagggagtttagaacaaaatggtgatagtattgaagaactcgtgagaacactattcggtaaacaaggcctagccattcttgacgatacaatagactctaacgaaatggtaaatatattaaaaaataacgaaaaaacaaaatcagatagaaaaaaggcagtacaggagctatggaacccccttaaagacaaagttaaaaaagctcaagctgctgaaatggccggcgtagttttagggctaaactccgacatctcgaaattgtttgacaattccgattataaagacttgaaaataaacttcagttcaggagactacgacgagaaaagagacgactatgctaactctataggagatgacattgtgttgctagataccatgaaagcactttacgacacactaatactatcccagatattacaaggaaagcaatccatatcagaagctaaagtggaagattataacacccataaagaacaactcagggcattaaaagcaattctcaaaccacataaaaggttatataatgaaatgttcagagaaaataataaaaaagacctatctaattacgtagcttacataagctcatactccgaaggaaaaagggtaaatagagaagggttttataaatatgtacaagcagtcttaaaacaagtagacgatagcgactcaaaacaagcgatattagaagcgatacgactagaaaccttcctccctctacttcgagtaaaggataacgccgttataccacaccaaattcatcaagcagagcttgaagcgatactcgagacagctagaaagaaatataaattcctcaacgatgtttcagaaggtgtaagcgtcaaagataaaatcatccagctatttacctttagaattccctactacgtaggacctctgaatccacacagtggagagacagtggcagacagaaaacaaggtaccggctgggtagttagaaaacaaagaggaaaagtctacccatggaactttgctgatatggtagacgtaaaggcatcagctgaagcttttataactaacctaacaaacaaatgcacatacttaatcggcgaagacgtattaccaaaacgatcattactatactctgaatttatgttactaaacgaactaaatatgataaaatatgacggacatgaactgcctgttgaaatcaaacgactatatatagaacaagtcttcaaacaagaacacaaaaagcaaacaaaaggaagagtactagatttccttaaacggaatggattaatcacaggatccgcaaccgcagtcatcaccggaatggacgattcaataaaaggcgatctccagtcgtacagagatatggtacgaatatttggtaccgggttcgaccactcaatggccgaaagaataataaggtgggtaacactgttcggtgaagcaaaagacatattagaaaataagataagagaagtatatggcaatagcatttccgattcacaaatgagagctattaaaaaactcaaatacgccgactggggaagactaagtcaagcattctttataaaaataataggatgcgacaaatcaggagtagaacgaaacataataacctgtctgagagaaagttcccagaatttaatggaaatattatcagaccagggaacctatataaaacaaataaaagcatggaatcatcagcatacaacaaacatgatggatactctagactatcaattagtcgatgacttgtacgttgccccatccgttaaaaggtcaatttggcagtcactatgtatagttgaagaattagtaaaaataatgggtcaagccccaaaaaaaatattcgtagaagtaactagaacaaaccaagcagaaaaaaccaagaaagacagtcgcaaaaaaagactagtagaactatacaccgcaatcggcaaagaaggagcagcttggaaaaaagaaatagaaaagcaccaagcaggtgattttcgaagaaaaaaattatacctatattacactcaaatgggacgatgtatgtattcacatgaaccaattgctatggacgcacttttcacgtcagaatacgacatagaccacatatacccacaaagcctcactaaagacgattcatgggacaacctagtgctagtaaaaagtcagctcaataaagaaaaatctgaccaataccccctcaggccggcaatacgagaaaagaacaaagcatattggcaatatctctgcagggcaggttttataagtgagaaaaaatatgaaagattaatgaggacgacagaactgacagctgaagaactaagtggtttcatcgcacgacagttagttgaaacaagtcaagctaccaaagcagtaattggactgcttgaaagaatctacaaacatacggacatatgcttcgtgaaagctgaaacagtatcccaatttcgacatcaacacaactttataaaaataagagaactaaataactaccatcatgctaaagatgcgtatctcaacatagtcgtaggcaacgtataccacgaaaaatttacaaaaaatccaagagaatttattgcaagatcaaccgaacgaagaccatacaatctcaacagaatgtacgacttcgacttactcaaacaaggcagagtgatatggcaggtcccaaaatccctggagaccgtacaagccatgatgaaatcaaatgacgttagaataacaaaaaagcttttagtccagaagggcgaactctacgatgcaacaattacaaaagcacataaaactaaagaaggaatgtacttcccactgaaaggggctgatgcaagactacgcgatgttcatagatacggaggatacgagaaaataaagatagcatattactcagtattcagctgctgtgagaaagccagcgatacgatacatacactcattatccccataccagtatatgcagccggattactacagacagaagcagatttaacagcctacgcttggcagacgaagcaaaaaacaaaaccaataaaagatatctattctatgataacaccaatatacaagaaactttgtataaacacagttgttaaaattgacggatttaaatattttctaggtggaagaacagaagactatatatgcttatacccagctattccagtcgtacttgatgaacaagcggcagcatatctaaaagcagtaagcaaagtaggtagagctgacgatgtagagaacaccgctcaagcaatagacctaataactgctgaagcgaatgaagcattctacgacgtactactaaaaaaaatggaagcaaaaatttttgttaaagcctaccaggaaagagtagaaaaattagcaagcgaaacggctcgagaacggtttcggaagctctccataggagcgcagtgcagctgcctcttagaaatactaaacttgctagcaaataacaaaacaacttccaacttaaaaaaatggcttggggttactatgagcagaagaaaacaaccaatggacttaacaaaactcgaagagtgtatagtatatgaaacatccattacaggattatacgagaaagcggtgtcattactatga

SEQ ID NO: 5329 - RNA, 4041 nt, synthetic construct
  misc_feature 1..4041: note = Cas9 variant
  source 1..4041: mol_type = other RNA
atggtcgaacactacgcaataggttttgacataggaactggaagtaccggctttgcgggcgtagatcccaatggaaaattggtacgtatgcgaggtaaaaacgtatatggagtatataggttcaaaggaggcgaagccgcggcagaccgaagaggatttaggacaaccagaagacgcattaaaagacgaaaatggcgactaagatttctaaaatctttctttgaaccatatattgcacctatcgaccccgagtttttcctacgtcaaaaatattcggctgactcaccactagacccgaaaggaatacgggccgataaaggactgttatcagacatgtcagatcaagagttccatgctaaatatccaacaatttaccatctaagataccaactaatgcacgagaaaagacaattcgacgtacgcgaaatttatctagcaatgcaccacatcataaaatacagaggacatttccttatagaagacggcgcagataatttcgatgcaaaacaaattgacttctttgaccagttccaaagaatggcagcggttacagcaggactcccagaactagaaactttagtagttccagacgaaactcagtcagatgctttcaaacgtgtactctttgacgaaagccaaactaaatccgatagacaaaaagtactagccagccaactattagacatacaagacaaccaatcaaaagcaatcaaagattttatagcagcactaactaaagcggtcgtcggtatgaaagcaaatcttgccaccctcacttccacagccatagaaagtacagataaaaacgattggacaaaaccgctaggacaattagacgatttcctactcaaacatgaagaagacttagacgaagacggatacgctttaattgatgctgcaaatcaaatgtacagtgctgcagtacttgcagcactcgtccctgaagggatgggattttcagaagccatgatggctaggtacgcccagcacaagaaacaattagcactatacaaacaagtaatagcgagtctacctgacaaaactcaaagacacgagctaaaagacgcatatgctgattatatagagcacgcagctcaaaatccacgcgatgctttctataaaagagtaactaaagtcttggaaggtgtagactcagcagacgcccgcacagtaatgacagcaattagccacgacgaatttcttctaaaacaaagaacactatcaaatgggaaaatcccataccaaatgcaacaacacgaatttgatgctattatagaaaatcaaaaagcatactatccatggctggcaacacccaatccagtcgaagcagacgcaaaacgattgccctactaccttgacgaattaataggatttagagtaccatattatgtcggcccgatggttactgaaaaacaatcacaatttgcttggatgatcagaaaagcagacggagaattaacaccatggaacttcttcgatgtagtagacagagagaaaaccgctaatagattcatccagagaatgcaaacaacagataaatacattctaggcgaagatgtgctaccaaaacacagcattctataccaacaattcgaagtcttaaatgaactaaataacattcgagtggaaaaacacccattaacaaccgaacaaaaacaatttatctatcaaagattattcgttgaccaacagagaaaaacaataaccaagaaaaatctacaagatacccttgtagctatgggtgagttcgacaaagcgcctgatataggcggactagctaaagaagatgtaatgatgtctagcttagctacatttgcagactattctaaaatacttcccgaagccatttcagaccctactagacaaaacgacatagaagatatcatcgcctggtcaacaatatttgaagatacacagatattctttgataaactgaaaaccgttgactggctaacaactcaacaacgtaaaagattagcctcaattagatacactggatggggaaaactttcaaaacgcctattgcaacaaattcctacatctaaacacacaaatgtaatggcagcattatgggcaacatcagataattttatgcagattcttcaagatgaacaatttcaagaagggctgtacgacgcaaacagattaccagaagaaacactcactcccgacgaacaggtcgagaaaatactcgatgaagcctacctaagcccagcagacaagaaaggagcacgcaaagtgataaaagtcatgaacgacattgtaagggctaatcatggagtactccccgaacaagtttttctcgaatcagcagacgatccacagaaaaataaaaggagaagcgttagtcgatcaaaacaattagaagaaaaatatcgtcaagcagcccaatcattcattgacgaagccgtgaaagaagaattaaacgcacaaatagtcaattcagctgaatttaacgacagattagtattatactttactcaaaatggtagagacatgtatacaggaaaaagactcgacatagaaaatctcggttcttaccaaattgatcacatattacctcaatccttagtaaaagatgactccctagataatagagcgctaacagcacgtgatatcaacgcagaaatgtctaaccaatttgtgtctgaaagatttggattaggcccaagagcattttggcaacaacttaaaaataatggactaatatctggcagaaaatttcgaaatctagttatgcaacgcgatgaaattgacaaatacgcacccggtttcattaatcgccaactggtcgaaacaaggcaaattataaaaacagtcgaacaaattattcatcgcttatggcctgatatccaaatcgtgacaataaaagcaaatcttacacatcaggtacgttctgaattagggttccctaaagtaagggagctaaacgactaccaccatgcgttcgacgccctcttagccgcaagaattggtcaatacttgctagagcactacgcaggtcttaaaccattcttcacttacggggaatttaaaagaggcgacactaagaaatacggaacaacaaacttcttgagaagattaacaaaagacaataaagacaagaaaggagaacttttgcccgaagtaagcgactggatagacagcatagatagtatttacaattacaagaaaataccagtagtatgggaaaacacaacaaacatgagtgcactgtttgaccaaactatatatccgagaccagaccgcgacacaacaaaaagaaaacttatacctacaaaattagacaaacctactgacatatatggcggatacagttctgccaaaacagcatatatggcagtaatgcgagtacaaactaagaaaggaactgaatacccagtatttaatatccccgtttctatagcgagtcaactaaatcgcataacagaccaaacaatgctcaaacaacaagtgaaacagttcataatcaatgcggaacaatctgctagtaaaaagaaactttacgaatcaggagacgttatactatcaagagtagcattgggacaaagattcacagataaaaactacggagaagtattcttaatatccaatatggaagtacagaatccccagtctttatggttaggtcgcgcttcacaacaacgtctaacacgagaacccgaaggtaacgaaaaaccagaaacctctcttgcagacatctatcagcaaatactaaaacaagtcgataggtattttcttgcattcaacatacgacaacaaagacaaaaactattaggtactcttgatcaatttacatcgcttccagtaggaagagttaacgagcaaaccagaaccgatcaaaaccaaagatctatcatcgcacgagtaatgatagtactaggcaaaggttcaagggaagagaaatttccagaatttggactttcagctttaggtcgattagtcagaacaggcggaattacactgtccgaagacgcacaaatcatctaccaatcaccaacaggcttatttgaacgacgcgtagccttgaaagatctgtga

SEQ ID NO: 5330 - RNA, 4041 nt, synthetic construct
  misc_feature 1..4041: note = Cas9 variant
  source 1..4041: mol_type = other RNA
atggcaaaaatattaggactggacctaggaaccaattcaataggatgggcggttgttgacatagaaaacaataacgaatttacacttatagaaaaaggagtcagaatatttcaagaaggagtaaaaatagaaaaaggaatagaaggaagcaaagcagcagaacgaacaacttatagatccgcacgaagaataaaatatcgaagaaaactgcgaaaaatacaactattaggcgtcttatccgaaaacggatactgtccgttcttgtccaaagacgaattagactcatggagatacaagaaagtatatcccacaaataaatcttttctaaattggcagaaaaccaatgaaatacaactagaaaacccgtatttttacagagcccttttagtagagaagaaactaaacctgaatatagaagaagaccgttttaaaatagggagagccttctatcacctagctcaaagaagaggtttcttaagcaataggatggaaggaactaaagaaaacgatggaactgtaataaaatcaataacagaaatctcaacagcaaaaggagacaaaacactaggtcaatatttctacgaacgatacaagaaaggagagaaaataagagatacatacacacacagggaagaacactatctagaagagttcgtccgtatttgtgaatttcaacaactggacaacaaattcgcggaaaaagtaagaaaagctatattttatcaaagacccctgaaatctcaaaaaggactaataggcaaatgcgtattcgaacctaagaaatctcgctgcagtgtaagtcgaccagaatttgaagaatatcgaatgctatgcttccttaataacataaaaattaaaacaccatcagacgaaaatttaagatttttgacagacaacgaaaaagaaaaacttaaacctcaattctttcgaaaatcaaaagatcactttgacttcgaagacttagtaaaacaactagcgccaaagaatcaattcaagttttacaaatcaagagacatattgccaggtaactggctatttaactacagcatgaacactacggtatccggatgtccaatctcggcaagactgaaagatctcttcggtgaaaatttcatggatataaaattcgactatatcagagaaaaagatgggaaaaagtcagtaatcgacatacatgacatttggcacgtcctcttcacctacgactctgaagaaaaattaaaagaatttgcccggaacagattaaacctagacgatataaaaataaaagagttccaaaggattcaactcaagaaagaatatgcagcgttatcgcttaaagcaataagaaaaattctaccattcctacgagaaggactcatatattcacatgctgtattcatcgcaaacatggaaacagcaattccctcagaaatctggaataattataccaacaggaacattatcaaaaacgaaatatacaacataatctcaaatcaaactgaagataaacaagtagttgacatcgttaacggaataattaaaagtagtagaatagaaaatagcgtatggtccaacgaagctgtagaatttttcaagaaagatctaaacagtaaaattaagaattactatggaataaagacatacaacgactttccagaagaaaagaaaatcagaatagaaacctacgcgttcaatctatttaaacaacagatgatgaaaaactttggaaggggagaatttgcagcggttcaaagaatagacgaacgccttaaattatttttaacagacaacttcaacatagaccccatactactcaagaaaatttaccatcccagcgccatagaagtctaccaaccacccgtaaggaaaaacgacggcaaattatacttgggatctcctatggtgagttccataagaaacccaatggccatgcgtgccctccatcaattaagaaaattgataaatgaacttataagaaaagaattgatcgattctaatacaaaggttaacatagaaatggcacgagaactaatgaacgctaatgaaagaaaggcttaccaaaactggcaaaacgaccgcgagaaaataagaaaagaatacgcactgaaaataaaacaacatctagacgtcgacaaagaaccatccgacgtagacatccttaaataccaattatgggaagaacaaaaccacaaatgcatatatacaggaaaagaaatcaacataagcgacttccttgggagcaaccctaaattcgacatagaacatacaatacctcgctcaatcagttttgataactctcaatccaacaaaacattatgtgaaaactacttcaacagatcagtaaagaaaaatcgaataccagctgcactaccaaaccatggcgaaataattgaaagactagaaaactggaaactgaaatatgaagaattagaaaaacaaatacaatacgcagtacgacaagcaaaaggagcaggcgataaggattctaaagatagagccatacagaaaagacataaacttaaattcgaatatgattactggaaaaacaaatacgacagatttgttatggaagacgtcccagaaggattcaaaaactcacaattggttgatactgggataattacaaaatactcaaggatgtacctaaatacgttatttgacaaagtatacacagtaaaaggtaacacagtagccgacttccggaagttgtggggcattcaagacgaatatgaaaagaaagctcgtgtaaaccattcacatcactgtgttgatgccataacaattgcctgcataacgaaaagtaattatgaaaatttagccaaattttaccatgattgggaagaattacacgtaaagggaattgaccaactaccaccaatgaacaaaccatggaaaacctttacagaagacatcaaagcaatacaatacgagatcctagtaagccattatacacccgacaaccttccaaaacaatcaaagaaaatacttcgtaagaaagggagaatacagaaaaatgagaacggaaacccaatatacctcaaaggagacactgtcagaggatcacttcaccaacaaacattttatggcgccatcgagaaaaccgaagtgaataagaaaggagaacccgaaaaagtaatcaaatacgttgttcgaaagagcctcgacgtactcgacgactcctcagttaaaaacatagttgacgatatcgtaaaagaaatagtccaaaacgccaggataaaagaaaaagattttataaaagagcttgaaatacaaaaacgaaaactagcaaaagcagaagaaaacaaggtagtccaaatacaagccgaaatagacaaactaaacaaacaagtcgcggatctgtatactatgcctaataaaaacggaaatccaatacctatcaagaaagtaaggatattccagacttcagtaacaaatccaatccatctcaaacaacaaagagacaaaagccagaaaacttcgaaaccacataaagagttctactacgctgcaaacgactcaaactacatgatggcaatctacgaaggcaaagacgaaaaaggaaaagttaaaagagacttcaaactattgaacaatctagaagcaggagagttctttaaatacagcgtacacaaagatctaaaagagaaaaatttagaaaatataagaaatgttataccagacaaggtaagcgcaggaaaaatcgaaatcccattaaaagccataataaaaacaggcacaatggtaatactctgggaaaatagcccagatgaagtgtgggatctcaccatatccgaagtagataaaagattatacaaagtagtaggaatgtcagtcaacaggatcaaatcagatgtaaaaacattcgagttcggaaacatcgtactacgtcataacaaagaagcaagtcccgctactttgcttaaaatacaggacggagagttcaaatcagacgaaaactacatagcacaaagaaaactatctcacaaccaattcaacgctctagtcgaaggagttgatttttcgttaagtgtactaggtgaaatcaaacgactcaaatga

SEQ ID NO: 5331 - RNA, 4044 nt, synthetic construct
  misc_feature 1..4044: note = Cas9 variant
  source 1..4044: mol_type = other RNA
atgggagaagatgggaagccagtacgtgtaaaaggaaaaacagctataggtgcacgcctgtttcaagaaggacatgtcgcagccgataggcgaatgttcagaacaaccagaaggagactaaacagaagaaaatggcgactaaaattattagatgagatatttgacccatacataaccccagtagacagtacatttttcgccagacttaagcaaagcaacttatcaccgaaagactctaggaaagaattcaaggggtcaatgttatttccagatctaacagacaaacaataccatgaagactaccctactatatatcatctacgtagagctttaatgacagaagacaagaaatttgatatcagaatggtgtacttggcaattcaccatattgtcaaataccgaggaaattttctaaacagtgcaacggtagatacctttaaagcgtcgaaagtagatttcaaaaaatcctttaaccaactgaacgagctttattcagccatcaaccctgaagacgcattccaagtagatatgaataaaagtgatgaaactggtcgtctattcttagactcgtcaatccggaagtttgacaaacaaaaacaaatatcaaagttaataccagtagtggtagaagataaagaagcaaaaaagctaaacggcaaaatcgcactagaaataacaaaagcaattctaggttacaaatcgaaactaaatgttgtaacacaaacagaaccagaagacccaaaaaaatgggccgtaaaatttgatgacgaagatatcgactcgaaacttaatgatattctcccagaaatggacgaaaaccaacaatccatagtcgaaattatacaagatctatattcacaagtgactctgaatcaaatcgtccccaacggaatgtcattatctgacagtatgataaaaaaatataacgaccaccacgaacatctgaaactctacaaaaaacttatagacaatataagtgataccaaaaaacgctctgcgctcaaaacagcgtacgataaatacgtaggtgatgatggaaagacaatagaacaagatgaattttacagtaacgtcaaaaaaaatttagatgacagtgatctaagtaaacaaatagcagatttaatagaagccgagaaatttatgcccaaacagcgcacaagccaaaacggagtaataccgcatcaactgcaccaaagggaattagatgaaataatagaacaccaatcaaaatattatccctggttcgcggaagcaaatccaaacaaacatgacctccacctagcgaaatacaaaatagaagaattggttgcattccgcatcccatactatgttggcccaatgataactccagaagaccaagaaaagtcttcacaaactatatttgcctggatgaagagaaaggaaccagggcaaattaccccatggaatttcgacgaaaaagtagacagaatggaaagtgcaaatcggtttataaaacgtatgacaacaaaagacacatacctaattggcgaggacgtactaccagatcaatcactactttatgaaaaatttaaggtactaaacgaactaaatatggtaagagtaaacgaccaccctttaaaagtctctgaaaaacaagcgatttatagagatttattcgaaaatcaaaaaagaatatcagttaaaaatcttcaaaattatgtaaaaagtaaaagcggattaccaacgggacccaagatatcgggactcagcgacccggaccactttaattctagcctcggcacttataatgatttcaaaaaaatgtttggagacaaagtggatgacccagatcttcaagacgacttcgaaaaaatgatagaatggtcgacaatattcgaagacaaaaaaatactcagagctaaactagacgaagtagcatggctaagcgatacgcaaaaaaacgaattcaaagaaattagatatcaaggatggggcagactaagtaaaaaattacttacaggaatagtcgatggaaatggacagcgaatcatagacgaactatggaacacaaataaaaatttcatgcaaatccaatcggatgattcttttgcaaaacggatacacgaagcgaacgctaatcaaatgaaggcaacagacgtcgaagacgtcctagccgatgcttatacctccccacaaaataaaaaagcaataagacaagtagtaaaagtagtcgatgatattcaaaaagctatgggcggagttgctcccaaattcataagtatagaattcacacgaagcgaagatcgaaacccaagaagaaccatatcgagacaaagacaactagaaaataccctcaaggacacagcacaagcacttgtcaaatcaataaacccggatatactgagtgaattagataatgcatccaaatcaaaaaaagggttaacggacagattatacttatactttacacaattaggaaaagatatgtataccggaaaacccataaatatcgacgagatcagtaactatgatatcgaccatatattcccccaagcatttataaaagacgactcactaaataatagggtactagtcagcaaagcaggaaataacggtaaatcggccaacgtaccactaaagctattcggagctaaaatgggtggttattggaaacaactagcagacgcaggtctaataggacaaagaaaattaaaaaatttacaaacaaacccagacacaataagtaaatttgctatgcacggattcataagacgccaactagttgaaaccagccaagtaatcaaattagtggcaaacatactaggtgacaaatacagaaacgacgacacaaaaataatagaaataacagctagaatgaaccatcaaatgcgtgatgaattcggcttcataaaaaacagagaaattaatgactaccaccatgctttcgatgcatacctaactgcctttttaggccattacttatatcaccgatacattaaactccgaccatacttcgtatatggcgatttcaaaaaattcagagaagacaaagtaactatgagaaatttcaacttcttacacgacctaacggacgataaacaagaacgcatagcagatactgagactggagaagtaatctgggatcgcaaaaggagtattcagcaattaagagatgtataccactacaaatttatgctaatatcacaagaagtcttttcactcaacaaagaaatgttcaaacaaaaactattccccgcaacactagctaaaaagagcaaattaatccaaataaaaaaggataaacccgttgatatttacggaggatactccaataataccgacgcatacctaaccgttgttaaacttaaaggatcaaaagaagataaatacaaaattgtaggagtaccaatgagggcactagataacttaaaacacgctgagaaagagtcaccccaatcatatacagctgaactccgtaaagcattagaaccacaattcacaaagataaaaaaaaacagaaaaacaggtgaagtgtcaaaagttgttacgaactttgacattgtattaggacgactcttctaccggcaaatggttattgacggaagcgaaaaatcactaatagcctctagcgtgtaccaatacaatgccaagcaactagtcctttcagatcaagcaatcagaacaatatcagatcaggaaggaatagacgaatttgaattaagttcgcaatacgacaaagtttacgacgaaatagtacagaaagttgaaaaactacttcccatatttcaacaccgacattttcaggagcgcttaaataacggcaaatctctattcgtaaatttgccagtacacgatgtttacgaaggaaataagctcgaacaagtcgggaaaaaacatataattaattcaatactaggaggaatccacgccaatgccgaccgaccagatattgacttatttggcataaaaaatttaggacagttttcatctaccagcggaataaacctatcatctgatgcgatcatatgttaccaaagtccgactggactatttgaaagaagagttgttctaaaagacttatga

SEQ ID NO: 5332 - RNA, 4044 nt, synthetic construct
  misc_feature 1..4044: note = Cas9 variant
  source 1..4044: mol_type = other RNA
atgacaaagcgcgaagaaccctacaatgtaggattagatatcggatcaagctcagtagggtgggccgtcgtagacaacaattaccatctgctaaatataaagaaaaataatttgtggggagcaagactattcaaagaagctgaaacagcacaagttacccgtggacaccgctcaatgcgaagacgatatagacgtcgaagaaacagattgaactggctcgacgaactattcgcagatgaattagcgaagatcgacccatccttcttactaaggatgaaaaactcatgggtcagtaaaaaagaatctacccgcaaaagagacccatacaatctattcatagatgaaaaatacaatgacgtcgattatttcaaccaatacccaacaattttccatctcagaaaagaactaataactgaagacaaaaaagtagacatcagactcatctacctagcaatacataatataataaagtacagaggtaactttaccctagaaaaccaaaatttcgatatctcgcaattgtcttcgaacttctcccaacaaatatctgacttcttcgccctattttcagactttggagtcataatgccagaagattttgatcctgacaagatatctgacattctactgaatccaaacctatcaccgtcaggaaaagtatcagaagcaatcgcaacaatctcaccaaaaaccaacgtaaaagcaaaaataaagatcatactattattattggtcggaaacaatggtgaccttaaaaaactgtttgacctcgaaaccactgaaaaaatcgctgtaaaactttcatctcggcatatagattcagaactcccaataatactatccgaacttaacgaacaacaagaaaatatcatcacaattgccaattcaatatttggctcaataatattaaaagatttccttggtgacgaaacatcaatatccgctgcaaaagttatatcgttcgaagatcataaacaagatctacagaaattaaaaacaatgtggagagaaacatccaacaaagaagctgtaaaagcgggaaaaaaagcatatgaagactatataggccacgaagatagcgaaacattctataaaaaaatcaaaaagtttcttgaaaaagcacaacctgtagatctcgccaacaaagcactcgccgagatagaattggaaaactacctccccaaacagcggaaccgaaacaacaccgtcattccataccaactaaacgaaaacgaactaatagctatacttgatcatcaagaaaaatattacccctttttaaaggaaaatcgtgataaaatactctcacttttaacatttagaattccctattacgtaggcccgttacaggactctaacaacaacagattctcttggatgacccgaaaagctagtggagctatcagaccctggaatttctcagaaaaagtcaacgtagaacaaagtagcaacgacttcatcaaacgaatgaggtcaacagatacatatttaattggagaaccggtgctaccaaaaaaatcattaatataccagtgttacgaagtactcagcgagttaaataacacaagagtaaaagacgggtctagcaacccaaaacggctagacgtaacaataaaacaaagaatatacaatgaaatatttaaaaatcaaaaatcagtatccgttaaagttcttcaaaattggctaataaaagagtcttacttcaaatcaccagaaatctcaggactagctgataaaaaaaaatatttaagcagtctatcgacctacatagactttaaaaaaatatttggacaacgctttgtcgacgatccagtaaactccccccaattagaagaactagcagaatggttaactctatttgaagataaaaaaatactgctcataaaacttcaaaactcaaaatatagttatgaccaagcaacaatcaataagctctcaacaatgcgatatcaaggaacaggaaaacttagcaaaaaattgttagttgatttaaaaactacaaaaaaaagtattggaaaatccggcgccgaatccctatcaatactagatctcatgtggagcaccaaggacaacttcatgcaaatcattcacgacgcagactacaccttcgaacaacaaataaaagaatttaactacgatacagaagacgaactaacacctctagaaaaagtagcaaatctgcatggatcgccagccctaaaaagaggactcaatcaatcaatcaaggtagtagcagatatagtaaaattcatgggacatgatccagaaaaaatctttatagaatttacccgaagcgatgatttttccaaattaacaataagcagataccgtcgtatcaaaaaacaatacctcgaaattgcaaaagcaatcaagaaaatcccagccgaatttaaggacataaaagagtaccaaacacaactagaagaaaacaagggtaaattagcaagtgaacggttaatgttgtacttcctacaatgtggacactcgctatattcaaataaaccaattgacttaaacatgattaactcatcaaaatatcacgtagaccacatcttaccacaatcatacataaaagacgattcattagaaaataaagcattggtattggcgagtgaaaatgaaaacaaaatagacaacatgctcatttcccatgacataatagccaccaatctacctagatggcaagcgttaaaagatcaaaaccttatgggaagcaaaaagttcgccgacctcactcgtacaacagtaactgaaaaccaaaaaaaaggatttatacagagacaactagtacaaactagccagattgtcaaaaacataacacttatcttaaatgatttatacaagaacacatcatgtatagagacaagagcaactctctcctcagaatttagaaaagctttctctaacttcgacgaaacaacctaccattaccaattcccagaattcgttaaaaacagagacgtcaacgatttccatcacgcacaagatgcattccttgcttgtgtaatcggtgaataccaattaaaaaaatatccgaaagataatctaagactagtttatgatcaatacagtaagtttctcgattcattgaaaaaagacaccagaaagaaaaacggcagaatgccaagatacacccaaaacggatttattattggatcaatgtttaacggcaaaacatatgtcgacgataacggcgaaataatttgggaccaaaaaatcaaagaatccattagaaaaactttcaactatcaccaatttaacgtagtacgtcaaaccatcgaacaacatggcaaattatttaacgatactatacaaccgcattcagatcgctacaaactaatacccttaaaaactaacagagacccggctatatacggaggttataataacgacaacaatgcctattctgtcgtcctggacgttgacggaaaaaaaaagatcaacggaattcctataagaattgcaaaccagttaaaatcagatgaattagacctttcctcatggttagaaaacaatattaagcataaaaaaccaatgactatcctcatcgataaagttccaaaatatcagcgtataataaacgaagaaaccggtgacctacttataaccagcgcaaatgaagttataaataacgttcaattgttcctaccatccatgtacactgcacttatctcactactagacagcacaaaaacagaaatgtattcaaagttactatccaattacgaagcaaacatactcatagatatttatgactatttattaacaaaactgaaaaacaactatcccctctatcgcaaagaatgggctaaattagcagaacacagagatgatttcatagaatcagacctagtgacacaggcgagcactctacaacaactcataaaatttatgcacgccgacccctcaaatgtcaaccttaaattcgggaacttcaaaggaaatcgctttggccgaaaaaacggaaatataaaactcagcaaaacagacttcatatacgaaagcccaactggcttgttcaaatccataaaacatatagattga

SEQ ID NO: 5333 - RNA, 4044 nt, synthetic construct
  misc_feature 1..4044: note = Cas9 variant
  source 1..4044: mol_type = other RNA
atgaaaagcgaaaagaaatactatatcggtctcgatgtaggtactaactctgtagggtgggctgtaaccgatgaattttataatatcctgagagctaaagggaaagatttatggggtgtcaggttattcgaaaaagccaaaacagcggctgacacaagaaccttccgcagcggtagaagaagaaatgaccgaaaaggtatgcgcttacaaatcttaagagaaatttttgaagatgaaatcaaaaaagtcgacaaagatttttatgacagactagatgaatcaaaattttgggccgaagacaaaaaagtttcaggcaaatacagcctattcaacgacaaaaactttagtgataaacaatacttcgaaaaattcccaacaatatttcacctaagaaaatatctcatggaagaacacggtaaagtcgacatacgttactatttccttgcaataaaccaaatgatgaaaagacgaggtcacttcttaatcgacggccaaataagtcacgtaacagacgacaaaccactaaaagaacaactcatactactgattaatgatctactaaaaatagaattagaagaagaattaatggatagtatattcgaaatactagctgatgttaacgaaaaacgcaccgacaaaaaaaacaacttaaaagaattaataaaaggtcaagatttcaacaaacaagaaggaaacatacttaattcaatcttcgaatctatagtgaccggaaaagcaaaaataaaaaatataatcagtgatgaagacatactagagaaaatcaaagaagataataaagaagatttcgtacttaccggcgatagttacgaagaaaatttacaatatttcgaagaagtccttcaagaaaacataacactatttaacaccctaaaatccacctatgatttcgttatattacaatccatcctaaagggaaaaagtacattatctgacgcacaagttgagagatacgacgaacacaaaaaagacctagaaatactaaaaaaagtaatcaaaaaatatgacgaagatggaaaactcttcaagcaagtattcaaagaagacaatggtaatggttacgtctcctacatcggatactatctcaacaaaaacaagaagataacagctaaaaaaaaaatatcaaatatagaatttactaaatatgtaaaaggaatactagaaaaacaatgtgactgtgaagacgaagccgtaaaatacctcttaggaaaaatcgaacaagaaaacttcctattaaaacaaatatcatcaataaatagtgtaataccacatcaaattcatttattcgaactggataaaatactagaaaaccttgcaaaaaattaccccagcttcaataataaaaaggaagaattcacgaagatagaaaaaatcagaaagacttttacctttagaataccgtattatgtaggtccgcttaatgattatcacaagaacaacggcggtaatgcatggatattcaggaataaaggggaaaaaattcgaccatggaactttgaaaaaatagttgacctacacaaatcagaagaggaattcatcaaacgaatgctaaatcaatgcacttatctcccagaagaaaccgtcctaccaaaatccagcatcctctactcggaatacatggtcttaaacgagttaaacaacctaagaataaaaggcaaaccactagacacagacgtgaaattaaaactaatagaagaactattcaagaaaaaaacaaaagtaaccttaaaaagcataagggactacatgattcgaaacaacttcgcagataaagaagactttgacaacagtgaaaaaaatctagaaatagtttccaatatgaaaagttacatagacttcaacaatatcctgggagacaaattcgaactagaaatggtcgaagacctcattgaaaaaataacaatacatacaggaaacaaaactctccttaaaaagtacatagaagaaacatatcccgacctctcatcctcacaaatccaaaagatcattaatctcaagtataaagactggggccgactgagtcgtaaattacttgacgggataaaaggccgtaacaaaactgacgacgtaaacaccgtaatcaactttatgagaaactctagcgacaatctcatgcaaataatcgaaggaaaaaattactcctttaacgagtatattgacaacctaaggaagaaatacataccacaagaaataagctacgaagttgtggaaaatctatacgtatcaccatccgtaaaaaaaatgatttggcaagtaattagagtaacagaagaaataacaaaagtaatgggctacgacccagataaaatatttattgaaatggccaaatcagaagaagagaaaaaaactactatttcacgaaaaaataaactcttagacctatataaagcaataaaaaaagatgaaagagattcacaatatgaaaaactactaactggattaaacaaattagacgaatcagaattgcgtagtaaaaaactatacctatattatactcagatgggaagggatatgtatacaggtgaaaaaatagacttagacaaactatttgattccacacactatgataaagatcacataataccacaatcaatgaaaaaagacgactcaataataaacaacttagttttagtaaacaagaacgctaaccaaactactaaaggaaacatctacccagtaccctcctcaattcgaaacaatccagatatttacaattactggaaatacctaatggaaaaagaatttattagtaaagaaaaatataacaggctaatcagaaacaccccattaacgaatgaagaactcggagttttcataaatagacaactagtagaaacgcgccaaagcacaaaggcaataaaagaattattcgaaaaattctaccagaaatcgaaaataataccagtaaaggcatcgctggccagtgatctccgaaaagatatgaacacactaaaaagcagagaagtcaacgaccttcaccacgcccacgacgcattcttaaacatcgtagcaggagacgtatggaacagagaatttacatctaatcccataaactatgtgaacgaaaaccgggaaggagataaagtgaaatattcactttctaaatattttactagaccaaggaaatcaaaaggaaaagtgatttggacccccgagaaaggtagaaaactcatagtagatacactcaataaaccatcagtgttaatctcaaatgaaagtcatgtaaaaaaaggagaactattcaatgcaacaatatcgggaaaaaaagactacaaaaaagggaaaatatacctacctctaaaaaaagatgatagactaaaagacgtgagtaaatacggaggctacaaggctataaacggagcgttctttttcttagtagaacataccaaatcaaaaaaaaggatccgaagcattgagctctttccactacacttactatcaaaattttatgaagacaaaaacacagtactagattacgcaatcaacgtactacaattacaagaccctaagataatcatagacaaaattaattaccgaacggaaataatcatagacaatttctcgtatctaatctccactaaatcgaacgatggatcaataaccgtaaaacccaacgaacaaatgtactggagagttgatgaaatatcaaacctcaaaaaaatagaaaataaatacaaaaaagatgccatcttaaccgaagaagacagaaaaataatggaatcctacatcgacaaaatctaccaacaattcaaagcaggtaaatataagaaccgcagaacaaccgacacaatcatagaaaaatatgaaattatcgacttagacacattagacaacaaacaactataccaattattagttgcgtttataagtctatcatacaaaacctcgaacaatgccgtagatttcaccgttataggcctcggtacggaatgcggcaagccgagaataacaaacctcccagataatacatatttagtgtataaaagtataacaggcatctatgagaaaaggatccggatcaaatga

SEQ ID NO: 5334 - RNA, 4047 nt, synthetic construct
  misc_feature 1..4047: note = Cas9 variant
  source 1..4047: mol_type = other RNA
atgaaaaagccctatacaatcgcactagatattggcacaaacagcgtgggatgggtagttgtcaccgacgactatcgagtacctacaaagaagatgaaggtgctcggaaatacagaaagaaaaacgattaaaaaaaacctaataggagctcttctattcgactccggcgataccgcagaagggacccgattaaagcgaaccgcaagaagaagatacaccagaagaaaaaatagactcagatatctaaaagaaatattcacagaagaaatggcaaaagtcgatgacggattcttccaacgactcgaggatagtttctatgtgctcgaagacaaagaaggcaacaaacatcctatattcgctaatttagcagacgaagtcgcttaccacaaaaaataccccacgatatatcatctcagaaaagaactagtcgacaacccacaaaaagctgatctaaggctcatatatcttgccgtcgcacatattataaagtttcgtggccacttcctaatagaaggtacattaagctctaaaaataacaatctccaaaaaagcttcgatcacctagtagacacatataatttactatttgaagaacaacgcctactgactgagggaataaatgcaaaagaattactcagcgcagcactctcaaaaagtaaaagattagaaaacctaataagtcttataccaggacaaaaaaaaacaggcatatttggcaacatcatagcattaagcctaggactaacaccgaatttcaaagccaatttcggactaagtaaggacgtaaaactacaactggcaaaagacacctatgcagatgatctcgattcactactcgcacaaatcggagatcaatacgcagatttgttccttgccgccaaaaatttatctgatgcgattttactaagcgacatactcacagaaagtgatgaaatcacaagagcacctctatctgcaagtatggtcaaaagatacagagaacaccacaaagatctagtgactctcaaaacactaatcaaagatcaactcccagaaaaatatcaagagatctttctggataaaacgaaaaatggatatgccggatacatcgaagggcaagtatcacaagaagaattttataaataccttaaacctatcctagcccgattagatggatccgaacccttattattaaaaatagatcgagaagactttttgaggaaacaaagaacattcgataacggttcaataccccaccaaatccacctagaagaactacatgcaatattacgaagacaagaagtgttttatccgtttttaaaagacaacaggaaaaaaatagaatcacttctaacattcagaattccctactacgtcggaccactcgcacgaggtcatagcagatttgcctgggttaaaagaaaatttgatggagcaatccgaccatggaacttcgaagaaatagtggacgaagaagcttctgcacaaatattcatagagaaaatgacaaaaaacgatctctacttaccaaatgaaaaagtactaccaaaacactccctattgtatgaaacctttaccgtttataacgaactaacaaaagtgaagtacgcaaccgaaggtatgacaagaccgcaatttctctctgcagaccaaaagcaagcaatagtagacttgttatttaaaactaacaggaaagtcacagtaaaacaattaaaagaaaactacttcaaaaaaattgaatgttgggacagtgtagaaattactggcgtggaagactcttttaacgcctcccttggcacatatcatgatctactcaaaattatacaagataaagatttcttagataatccagacaatcaaaaaatcattgaggatataatactaacactcactttattcgaagacaaaaagatgatatcgaaacgactagatcaatatgctcatttattcgacaaagtagtcttaaataaactagaaagacaccactacacaggctggggaagattatcaggcaaattgataaatggcatcagggataaacaaagtggaaagactatattagattttttaaaagcagatgggttcgctaaccgaaattttatgcaattaatacatgacagtgaattatcgtttatagacgaaatagcaaaggcacaagtaataggtaaaacagagtattcaaaggatttagtaggaaacttagccggatcgccagccataaaaaaaggtatatctcaaaccattaaaattgtagacgagttagtcaaaataatgggctatctcccacaacaaatcgtcattgaaatggctagggaaaaccagacaaccgcccaaggaataaaaaacgcccgtcaaagaatgagaaaattagaagaaaccgcaaagaaattaggatccaacatactaaaagaacacccggttgataacagccaactccaaaatgataaacgatatctatattacctgcaaaatggaaaagatatgtataccggtgacgatctagatatagattacctaagttcatatgatatagaccacatcattccacaatcgttcataaaaaataatagtatagataacaaagtactgacctctcaaggtgccaaccgcggaaaactagacaatgtacctagcgaggcaatagttcgaaaaatgaaaggctattggcaatctttactgagagcgggtgcaataagcaagcaaaaattcgataatctaacaaaagcggaaagaggaggactaacccaggtggataaagctggcttcatccagcgacaactggtagagacacgacaaataacaaaacacgtagcacaaattttagatagcagattcaacactgaatttgatgaccacaataaaagaattcgaaaagtacacattatcacacttaaatctaaactcgttagcgatttcaggaaagagtttggactatataaaatacgagacataaatcactaccatcatgcccatgatgcctaccttaacgccgtagtagcaaaagcaatattaggtaaatatccccaattagcaccagagtttgtatacggcgattacccaaaatacaactcattcaaagaaagacaaaaagctacccaaaagatgctattctactctaatatactaaaattcttcaaagatcaggaatctttacacgtgaattcagacggcgaagaaatatggaacgcaaataaacatcttccaataataaaaaacgtcctttcaataccacaagtaaacatcgttaaaaaaactgaagtacaaacaggtggattttacaaagagtcaatactttcaaaaggtaactcagataaactcatcccaagaaaaaataactgggacacaagaaaatacggtggatttgacagccccacagtggcatacagcgttctagtgatagcaaaaatggagaaaggcaaagcaaaagtcctaaaaccagtaaaagaaatggtcggaatcacaatcatggaacgaactgcattcgaagaaaacccagtcgtcttcttagaagcacgcggatatcgagaaatacaagaacacctcattatcaagttgccaaaatactcactattcgaattagaaaacggaaggagaagactactagcatccgcatcagaactccaaaaaggaaatgaactattcttaccagtagactacatgacattcctctacttagcagcacactatcatgaactaaccggctcaagcgaggacgtcctacggaaaaaatactttgtagacagacacctacactactttgacgacatcatacagatgattaacgacttcgcagaaagacatatattagcaagctctaatctagagaaaataaatcacacttaccataataatagtgacttaccagtgaatgaaagagcggaaaacataattaacgtatttacattcgtagccctaggtgcaccagcagcatttaaatttttcgacgccacgatcgatagaaaacgatacacatctacaaaagaagtcttaaatgccacattaattcaccaatcagtaacaggactctatgaaacaagaatagatctctcacaattaggcgaaaattga

SEQ ID NO: 5335 - RNA, 4047 nt, synthetic construct
  misc_feature 1..4047: note = Cas9 variant
  source 1..4047: mol_type = other RNA
atgaagtccgaaaaaaaatactacatcggtctagacgtagggacaaatagcgtagggtgggcagtaaccgatgaattttacaatatactacgagctaaaggaaaagacctatggggcgtgcgcttatttgagaaagcaaaaaccgcggctgatacaagaacttttagatctggacgacgcaggaacgatagaaaaggagtacgactgcaaatcctcagggagatatttgaagacgaaataaaaaaagtagacaaagatttttatgacagactagatgaatcaaaattttgggccgaggacaaaaaagtaagcggtaaatatagcctctttaacgacaaaaacttctccgacaaacaatacttcgaaaaattcccaaccatttttcatctaagaaaatatctaatggaggaacatggaaaagttgatatacgctactacttcctagctatcaaccaaatgatgaaacgaagaggacattttttaatagatggccaaatcagccacgtaacagacgataaacccttaaaacaacaacttatactcctcatcaacgatctgctaaaaattgaactagaggaagaattcatggactcaattttcgaaatattagccgacgtaaatgaaaagaaaactgaaaaaaaaaacatattaaaagaactgataaatgcacaagactttaacaaacaagaaggaaaaatcttatactcaatattcgaatcgatagtgaccgggaaagccaaaataaaaaacataattagtgatgaagatatattagagaaaataaaagaagataataaggaagattttgtattaacaggagattcatatgaagaaaacctccaatactttgaagaagtcctacaagaaaacataacactttttaacacattaaaatcagcatacgattttgtaatattacaatcaatattaaaaggaaaatcaacactcagcgatgcccaagttgaacgatacgacgaacataaaaaggacctagaaatactgaaaaaggtaataaaaaaatacgacgaagacggaaaactattcaaacaagtcttcaaagaagacaatggcaatggatatgttagttacattggatattatttgaataaaaataaaaaaattactgcgaaaaaaaaaatatcgaacattgaattcacaaaatatgtcaaaggtatcttagaaaaacaatgcgactgtgaagacgaagacgtcaaatatttactcggaaaaatcgaacaagaaaacttcttactgaaacaaatctccagtataaacagcgtaataccccatcaaatacatcttttcgagttagacaaaattctagaaaatctcgcgaaatactatccaagctttaataacaaaaaagaagaattcacaaaaattgaaaagatcagaaaaaccttcacattcagaataccatattacgtcggaccactaaacgattaccacaaaaacaacggcggcaacgcatggatatttcgtaataaaggagaaaaaatacgcccatggaactttgaaaaaatcgtagatttacataaaagcgaagaagaatttataaaacgcatgctcaatcaatgcacatatctacccgaagaaactgtactacctaaatcatccatactatattcagaatacatggtcttgaacgaactaaacaacctcagaataaacggaaaaccaattgacactgatgtaaaactaaagctaatagaagaattgttcaaaaaaaaaacgaaagtaacactaaaatctattagagactacatgataaggaacaatttcgccgacaaggaagactttgacaattcagaaaaaaacttggaaatagtatcaaacatgaaaagctacatagatttcaataacatactaggcgacaaatttgaattagaaatggtagaagatttgattgaaaagattactatacacacaggaaataaaaaactactaaaaaaatatatagaagaaacatacccagacttatcaagctcacaaatacaaaaaataataaacttaaaatacaaagattggggtcgactcagcagaaaactattggacggaataacaggcaccaatatagaaacaggcgagatcgacacagttatcaactttttgagaaacagttccgacaatctaatgcaaataataggaagccaaaactattcattcaataacgatatagacaaactacgtaaaaagtatataccccaagaaatcagctatgaagtcgttgaaaatttgtatgtaagtccaagtgtaaaaaaaatgatatggcaagtaataagaataaccgaagaaattacaaaagttatgggctacgaccccgacaaaatattcatagaaatggcaaaaagtgaggaaggaaaaaaaacgacaattagtagaaaaaacaaattgttagcactgtacaaagctataaaaaaagatgaacgagattcacaatacgaaaagctactaacaggcctaaataaacttgacgattcagaccttcgaagccgaaaactctatctctactacacacaaatgggacgcgatatgtacactggcgaaaaaatcgatctagataaattattcgacagtacacactatgataaagaccacatcatcccacagagtatgaaaaaagacgactctattataaacaatctagtacttgtaaacaaaaacgccaaccaaacaaccaaaggaaatatataccccgttccttcaagtatcagaaataaccctaaaatatacaactactggaaatacctgatggaaaaggaattcatatcgaaggaaaaatataatcgtttaatcagaaacaccccacttacaaatgaggagctcggcggattcataaatagacaactggtggaaaccagacaatctacaaaagccataaaagaactattcgagaaattttataaaaaatctaaaataatcccagtaaaagctatcctagcctcagacttacgcaaagacatgaacaccctgaagagcagagaagtcaacgatctacaccacgctcacgacgcgttcttaaacatagttgcgggagacgtatggaacagagaattcacatccaaccccattaactacgttaaagagaacagagaaggtgataaagtcaaatatagcttatcaaaatactttacaagaccccgaaaatccaaaggtaaagttatatggacaccggaaaaggggagaaaacttatcgtcgacacactaaataaacccagtgtactaatttccaatgaaagccacgtaaaaaaaggcgaactattcaacgcaacaatcgcgggaaaaaaagactataaaaaaggaaagatatatctaccgctaaaaaaagacgacagactccaagacgtaagtaagtatggaggttataaagcaataaacggagcctttttcttccttgtagaacataccaaaagcaagaaacgaatacgatcaattgaactatttcctctacatctactatcaaaattctatgaagacaaaaacacggtactggactatgcaatcaacgtactccaactgcaagacccaaagataatcatagataagataaattaccgcacagaaataatcattgacaactttagctacttaatatcaaccaaaagcaatgatggatctataaccgtcaaaccaaacgaacaaatgtattggagggtagatgaaatttcaaatctaaagaaaatagaaaacaaatataagaaagacgcaatactcactgaagaagacagaaaaataatggaaagctacatcgataagatctatcagcaattcaaggccgggaaatataaaaatcgacgaacaacagatactataatagagaaatatgaaatcatagatctcgatacactagacaacaaacaactttaccaacttctcgtagcattcatatccttgtcatataaaacaagcaataacgcagtagacttcactgtaataggacttggaacagaatgcgggaaaccacgaataactaacctacccgacaacacttacctcgtatataaatcaatcacaggaatatacgagaaaaggataaggataaaatga

SEQ ID NO: 5336 - RNA, 4047 nt, synthetic construct
  misc_feature 1..4047: note = Cas9 variant
  source 1..4047: mol_type = other RNA
atgaaatcagaaaaaaaatattacatcggattggacgtaggaacgaacagtgtagggtgggcagttactgacgagttctacaatatacttagggcaaaaggaaaagatctatggggcgtaagactattcgaaaaggcagataccgcagcaaacacaagaatctttcgatcggggagacgcagaaacgatagaaaaggaatgcgactacaaatacttcgcgaaatattcgaagacgaaataaaaaaagtagacaaagatttctatgacagattagatgagtcgaaattctgggccgaagacaaaaaagtcagtggaaaatattccctattcaatgataaaaacttttcagacaaacagtactttgagaaatttccgaccatattccatctccgaaaatatctaatggaagaacatgggaaagtcgatatacgatactatttcttagcgataaaccaaatgatgaaacgaagaggtcatttcctcattgatggacaaatttcacacgtaacggatgataagccactcaaagaacaactcatactattaattaatgatttattaaaaatagaactcgaagaagaactaatggattctatttttgaaatattagcggacgtaaacgaaaagaggactgataaaaagaacaacctaaaagaattaataaaaggtcaagacttcaacaaacaggaaggaaacattttgaatagcatatttgagtctatagtcaccggcaaagcaaaaataaaaaatatcatttcagacgaagacatcttggaaaaaataaaagaagataacaaagaagatttcgtcctaacaggcgacagctacgaggaaaatctccagtactttgaagaagtgttacaggaaaacattacattatttaacaccctaaaatcaacatatgattttttaatactacaatcaatccttaaaggcaaaagcacactctcggacgcacaagtcgaaagatacgacgaacacaaaaaggatttagaaatattaaagaaggttattaaaaaatacgatgaagatgggaaactattcaaacaagtattcaaagaagacaacggtaacgggtatgtatcttacataggatactatctaaataaaaataaaaaaatcactgcaaaaaaaaaaatctcaaacatcgaattcacaaaatatgtaaaaggaatacttgaaaaacagtgtgattgtgaagatgaagatgtcaaatatctccttgggaaaatagagcaagagaattttctactgaaacaaataagctcaattaatagtgtcatcccgcaccaaattcatcttttcgaactggacaagatcctcgaaaacctagccaaaaactatccatcatttaacaataaaaaagaagagttcacaaaaatagagaaaatcagaaaaaccttcacgtttaggataccatactatgttggaccattaaacgactatcacaaaaacaatggaggaaatgcatggatattcagaaacaaaggcgaaaaaataagaccgtggaattttgaaaaaattgtagacttacacaaatcggaagaagaattcatcaaacgcatgttaaaccaatgtacatatttacctgaagaaacagttctacctaaatcaagcatactttatagcgaatacatggtactcaacgaactgaataacttacggatcaatggaaaaccactcgatacagatgtaaaactcaaactaatcgaggaactttttaaaaaaaaaacaaaagtaacattaaaaagcattagagattatatggttagaaacaacttcgccgacaaagaggattttgacaactcagaaaaaaacctagaaattgcaagcaacatgaagagctacattgacttcaacaacatcctagaggataaatttgatgtagaaatggtagaggatttaatagaaaaaataacgatacacacagggaataaaaaactcttaaaaaaatacatagaagaaacctaccccgacttaagcagcagtcaaatacaaaaaataataaatttaaaatacaaagactgggggaggctgagtagaaaattactagacggaataaaaggaacaaagaaagaaactgaaaaaacagatacagtaataaacttcctacgcaatagctctgacaatttaatgcagataataggttcacagaattatagtttcaacgagtatatagacaaactgcgaaaaaaatatatcccacaagaaataagttacgaagtcgtagaaaatctttacgtatcaccatcggtaaaaaaaatgatttggcaagtaataagagtaacagaagaaataactaaagtaatgggatacgacccagacaaaatattcatagaaatggccaaatccgaagaagaaaaaaaaacgaccataagccgaaaaaataaactattagatctatataaagcaattaaaaaagatgagagagatagccaatacgaaaaactactcacaggactcaacaagctagatgactctgacttacgaagcagaaaactgtacctttactatacgcaaatgggcagagacatgtacactggtgagaaaatcgatctcgataaactctttgactcaacccattacgataaagaccacattataccccagtcaatgaaaaaagatgattcaattatcaataacctcgtactagtcaacaaaaacgccaaccaaacaactaaagggaacatctacccagtccccagtagcattagaaacaacccgaaaatatataattactggaaatacctaatggaaaaagaatttatctccaaagaaaaatataacagattaataagaaatacaccattaactaacgaagaactcggaggctttataaatagacaactagtggaaactaggcaatccaccaaagctataaaggaattattcgaaaaattctatcaaaaatctaaaattataccagtcaaagcgtcacttgcatccgacttaagaaaagatatgaacacactaaaatcaagagaagtaaatgatctacatcacgctcacgacgcctttttaaacatcgtcgcaggcgacgtgtggaacagagaattcacaagcaatcccattaattatgtcaaagaaaatcgagaaggagataaggtaaaatactctctttcaaaagactttacacgaccgagaaaaagcaaaggaaaagtcatttggactcccgaaaaaggacgaaaacttatagttgacacactgaacaaaccatcagtactcataagcaacgaatctcacgtaaaaaaaggagaactattcaacgccaccatagcaggcaagaaagactacaagaaaggaaaaatatacctaccactcaaaaaagacgacaggctacaagacgtgtctaaatacggagggtacaaagccataaatggagcatttttttttctagttgaacacacaaaaagtaaaaaaagaataagaagtatagaactcttccccttacatctacttagtaaattctatgaagacaagaacacggtattggactatgcaataaacgtacttcaactacaagatccaaaaataatcattgacaaaataaactatagaacagaaataatcatagacaacttttcatacctcataagtaccaaaagcaacgacggctcgataactgtgaaaccgaatgaacaaatgtactggagagtagacgaaatttcgaacttaaaaaaaatagaaaacaaatataaaaaagacgctatactaacagaagaagataggaaaataatggaaagttatattgataaaatatatcaacaatttaaagcaggaaaatataaaaatcgacgcacgactgatacaataatagaaaaatacgaaataattgacttagacacactggacaacaaacaattataccaactccttgtcgcatttatatcactatcttataaaacttcaaacaatgctgtagattttacagtgataggattaggtacggaatgtggaaaaccccgaattacaaatcttcccgacaatacatacctagtatacaaaagcataacaggaatatatgaaaaacgaatacggataaaatga

SEQ ID NO: 5337 - RNA, 4047 nt, synthetic construct
  misc_feature 1..4047: note = Cas9 variant
  source 1..4047: mol_type = other RNA
atggagaaaaattactacctaggattggacctaggatctaattcagttggatgggcagcaacagacgaagactataacttcctaagactaaaaggcaaaacagcatggggcgctcgcatcttttccgaagctaaggactgcaaagaaaggaggacatacagaagtaataaaagaagactagcaagacgaaaatatagattagtattgctcaaacaattattcgccgaagaaatgactaaagttgacaagacattcttccttcgattagctaacagcacctactgggaagaagataaaactaaagactctgatggaaacgaaataggaaagaaccttattttcaaaacacatgaagaagaaaaacagtattacacaaaatatccaacaatctggcacttgcgtaaggccctcatcgagaacgacgaagaagcactcagcaacctacgttatgtatatttagcaatacatcacattgtaaaatataggggaaacttcctcacagaaggcgaaatgggcaacgacatacccccaatcacaacaattgaagaaataaaccaaacgctcagcctattagaagttgatagttccgaagacgccactgataaaacgacatacataaaacctgaatcttataacgaattattcacaatattagaaaacaataatttaaacaaagtaaagaaacaacaagagatagacaaacttttcatatcctcgaaagaaagatctgaaaatatcaaaaactacataaatctattcaaaacaataatcgtaggaggttcatttagtttaaagaaaattaacgaggatacagaggacattagcgtcgactttacaaaagatttcgagaacagcgaagcagacattagcaaagcactaggcgactccttcaatctagtgcttatcgcaaagaaatattacgattacataatccttaaagaacttctaggcaaaaacaaagaaatatccgaagcaatggtccaaatctacgaagaacataaagatgatctaaaatctctgaaaacaatcctaaaagatctagataacaaactaggaaatgacggtaaagacagaatatactacagcgtattcaaacaagaaccgacggaaaaatttaaagaaaccaattatctatcattcgtacaaggcggaaagctggaagaactgaacaaatacatcaagaaaatattagaaaacaacgaaaaagatatagacgataaagaaacatataatgccctatacgaaaaagcgtgcaaaggggatttatttaagaaacaggctaatgcttgcacgagcctgataccacaccaatttcatctaagggaactaaagaaaattctcgaaaatgcggggcgtaaatactctttcttaaacgacataagcgacaaaataataaaaatattcaaattcagagtaccgtattactacggcccactcaacaatgaaagtaatgcgcacagctgggtagtaaagaaagaagggcaagaaaaagcaaagatcacaccatggaacataaacgaaatcatagatacgcccaaaactagagacaacttcttcaagaaactgaccaatagctgtacatacttagtaggcgagacagtactgcccaaaacatcactttactatgaaaaatacctagtactcgacaggctaaacaaaatgcaagtaaacggagattatctatcagctagtgagaaaaacgacgtattgaaattcatactctcccgtaaaactacaacgatagaacaaataagaacatacctcagcaaaaacaaatcaactaaagcaaacgacataagcatcagcaacataaaagcgactgatcctttcaacgcagtttctcacgcattttacggaaaacacccggatctcaatataaatttatgcgaagaactgatcaaattcgcaacaatatacgcagacgataagaaagaactcaagaaatttgtctcaagtaactttaatctaactgatgagttcataaaagaatacttgaatacacctacaaacaaatggggtagactttccagaaaattcctctgcggtggagaccaattagaaatgtattatgtcgacgacaacggcatattacatagcatcttgaacattctagaagaaacaaatgaaaatctacaagaaatcctaaacaatgaaaaatacgggttcaaccagaaaatagcagacttcaacaatactcttacagcagacaaaacaacagaagaacaaatagaagatatcttggactccacaccagcattaatgagaagatcaattatacaaacacttgcggtagtagacgacgtaattaaagcagcaggaaaggcaccacagaaaataatgatggaagtaacacgcactgacggcaagaaagaagaaacaaaatcaaggtacgtacaactcaagaaacaaataacaaacgataaagtattaacatcagacgaaaagaaagaactattaactaacttagaaaacaagaaaatccaactcaaaggaaaacatatatatctatacttcatgcaaatgggtatagatttttatacaggaaaaataatggacataaacgacgtaataaatggaaaatatgatattgaccatatcattccacaatcaatgatcaaagatgacagtctcgacaatatggtgctagtaagcaaagactataaccaaaaagttaagaaagatatctatccaatatgtgacgaaatacgtaataacatgctagacaaatggaaaggctactacgccaggaaaattatttccgaagaaaaatacaacagattaaaaagaacaaaagaactcaatgcagacgagataaacgccttcatcaatagacaaataaacgtagttaattactcaaacatacaaatcaaaagaatatttgaaataaaataccccgaaacaaaaataatattctccaaagccagctttcctagcttactccgtaaagaatacgaaatagctaaaatgagagatttaaatgacgcacaccacgctgttgacgcatacctaaacatagtttgcggaaatatactcacgacattatatacggacatcttctatatgttcaaagaaaagaaagaagaccacaaaaacatctcattcaacatggagaaaagacttataaactatatagataaaaacaacttaaaagacaaaataaaaacaagctgcttacgacacgacgcactcataacatataaacccgactacgacagcggtaaattctacaaagaaacaatatttaagaaaagcggagataaagaaaccggattaataccgctccatacaaaaggacccatgagtgacactaagaaatatggaggatactcacaattatcgcaatcctatataatagcggttgaatacaaactcaaaaataaaacagtaaagaaattatgtcgagttcccaccttatacctaaaacaatacaaaaatgacctaaatacgatcgcaaaaatcatgatagacgacgaaaaagctacagacatcaaagtactcagaaaaatttacctaaaccagaaaatcaggtacaacggatgctactacctaatctatacatctaaagaaaaacaaaataaatataaaatggcataccaaaactacctagacaatgattatctaatatacctaaacaaatgtctcaagaaaatagatgaactagacgatggggaattaacaagtcaagaatttattgtcaacaaagacggcgacaaatttcttatagacaaaaatcacaatctggaaatttttaaatcaatcaaagaacaatacaacaaaaccatatatgattacacaccctatatagtacaatcccgcgaaatgaaagaagaggactttaacaatctaagtctaaagaaacaaatagacacattattaaacatgatcaaaatactatcaaggagcaacgaacaagctaaattcgaaactgccttcttcgaaaacttcaccaaagtattcctaaaaaccatgacaataactaacgaaaaagtctacatagtcaacgaaagtccatctgggctgttcaaaggaaaagaagaactaatatga

SEQ ID NO: 5338 - RNA, 4047 nt, synthetic construct
  misc_feature 1..4047: note = Cas9 variant
  source 1..4047: mol_type = other RNA
atgaaaaaattcgaagattactatttaggtttagacttgggaacaagtagtataggatgggcggtaacaaatgagaaatacgacatcttaagatttaacaaaaaattcatgtggggcacccacttatttgacatgggcaataccgcctcagaaagacgaatattccgtacctctaggagaagactcaaaagaaaaaaaaatcgaatagaattactacaaacattattttcagcagaaatgtcaaaaaaggatttcggattctttcaaagacttaaagaaagtcagtactttatcgaagacaaaacctttaaaaacaaaaacacattattcatggatgaaaattataccgatcaagattaccacatggaataccccaccatataccacttaagaaaagcactaattgacaacgaggaatcagcctttgaaatcagaaaactttacctcgccatatcccacatactctcacatcgaggacacttcctattcgaaggtgaactatcggacaacctagactttgatgatatattcaatgaattcgtaaaatatctaaacgaagagttaaatatagatttcaaaattaaatccgatgtctcactacaggctataaaagaaattctcacagataaaatgctcaaccgaaccaaaaaaaaagagaaactctcagaacttcttgaagaagaaaaaaataaaatataccaagaaatatggaagctactggtaggcaacgaagctaagatgagcacaatattcgacgacaaagaatacgaagaagccaagatagcattctccaaaggaaattatgatgaaaaagaagaagaatatgagagcatactaggtgaaaaaatattatttgtacaaaaagcgaaagcaatttatgactggatgttattacaaaacatcttaaaagaagacaaatatctgtcatactcaaaagttaaactctacaatgagcacaaaaaagacctaaaaatattaaaagatgtgctaaaaaaccttgacaaaaaaatctacaaagaaatattcagcgagaatggactatacgaagaatatcttagaattgagaagaaaaagattggatctaaggaagaaaagactaaagatatattatacaaccgactcaaaaaaatattcgaaaatagagataacatggccatcgaagacatactcaataaaattgaactcgattcttttctacctaaacaaaaaataaaagacaacggagtaatacccagacaagtacaccagaaagaacttgaaattatactgaaaaacgctgaaaaatattttaaatggctaatagaaaaagatgaaacaggactttccgtctcagaaaagataatgaaaatctttaaattcaaaataccttattacgttggacctctaaactcaaaatcaccatttgcatggattgaaagaaaagaatatggaaaaattctaccttggaattttgaaaacatggtagacatgtcaaaaacggcagagaaattcataaagagaatgacaaacaaatgtacctatttacctgaaaaagatgtaataccaaaaaacagcctactctataccaaatacatggtccttaacgaattaaacaatctaaaaatacgtggagaaaaaatcaaagtggaactaaaacaaaaaatatacacagagcttttccaaaaaaataagaaaatcggaatgaaaacactaatcgaatttcttaaatcacaaaacatagttgtaacaaaagttgaaattacaggaatagacggcacgtttaacacatcactcggatcgtatattgatatgaaaaaaatattcggcgaagaaaaaatagtcaaagatagctataagaaaatgatagaagacataatattatggattactctatacggagaagaaaagaaactaataaagtccaaaattgaagaaaaatatcctgaaaaagtaacaccagaagaaatgaaattaatattaaaactgaaatatagggactggagccgactatcaaaagaattcctcacagaaatagaaactatggacgaagaaacaggggaactaatatcaataatagaaatgctatggagaaaaaacgaaaatatcatggaactgttatcatacaaatacgacttttcaaaccgaataaaggaatacaatggaataaacgaaaaagaaaaaaatataacttacgaagacttagtgaaagacctacaaataagcccctctgtaaagaaaatgatttggcgtgcacttgtaatagtaaaagaaatcaaaaaagtcacaaacaaatcacctaaaaaggtcttcatagaaatggctcgcgacacccaaaccgaaaagaaaagaacagagaagcgcaaagacaaactcctagaattatataaaaacatcaagaacgatgatagtataaaagagctcgaaaaaaacttaaaagacaaaacaaacgatgaccttaaatcaaaaaagttatatctatactacctacaattagggaggtgtatgtatagcggggaagtcatcagattagaagacctcatgaacgataacctctacgatatagatcatatttatccacaatccaaaataaaagatgactcatttgataacaccgtattagttaaaaagcaaattaacgcagataagacaaacgaataccccatagataaatcaatccaaaataaatgcaaagctttctggacctccctaaaagaacgaggactgatgtcaaatacgaaatacgaacgtttaacccgaacggaaggattctccgatgacgaactcgccggtttcatatcaagacaaattgtagaaaccaggcaagcgacgaaagtcctggcagacctattaaaagtaatattcggaagtgacacacgaatagtatacgtcaaagcaggactcacatctgacttccgccaaaaattcggaatatataaatttcgagaactcaacgactatcatcatgcacacgacggatacctaaacattgtaacagggaacatctataacacattattcacagacaatccgtacaacttcataaaagatagaaaaaaagataacagaacatataatcttaataaagtatttgaaagagaaaatgacgtatggaatcccgatgtcatgttgagcaaaatagagaggtatatctacaaaataagacccctattcactcgggcaagctacgaacaaaaagggggctttagtgatcaaaacatatcctcagaaaaagacaaattaagaccactaaaatcatctggtgtcctttcaaacattaagtacggaggatacgataaaatcaaaaactcttactttttcattgtggaatacaccgaaaaaaagaaaagggtaagaagtatagaaacactcccaatctatataaaaaagtcaataagtacaaaggaggaccttgaaaaatattgtaaagaagaattaaaattacaagaacctaaagtactagtcagcaaattaaattacaaatcccttatatactcaaacggacacgaatactatataaactcaaaaacagcagattccatcacaattcaaaatggaattcaaataatcctcactaaagaaaactacgaaacgtacagaaaaatttacaagaatctcgaatacttaaaactaatatataaggacgagaaaatccgcgaagaaaaaatactcgaaaaaatcccaaaaatattaaaaaacaataaaaatgacagagacctctcagaagatgaaatatcagagaaattctggaagctatacaaagaaatcttcgaaaaaatcaaaattggcatcttcagtaaatttaaatccacactccctatttacatcgaggattgcaaaaagcttaaagactttacaacactaaacaactacgctaaatcacgcttcatacaagaaattctaaagtgccttaacagccaacagggggaattcgacacaaaatatacacataactactccaaaaaatataacaccaaactctcgaaatcaaaaatactagaaaacgacttctacataataaaccagtcgccaacaggacttttcgaaaaaaaagtattcctagataaatga

SEQ ID NO: 5339 - RNA, 4047 nt, synthetic construct
  misc_feature 1..4047: note = Cas9 variant
  source 1..4047: mol_type = other RNA
atgggagaagatggaaaaccattaagggtaaaaggaaaaacagccataggagcacgccttttccaagaaggcaatccagcagccgacaggagaatgtttagaacaacacggagaagattgaaccgccgcaaatggcgattaaaattactagacgaaatttttgacccctatataacccctgtagacagcacattcttcgcacgcttaaaacaatcaaacctatcgccaaaagactccagaaaggaattcaaaggctcaatgctatttcccgacctcacggacaaacaataccacttagattatcccacgatttatcaccttagacacgccttgatgacacaggacaaacaattcgacatacgaatggtttatttagcaatccatcacatagtcaaatatagaggaaattttctaaattcaacacccgtcgactcattcaaagcttctaaggtaaacttcgatgaccaatttaaaaaactaaatgaactctatacagcaataaacccagaagaatccttccaaatcaatctagcaaactcagaaaaaataggtcagcaattcctcgacccctcaataagaaaatttgacaaaaaaaaacaaattccaaaaatcgtaccagtaacaatggacgataaagctgtagataaattgaatggaaaaatagcaagcgaaataataaacgccatactaggctataaatctaaactagatgtagcagtacaatgcgacccagaagactccaacccgtgggcagtaaaatttgatgacgaagacatagacgcaaaattgcaaaaaatcctacccgagatggacgaaaaccaacaaagtatcataggcatcatacaagatttatactctcaagttactctaaatcaaattgttccaaacggaatgtcattaagcgaaagcatgataaaaaaatataatgaccaccatgaccatctcaaactctacaaaaaattgatcggacaaattagtgattcaaaaaagaaaacggctttaaaaaaagcctacgaccaatacgtcggcaatgatggcaaagtaattgagcaggatgacttctattcgagcgtcaaaaaaaacttagatgactctgaactatctaaacaaatcatggacctaattgatgcagataaattcatgcccaagcaacgcacgagtcaaaacggagtaatacctcaccaactccatcagcgggaacttgacgagataatagaacatcaatcaaaatactatccatggttagccgagtccaaccccaacaaacacgacctacacctagcaaaatataaaatcgaagagttagtcgcatttcgaattccctattatgtaggaccaatgataacccctgaagaccaaaaaaaatccggagcagcagtttttagttggatgaaacgaaaagaaccaggacaaattacaccatggaactttgacgaaaaggttgacagaatggaatcagcaaacaaatttatcaaacgaatgactacaaaagatacctatctgatcggagaggatgtattaccggacgaatccttactttacgaaaaatttaaagtcctaaacgaacttaacatggtacgagtaaacggggacagtctaaaagttgcagacaaacaggcaatttatcaagatctatttgaaaactataaacacatcagtgtaaaaaagctacaaaattatatcaaaggaaaaaccggactacccaacaatccagagatatctggactatcagatccagatcaattcaacaattcattgggtacatataatgattttaaaaaactattcggagataaagtagacgacccagacttacagaatgactttgaaaaaatcgtcgaatggtcgacagtattcgaagataaaaaaatacttagagctaaactcaacgaaatcacatggttaacagacaaacaaaaggatgacctagaatcatcacggtaccaaggatggggaagactctccaaaaaactacttacagggatcgtaaacgatcaaggggaaagaataatagacgaactctggaataccaacaaaaacttcatgcaaatacaatcagatgacgacttcgcgaaaagaatccacgaagctaacgctgaccaaatgaaaagtacaaatatggaagatgtacttgcagacgcatacaccagtccacaaaataagaaagcaatccgccaagtggttaaagtagtagacgatatccaaaaagcaatgggaggagtcgcaccaaaattcataagcatcgaatttacacgatctgaagacagaaacccaagaagaacgatatctaggcaacgccaactagaaaatacacttaaagacacagctaaaagcttagttaaaagcatgaacccaaacatcttaagcgaacttgataatgcatctagatcaaaaaaaggactaacagacaggctatacctatactttacacaattaggtaaggacatgtacactggggagccgatcaatatagatgaaataagtaactacgacatcgatcacatcttaccacaagcattcattaaagacgacagtctaagtaatcgcgttttagtatcaaaggcagtaaataacggtaaatcagctaatgtcccactaaaattgtttggcgctaaaatgggtcacttctggaaacagcttgcagaagcagggcttattaataaacataaattgaaaaacctacaaactaacccagatacaataagtaaatttgctatgcatgggtttatacgaagacaattagtagaaacatcacaagtcataaaactcgtagcaaacatcttaggagataaatatcgaaatgacgatacaaaaataatagaaatcaccgcacgtatgaaccaccagatgagagacgaatttggatttatcaaaaatagagaaataaacgattaccatcacgctttcgatgcctacctcacggcatttttagggcgatacctttaccacagatacattaaactacggccttacttcgtatatggagacttcaaaaaatttagagaagacaaagtaacaatgagaaactttaactttctacatgacctaactgatgacacccaagcaagaatagcagataccgaaacaggtgaggttatatgggatagagaaacaagcataaaacagcttcgagatgtctatcattataaatttatgctaatatcccaagaagtatataccctccgaggagcaatgtttaatcaaaccatatacccagcttcacaagcaggaagaaaaaaactaattcctatgaaagctgacaaacccgtggatgtttacggagggtactcgggaagcacagacgcatacatggcaatcgtgagaattcatgacaaaaaaggagacaaatataaagttgtaggtgttccaatgcgagcacttaacagattaaatacagctaaaaacgtatcagacgccaaatacgaccaagaactaaaagaagtattaacaccacaattcaccaaatcgaaaaagaatcgcaaaacaggagaaataacacaaaccgtcgaagatttcgaagttgtgctaggtaaggttatgtacaggcaactcgtaatcgacggcgacaaaaaattcatgctaggttcatcaacttaccaatacaatgcgaaacaactggtactatctgatgaatcaataaaaactctagcctccgaaggaaaacttaatgaagcacaagagtctgcagcatatgacaaagtatatgacgaaatccttgataaagtaaacaaatacttcgccctatatgatacaaacaaatttcggcaaaaactcagtctcggaaaagataaattcgtcggactaccaaatcacaacgtatttgacggatcaaaaaaaatctcatcaggaaagcgcgaaatacttaacgaaattctaaacggactgcacgcgaatgcaacactaggcacactttctgacatcggcttttcaacaccctttggaaaaatgcaacaacctcgaggcatcggactgagctcaaatacttctattgaatatgaaagtttcaccgggctattcaaacgaacaatattcttgaaagacctatga

SEQ ID NO: 5340 - RNA, 4047 nt, synthetic construct
  misc_feature 1..4047: note = Cas9 variant
  source 1..4047: mol_type = other RNA
atgaagaaaccatatacgattgcactagatataggaacaaactccgtcggatgggtagttgtcactgacgactatcgagtccctacaaagaaaatgaaagtacttggaaacactgaaagaaaaaccatcaagaaaaatctaatcggagcattattgtttgatagtggagacacagcagagggcaccaggttaaaaagaaccgcaagaccaaggtacacaagaaggaaaaacagactcaggtttttaaaagaaatctttaccgaggagatggccaaagtagatgatggcttctttcaaagacttgaagattcattctacgtacttgaagacaaagaaggaaataaacatcctattttcgcaaacttagcagatgaagtagcctatcacaagaaatatcctaccatataccacctaagaaaagaattagttgacaacccgcaaaaagcggacttacgacttatctatttagcagtcgcacatatcattaaattcagaggacacttccttatcgaaggcaccttaagttccaaaaacaacaacctacaaaaatcattcgaccacctagtggacacatataacttactttttgaagaacaaaggttactcacagaaggaataaacgctaaagaacttttgtcagcagcactttcaaaatcaaaaagactagagaacttaatctcattaataccaggtcaaaagaaaactggaatattcggaaatataatagcattaagcctgggccttaccccgaacttcaaagcaaacttcggcttatcaaaagatgtaaaactgcaattagcaaaagatacctatgcagatgatctcgatagcctattagctcaaataggagaccaatatgcagacttatttctagctgccaaaaatttaagcgacgcgatactgttatcagacatcttaactgaatcagacgaaataactagggccccactaagtgcgagcatggttaaacgatatagggaacatcacaaagacttagttacactaaaaacacttattaaagaccaattaccagaaaaatatcaagagatattcttagacaaaactaaaaatggatacgcaggatacatagaaggccaagtcagtcaggaagaattttataaatatctcaaaccgatcttagctagactcgacggatcagaaccattattactaaaaatagaccgagaagactttctaagaaaacaaagaacgttcgataatgggtctataccacaccaaatccacctagaggaactccatgccatactaagaagacaggaggtattttatccattcttaaaagacaatagaaagaaaatagaatcattactgacgtttcgaataccatactacgtaggcccactggcacgtggtcattccaggtttgcatgggtaaaaagaaaatttgatggcgccatccgaccatggaattttgaagaaatcgtagacgaggaagcctcagcacaaatctttattgagaaaatgacgaaaaacgatctataccttcccaacgaaaaagtacttccaaaacattccctactttacgaaacattcacagtatacaatgaactaacaaaagtaaaatacgccacagaaggcatgacacgaccgcaatttctatcggcagatcaaaaacaagcaattgtagacctattatttaaaacaaaccgaaaagtaacagtaaaacaattaaaagaaaactactttaaaaagattgaatgctgggattctgtagaaatcacaggagtagaagactcgtttaatgcatcactaggaacctaccacgacttattaaaaattatacaagacaaagactttttggataacccggacaaccagaaaattatcgaagatatcatattaaccctgaccttatttgaagacaagaaaatgattagcaaaagactagaccaatatgctcatctatttgacaaagtcgtattaaacaaattagaaaggcaccattatacaggatggggacgtctctcgggcaaactgatcaacggcatcagagataaacaatcaggaaaaacaattttagacttcctcaaagcagacggatttgcaaatcgcaacttcatgcaactaatacatgactcagaacttagctttatagacgagatcgcaaaagcacaagtcattggaaaaacagaatatagtaaagacctcgtcggaaatttagcaggatctccagcaataaagaaaggaataagccagacaataaaaattgtagatgaacttgtcaaaattatggggtatcttccacaacaaatagttattgaaatggcaagagaaaaccaaactactgcccaaggaattaaaaacgcacggcaaagaatgagaaaactagaggaaacggcaaagaaattgggttcaaatatactgaaagaacacccagtcgataacagtcaattacaaaacgataaacgatatttatattatctccaaaatggcaaagatatgtacacaggtgacgacctagatatagattacctatcaagttacgatatagaccatataatacctcaaagttttatcaaaaataatagcatagacaataaagttctgacaagtcaaggagctaatagaggcaaattagacaatgtcccttcagaggcgattgtaagaaaaatgaaaggatattggcaatcgctcctcagagccggtgccatttctaaacaaaaatttgacaatctaaccaaagcagaaagaggaggacttacacaagtagacaaagccggattcatacaacttcaattagtagaaactagacaaataacaaaacatgtagcacaaatactagactcgcggttcaacacagagttcgacgaccataataaaagaatacgtaaagttcacattattacactcaaatcaaagctcgtatcagactttagaaaagaatttggactttacaaaataagagacataaatcattaccatcacgcacacgacgcctatcttaatgcagtagtagcaaaagctatactagggaaatatccacaattagcgcctgagttcgtatatggagactacccaaaatacaactcattcaaagaaaggcaaaaagcaacacagaaaacgttgttttattcaaatattctaaaatttttcaaagaccaagaatctttacatgtaaattcagacggagaagaaatatggaatgctaataaacatctacccatcattaaaaacgttctttcaattccacaagtaaatattgtaaagaaaacggaagttcaaaccggaggcttctacaaagaatcaatattaagcaaaggaaactcagataaactaatccctcgtaaaaacaactgggacaccagaaaatatggcggattcgacagccctacagttgcatattcagtacttgtaatagcaaaaatggaaaaaggaaaagcaaaagttctaaaacctgtcaaagaaatggtaggtataacaataatggaaagaattgctttcgaagaaaatccagtggtcttcttagaagccaaaggatacagggaaatacaagaacatctcatcataaaactcccaaaatactctctttttgaattggaaaacggaagacgaaggctactcgcgagcgcctcagaacttcaaaaaggtaacgaactgtttttacccgttgactacatgacattcttatatcttgccgctcattatcatgaattaacaggttcatcagaagacgtcctacgaaagaaatatttcgttgagagacatttacactatttcgacgacattatacaaatgataaacgactttgccgagcgacacatccttgcaagttctaatctggagaaaatcaatcacacatatcacaacaatagcgatttaccagttaacgaaagagccgaaaatattataaatgtattcacatttgtcgcactaggagcaccagcggcttttaaattctttgatgccactatagatagaaaaagatacacttcaacaaaagaagtcttaaacgccaccctcattcatcaaagtgtaacaggcctgtacgaaacgcgaatagatctaagccaactaggagagaattga

SEQ ID NO: 5341 - RNA, 4050 nt, synthetic construct
  misc_feature 1..4050: note = Cas9 variant
  source 1..4050: mol_type = other RNA
atgaaacaaaaattttacgtaggcttagatatgggcaccgcgtctgttggctgggcagtgaccgatgacaaatacaacattataaaaagacacggaaaagcactctggggagttagattgtttaaaacagctaacacagcagaagagagaagaatattccgagcagcaaggagacgaacacaaagaagaaaacaaagaatggaactcctacaagagatattcggagacgaaataagcaaaacggacataggattttaccaacgaatgaaggaatcaaaatactggtttgaagataaacgagacataaatggtaaacaacccgaactaccgtacgccctatttgttgatgacggatttacggataaagactatcacgaacaatttcctacaatatttcacttaaggaacgtcctagtaaatgaatggactcaaaagtatgatatccgactagtctatcttgccattcaccacatcataaaacatcgcggacattttttatttgaaggtaaaaaaatgagcgaagtaacagattttggaagtgcatttgaagcattttgtaaagtcgcctcagataatgacatcgagataactgtagatgaagagaagttaaaagacatagaagacctacttaaatcgagacaaaaaagcaaaacagcaaaaaaacaagaactaggtaagattatagcgggagctgacaaacaaaaaaaagctctggcggcacttgtgacaggatgcatggttaaattatcagaaatattcgcagataagtctttagatgatggggaaagaaacaagatatcgtttgcagattccaactacgatgaatacattgcaaacgttgaagaaacgctagcagaaaggttcctccttatagcagctggtaaagccctgtatgactgggcagtgctatcagacatactcgaaggatcaacatacatctcagaggccaaagttaagatttacaaaaagcacggagacgacctacgaaaacttaaaggattattaaaaactcgaccagatgaatacaaactaattttcggcctaccagaaaaacaagccaattacagcgcatatataggaatggtaaaaaaaaacggtaagaaggtacccatagataaaaaatgtacaaaagctgacttctattcattccttaagaaaaccctcaataaaattaattttgaggacgaaaaggagagagaaatcgcagaatctatcattaacgaaatagagaacgaaacattcctaccaaaacaagtgataagcgacaacggagttattccttaccaactacatgaggcagaattagacagaatcttaaaaaatgcagccctatattatccgttcttaagcgaaaaagatgacgaggggtacacaaatatggataaaataaaagcaattttcaaatttagaattccatactatgttggccccttaaatacatatcattctgacaaggggggaaactcttgggcagttagaaaacaagatggaaagatatacccttggaatttcgaatcaaaaattgatgcaggagaaagtgcacgaaaatttataggaagaatgacaaataaatgtacatacttaattggaaaagatgtactaccaaaagaaagtctactctattccaaattcatggtactaaacgaactaaataatttaagaatagatggagaaaaagtgagtgtagaaataaaacaagcagtatacgaaaatgtgtttaaaaaataccagcgtgttactggaaagaaggtcaaagactttctgatcagaagcggaatcatcgggagagaacaagaacttagtggtttcgaccaaaatttcaagtcaagcctaaaagcatatcacgatattaaacagatcgcaggagacataaatctatctcaaaatcaaaaagaagacataataaaagaaattactgtattcgcagatagccaaaaaatgctaaaaaaacgcctaaaaataaaatatccagaactaagcgataaacaagtaacaaaattagcagccaaaaaatatacaggatggggccgactaagcagagaatttcttgaagaagtcgaaagtgtaaacaaagaaaccggtgaagtactcaatattatcagtgctttatgggaaacaaacgagaatctaatgcaattactaagtaataaatatgattaccttagtgaaataaagagactaaatgacgaagccgaagataaatccgaagttgttacatatgacgatgtacagaaattgtatgtatcacccgccgtaaaaaggccagtatggcaaacacttaaaatcgtcgaagaaataagtaagataatgggttcaaagccagaaagaatatttgtagaaatggctagagagcccggacaaaaaggtgatgtcaaagtctcaaggaaaagtagacttctagaaaagtataaatactgtaaaaaagaggcaccagaaatatacgaaaacctcgtaaaagaagatgataacaagttacgatcagataaattgtttttatattatacccaaatgggcaggtgtatgtatagtaatgaagtcatcgacatcgaggacttattcacaaacagatacgatatagaccacatatacccacagtcaaaagtaatggatgactcgctagataacagagttctagtaaaacgcgaactaaattcaaacaagacagacgtgtttccagtcccaaaagagtatatggataaggcgaaaacactctgggatatgttaaaaaaaaaagatcttataagtaaagaaaaatatcatagactaactcgaagagatggatttagtgaaaacgaactatcaggtttcatagcaagacaactagtagaaaccaggcaaagtacaaaagccgtcacacagctactaacgaaagcttatccggaatctgaaatcgtttatgccaaagcaaacgcggtatcagaatttagacataagttcggatttaccaaagttagatcgataaatgactatcaccatgctaaagacgcatacctcaatatcgtagtcggaaatacttattatgtgaaatttacaaaagatgcagcctggttcataagaaataacccaggtagaacatacaacctgaaaaagatgttcgaacaaggcacggtatctagaggtggagaaacagcttgggtctcaggagaagacgggactatatttacagttaaacgagtaatgggcaaaaacaacatattatttactcgaaaagcgtatgaagtacgaggtggattattcgatcaacagatcatgaaaaaaggaaaaggacaaattcccgtaaaaaacaactccgaagatgaccgtttatgcgctacagagaagtatggtgcatataacaaagcatcgggagcctattttatgcttgtagagtcagaagataaaaaaggaaataaaattagaacattagaatttgtcccggtgtacttagcaaaagaattggaaaagtcagaagacgcagcaatcagatattgtgtcgaaaaactagaattaaaaaatccagatgttagagttagaaaaatcaagatggatagcctattcaatgtagatggatttcgaatgcatctaagtggcagaactggaaaacaattaatattcaaatgtgcagaacaactggtcctagacgaggaatcacaaaaaatcctcaaaaaaactgccaaagtgttcgcagactataaagagaataagaacatcaaaatctccgacaaaatcgaattaaccgatgaaatgctcataaaactatacgagctattttacaaaaaattaaaagatactgtatacaacatacgattatcaacacaagtaaaaacacttgaatctggaaaagaaaaattcgaaaagctcagccttctcgacaaatgtttggtaatagaagaaattctccatctattccaatgtcagtcagtcgccgcaaatctttcatcaatcggaggcgccgcaacagcaggaatattagtcctaaataatgaaatctctagatgtgggaaagtagaaataataaatcaaagcattactggattctacgaacaagttatagatttaaaaaatatttga

SEQ ID NO: 5342 - RNA, 4050 nt, synthetic construct
  misc_feature 1..4050: note = Cas9 variant
  source 1..4050: mol_type = other RNA
atgcagaaatattatctaggcctagacatcggtacaaatagtgttggttgggccgtaactgatgaaaactacaacctatgtaaatttggtggcaaaagaatgtggggcatacgattattcgatggagcacaaaccgctgaagaacgaagaatgaatagaagcaatagaaggcgacttagtaggcaaaaacaaagaatagaccttttacaagaattattcgcaaaagaaatagctaaggtagatccaacattctttattagactgaacgaatcaagactgtatatggaagacaaatcaacaggaacaaaatttccactattcgctgatccgggatacacagataaagaatattataaagaataccctacaatataccacttacgccaagaactaataaaaaaccccgaatcacatgacataagactcgtttatctggcgtgtcaccacattctcaaaaatagaggacactttctaataaacggtagtttctcagatctgaagaatttaagtttcgtatgccgagaaatgttagacgcctttaacgaattatctaaataccagctgatgatatcagatatcgacgcattagaaaaaatactctcggacagaaaacaacaaaaatctgcaaaagtaaaagaactagtgcaaatattcgaatgcgtaccaagagaagataaatcagatgcaaaaatttgtaaagaaatactttctaatttatgcaaatttctagtcggtgcaaaaggaaacattacccgactctttgatacagacttcgatgaaatggaaacgtcatcattttcattcggagatagtaaatatgaggatagcctacttccttcattagaagaaaattacccagattacgctaacgtaattcagaaaataaaggcaatgtacgactggagcgtccttgtagaaataatggcaggagagaactatctttcatttgcaaaagtaaacgcctacaaaaagcacaaagaaaatctttcaatacttaagtccctgatgaaaaaatattgtactccagatgtctaccaacgattcttttatgaaactgacgaaaaatctagctacggaaactacattggcgccatacataacaacggacattcacacacaatgaaaaaatgcgacgaagaaacgttctataagtcactatccaaaatattagataaactagtcgttcaaaagacagaccaagacacacttgagatactaaaaaaagaagcaaaaaaccaaacattactccctttagccaggacaaaagccaatggagtaattccaaaccaaatacacatacaagaacttagagcaatcctggacaacgccaagacatacttatcattcttaaatgaagccgacgaatacggtactatagccgaaaaaataatacgtatcgcaaaattcaagattccttattatgctggcccactcagcactcgacacaaagaacagggagcaaacacatggatagtccgaaaacaggaaggccgaatctatccatggaattttgaagagatggtagacctagagaggagcaacaacgaatttataagaaggatgacaaataaatgtacatatttaataggagaagatgttctccccaaaaactcactactatacagcaaattcatggtactgaatgaactaaacaatctaaaaatacgtggacacaagatctccgtagaattaaaacaagaactatataaagagcttttctgtaagaaagccaaagtcaccggaaaagcacttttagtatatttaaaaaaaaaagacgcagagctaacactcgaggatatctcaggattcgacgcagatttcaaaagtagcctcagtatctacattgattttaaaaatcacatcctacgagaacaaatagatgatggcaaataccaatccatagtggaaaatattataaaatggaaaacgatctttgatgtagactcaaaaatgatagagaaattgatagcacgcgagtacccaaacatgttttcctctgaacaaatcaaaaaaatctgcagattaaaatgtagaggctggggcaacttttcaagcagatttcttaacggaatacaaggtgaaaacacagagacaaaagagtgttttaccataattgaagccttatggaaaacaaactataaccttatgcaattattatccaagcaattcacatttaaagatgctatagactgcataaacgccgataaagttggcaaaatagacaaagtgacatatgaaaacacagtaaaagacttagtggtatcccccgcgaacaaaagggcaatttggcaaaccgtccaaataacagaagagatcaaaaaagtaatgaaatgcgaaccagaaaaaatattcgtagaaatggctcgaggaggagaaaaagaaaaaaagagaacaataagtcggaaggaacgactattaaaattatacatggattataaagacgaaaatcgagactggataaaagaaattgaatccagagacgaacaagacttcaccaatcgaaaactatatctatattatacacaaattggtaggtgtatgtactcaggagaggaaataagtcttgaagaactcatgcaaaaaaatagtaaatgggacaaagaccacatctacccacaatccaaaataaaagacgactcactagataacttagtattagccaggaaagacataaataataacaaatcaaataaattattaccaactggaattcaagataaaatgaaaaaatattggaaaatgctactaaaatacggttttattagtaaaaagaaatatgacagattgatgaggacagaagacttcagcgacgaggaactatccggattcatagcaagacaaattgtcgagactagacagtcgtcaaaagctgtagctgaattactagaacatttaaatgaacatacagaaatagtttacgtcaaagcagaactcgtatcagatttcagacatgataataacatgcttaaaagtcgaagaataaatgactaccaccacgccaaagatgcattcttaaatatagtagtgggaaacgtatacaatgctaaattcacagcaaacccccggaactggataaagaaaaaccgcaacacaaactactcaatacgcagagtattcgactatacagtaaaaagaggctcaacaatcgtctggcaaggagttaaagacggcggacactccatagatggcattaagaaaacaatggcaagaaatgacatattatacaccgaaagaacatattgtgaacaaggcgaactattcaacgccacattaataaaaaaaggaaatccgaacgctataggactaaaaaaaggactagacccaatgaaatatggtggatactcaagtccgaaaactagtgcattcgccttcatcgaatttgatggaaaaaaaggccgacaaaatcacctagtggaaatcccggtatatatagcgaatatagcagctagacaaccagaatatataaagaatcacctggaagaaaagaagggttatcaaaacgtcattgttaaaaaatatcccatacaaaaaaacgcacttattaaactcgatggatacccagcaagactacgcggtgcaaacgaaaaatcaataacactaaagaacgctgtacagctcgtgcttaagccagaatatcacgagacgataagaaacgttgaaaaatacttggaatacatagataaagacgagtcagttagtaaggcagcacgatttagccacacagaactagacaaactctacgatgaactatgctttaaagcagaaaatagtatatataaaaaacgcccagcaaaccaatcagcaactttaaaaaatggacaaaaaacatttttagccataacaaatttaaaagaaaaagcacaagtcatcaataacataataacgatgtttagatgcgatgccacaacaactacgaatctaaaaacgatagggggatcagctaacgcaggaggaatgcaagtgaacaaaaacacactaacatcacagaaagtagtattagtacaccaaagtattacaggcctcttcggaacagaagaggaactgttgtga

SEQ ID NO: 5343 - RNA, 4053 nt, synthetic construct
  misc_feature 1..4053: note = Cas9 variant
  source 1..4053: mol_type = other RNA
atgaagaaaccttactcaatcggcctagatattggtaccaattcagtaggatgggcggtggtcacagacgactacaaagtcccggcgaagaaaatgacagttttaggaaacactgacaaatcacatattaagaaaaatctactaggagcattactttttgactcaggaaataccgcggctgacagaagactaaaaagaacagcacggcgaagatatacacgtagaagaaacagaatcctatatttacaagagatattcgcagaagagatgtctaaagtagatgactcattctttcaccgattagaagatagctttctagtaacagaggataaaaggggagaaaggcaccctatttttggaaatctcgaagaagaagttaaataccatgaaaactttcctactatataccacctaagacaatatttagcagacaacccggaaaaagtagatttgcgacttgtatacttagcgcttgctcacataataaaattccgcggtcattttctaatagaaggaaaatttgacacaagaaataacgacgtccaacgactatttcaagagttccttgctgtttacgataatacattcgaaaacagttcactacaagagcaaaacgttcaagtagaagaaatattaacagacaaaatctccaaatcagcgaagaaagacagggtactaaaactttttccgaatgaaaaatcaaatggacgatttgcagaatttctcaaacttatagtaggcaatcaagcggatttcaagaaacatttcgaactggaagagaaaacaccattacaattttcaaaagacacctatgaagaagaactagaagtcctactagcacaaatcggagataactatgctgaacttttcttaagcgccaagaaactctatgacagcatactactatcagggatcttaactgtaactgatgtctcaacgaaagctcctctctcagcatccatgatacaacggtataacgaacaccaaatggacctagcccaattaaaacaattcatcagacaaaaattatcagacaaatacaatgaagttttcagcgacgtctcaaaagacggctacgctggctatatcgatggcaaaacaaaccaagaagccttctacaaatatctaaaaggattattaaacaaaatagaagggagcggatactttttagacaaaatagaaagagaagattttctcagaaaacaaagaacattcgataatggatcaattccacaccaaatacacttacaagaaatgagagcaataatacgaaggcaagcagagttctatccattcttagctgacaaccaggatagaatagagaaaatccttactttccgcataccatactatgtagggccattagcgcgaggaaaaagtgatttcgcgtggctctcgaggaaatctgccgacaaaattacaccatggaactttgatgaaatagtagataaagaatcatcagcagaagccttcattaaccgaatgactaactatgacctatatttaccaaaccaaaaagtactccctaaacactcccttctctatgaaaaattcacagtatacaatgaactcacaaaagtaaaatataaaacagaacagggcaaaacagcattctttgacgccaacatgaagcaagaaatattcgatggagtatttaaagtctatcgaaaagtcacaaaagacaaattaatggatttcttagagaaagaatttgacgagttcagaatagtggatcttactggccttgataaagaaaacaaagcatttaacgcttcatacgggacataccacgatttacgaaaaatacttgacaaagattttctcgataatagcaaaaatgagaaaatcttagaagatatagtattaactctaacactatttgaagaccgtgaaatgataagaaaaagattggaaaattattcagacttactcacgaaagaacaggtcaaaaagttagaaagaagacactacacaggatggggtcgcttatcggccgaacttatccatggcatacgcaacaaagaatcccgcaaaacaatactcgattacttaattgacgatggcaatagtaacaggaacttcatgcaactaataaacgacgatgctttaagttttaaagaagaaattgcaaaagcacaggtaataggtgagactgataatctaaaccaagtagtatcagacatagcaggaagcccagctatcaagaaaggtattttacaatcactcaaaatagtcgacgaactggtaaaaatcatgggacatcaaccagaaaacatagtagtcgaaatggccagggaaaaccaattcaccaatcaaggacgacgcaactcccaacaacgcttaaaagggctaaccgacagcataaaagaatttggatcacaaatcttaaaagaacacccagtcgaaaacagccagctacaaaacgacaggttattcttatactatttacaaaacggacgagatatgtatactggtgaggaactagacatcgactacctttcccaatacgacatagaccacataataccacaagcatttatcaaagataacagtattgataatagagttttaactagcagcaaagaaaataggggtaaaagcgacgacgtaccatctgaagacgtagtaaaccgaatgcgaccattctggaataaattactttcttccggtctcatttcacagcgcaaatataacaacctgactaagaaagaactaacaccagatgataaagccggattcatcaaaagacaattagtagaaacaaggcaaataacaaaacatgtagcaagaatgttagatgaaagattcaacaaagagttcgatgataacaacaaaagaataagacgagtaaaaatcgtaacattaaaatctaacctagtttcctcatttcgaaaagaatttgaactatataaagtacgggaaataaatgattaccatcatgcccacgacgcatacctcaatgccgtagtagtgaaagctctattggtaaaatatccaaaactcgaacccgagttcgtctatggcgaatatcccaaatataactcatatagggaaagaaaaacagctacccagaaaatgttcttctattcaaatataatgaacatgttcaaatcaaaagtaaaactagcggacgatcaaattgtagaaagacccatgatcgaagtaaacgacgaaacaggtgaaatagcttgggacaaaaccaaacatatcacaactgtaaagaaagtactcagctacccccaagtcaacatagttaagaaagtcgaagaacaaacaataggacaaaacggaggtctcttcgatgacaatccaaaatcacctctagaggtaataccaagcaaacttgtccctttaaagaaagcactaaacccagaaaaatatggaggctatcaaaaaccaaccactgcctaccctatacttctaatagtagacactaaacaattaataccgataagtgttatggataagaaaagattcgaacagaatccagtaaaatttttaaaagataaaggataccaacaaatagagaaaaacaatttcgtaaaattaccaaaatataccctagtggatattggcaacggaataaaaagactctgggctagcagcaaagaggtacataaaggaaaccaacttgtagtatccaagaaatcgcaggatctattatatcatgcacaccatttagacaatgattactcaaacgaatatgtgaaaaaccactatcaacaatttgatatattattcaacgaaataacaagtttctctaagaaatgcaaactaggaaaggaacacatccagaaaatcgaagaagcatactcaaaagaaagagattcagcctccatagaagaattagcggatggattcataaaactacttggatttacacaactaggagcaacctcaccattcagtttcttaggtatcaaactaaatcaaaaacaatacaccggtaagaaagactatttattaccctgcatggaagccaccttaatccatcaaagtatcactgggttatacgaaacccgaatagacttatcaaaattaggaggagattga

SEQ ID NO: 5344 - RNA, 4053 nt, synthetic construct
  misc_feature 1..4053: note = Cas9 variant
  source 1..4053: mol_type = other RNA
atggggaagaactactaccttgggttagacatggggacatcatcagtgggatgggcagtaaccgatgaaaagtacagaattttacgcgccaaaggaaaagatctctggggagtgcgcctatttagtgaggccaaaactgcagcggaaagacgaacacacagaacaagtagaagaagactagacagagaaaaggcaaggatagcctgcctcaaagaaatgtttgcagaagaaattaataaaatcgatccaggattttatcaaagattaaatgactccaaatacttcctagaagataaaaaagagcatcaaccgtatgcaatatttgccgacacaggatacactgacaaagaatactacgacgaatacccaacaatattccacttaagaaaagccctactcaacatagaaaatgacaaaaaaaaatacgatgtacgattagtatacctggcaatacttaatatgttcaaacatcggggtcactttctcaatgctaacctagatgataaaagtgggggaaacttgaaagaatacatagagatgctacaccaatcaatggttaacatcttaaatattaatctaaaaaacgtggaaatagagaaaatcgaaaaaatattaaaatctacccaatactcaaattccgaaagactagagaacctgttagaactatacgaactgagcaaaaacaaaaacaaaatagaaacggagatcttcaaatttatatgtggacttaaaggaacaatatccaaaatttacgtagaagataaattcgaagacgaatttgctaaaatgacactaagctttcgagactccaattttgacgaaaaaataatagaaatagaagataatttggacgatgataaatatgacatgttccttctaataaaacaaatacacgattggtctgtattagcaaatataatgaacggagaagaatatttatccgtagctagggtaaaactgtatgataaacacaaaaaagacctggaggttctaaagaaatattataagcaaaattcgatggaagagtataataaaatgtttagacaaatgaatgacggaaactatagcgcctatgtaggctccgtaatttataaagacaactcagtacgcaggggctgcaagagcaaaaaggaagacttttacaaaaatatactgaacacaatcaaaagttgggaagattgtgaggcaaaagagtacataacctcagaaatagacaaaggcaattttctaccaaagcaaataaccgcatccaatggagtcatacccaatcaagtacacaaaaaagaactgaaaaaaatacttaaaaacgcatcagaatacttaaatttccttaacgaaaaagacgaatccggatacacaataagcgaaaagatagtaaaattattcgaattccaaataccatattacgtaggccctatagcatacaacatcggaaacgacgaatcgaaacaccgccataacatgtggagtgttagaaaggaaaaaggacctatatacccatggaactttgaacaaaaaatagatataaaaaaatctagtgaaaaattcattagaaacctaataaaccattgtacatatttgaacgacgaagaagtattacccaaaaacagcctgctatatgagaaatttatggttctcaacgaactaaacaaattaaaaatcaatggcgagaaaatctcggttgaactaaaacaaaatatatttaatgacttattcaaaaaagggaaaaaagtaaccaaaaagggactcattaaatacctaaaagagcaaggtgaaatagataattgcgaagaagtagagatctcaggaatagacggagacttcacaaacaagctatcaaactacaaaaaattcgcggacatatttggagtacaaagtctaacctacgaacaaaccgacatcgcagagaatatcataaggtattcaactatctacggagacagccggaaattcttagaagaaagaattagggaagagtactcaaatgtactagacgaaaagcaaattaaaagaatactaggaatgaaatttaaagactggggaagattgagcaaagagttactagaactatcaggcgtcgataaagaaacaggagaaattgcatcggtgataagtagaatgtggaacgataactacaatttaatggaattaatagctactgagaggttcagctacgcttatgaaatagaacaacgatccaaaaaactagaaaagactatttcaactatagaatatgaagatttagacgaactctatatgagcacgccagtaaaaagaatggtatggcaaacaatattagtactcaaagaactcgaagaagtactaggatgtcctccaaagagaatcttcgtagaaatggcgagagacgtaaatgcaccaaaagacagaaaagactcacgtaaaaaaaaattattagaactatataaaaattgtaaaaaagaagaaggcgactggtcaaaagaactaaatgcacgagaagaaagcgaatttaaaagtaaaaaattatacttatactatatgcaaaaaggacggtgtatgtatagtggaaaaccaatcgacttaaagaatctacttaatgataatttatacgacatcgaccatatataccccagacactttgttaaagatgattcaatagaaaataacttagtcttagtagagaaaaacttcaacgctcacaaatcagataactacccaatagaaaacgaaataaggcagaaaatgcactccatgtggaagatgcttagagacggcaattttatcacagaggaaaaatacagtcgccttatcagaaaagaggaattcaccgatgatgagaaagcaaaattcatatcacgacaaattgtagaaacaagacaaggaacgaaggtcataacagacctcttcgaacaaacattcccagaatctgacatagtatacgtaaaagccggaaatgtaagcgaattcaggcataaatttaagctaataaaatgtcgcaacgtaaacgacttccaccacgccaatgacgcatacttaaatatagtagttggaaacgtatactacacgaaatttacaaaaagtgcactcaattttataaaagactacaagaaaaatccagaaaagaacaaataccacatggatcacatgttccaataccccgtatctaggggcggagtagacgcatggataacaaaaggcgccgaaagcataagtatggtacgaaaaatgatggcaaaaaacaccccaatggtaacaagaatgaactatgaaaagcactcgggtcaaaaaggcggaatatccgaccaaaatatctgttcagccaaaatcgccaaaaaaaatgtatacctaccaataaaaatgggtgacgaaaaactaaaaaacgtagagaaatatggtggatacgggtccttaacagccaaatactttttccttgtagaacatacaataaaaaaaaaaagaatcagaacgatcgaagcatatcctatgtatctagacgcactaaacaaagaaaacaaactactcaattactgtgtacaagtccttgaatatgatgaaccgaaaataataatggaaaaaataaaagttaagagtctgttcaaaatcaacgggtattactactacttaaacgcaaaatcagttaatagaataatatggggaaacgcaacacaactatttctggaaaatgatataaacgaatacgttagaaaaataagtaaaaacatagaatgtatagatattaattcagaaaataacatcaaagtatacgacatatttatagaaaaatattcaaacaaactatttagtaataggctaggcaacctgaaagaggcgataatccaaaaccgcaacaaatttatagaactcaaaatcaatgaacaaatcaatgtaatcttagaactcgtaagatattcacaggacggtgtgtacagcatcaatcttagtcaattgggactctcctcaacttatgccataaataggacttcaaaagagataagtaaaatgaaagaatgcaaactaatcaatcaaagcgtaacaggactatatgaaaacgaaatagatttattaactgtatga

SEQ ID NO: 5345 - RNA, 4053 nt, synthetic construct
  misc_feature 1..4053: note = Cas9 variant
  source 1..4053: mol_type = other RNA
atgcaacaatattatctgggcgtcgatatgggaagtgcgagcgtgggttgggcagtgactgatgaaaaataccaattagtcagaaagaaaggaaaagatctctggggagttagaacgtttgatatagctcaaactgcagaggtacgccgcgtcagcagaacgaacaggagacgacagaacagaagaaaacaaagaatccaaatattacaagaactattaggggaagaagtattaaaaatagacgccggattcttccaccgtatgaaagaatcacgatatgttgccgaagataaaagaacactcgatggaaaacaagtagaacttccatatgctcttttcgtagatcaaggctttaccgacaaagacttctacaaacagtttccgacaatcaatcacttaatagtctacttaatgacgacatcggatacaccagatatcagattagtatatcttgcacttcactattatatgaaaaatagaggcaattttctacactctggtgacatcaatgatgtaaaagacatacaaagtattttagaacaattggaaaacgttctaaaagaatacgttgacgattgggagctcagtctcaaagacaaagtggacgctataaaagaaatttacaataaagacctgggacgtggtgaaaggaaaaaggcattcataaacacgttaggagtaaagacgaaatctgctaaagcattttgctcactcataagcggcggatcaaccaacctcgcagaattatttgacgactcaggactaaaggagtcagaatatgcaaaaattgagttcgccaacgcaaactttgaagatagtgtcgaaggcattcaagcactattagaagatagatttgcagtaatagaagcagcaaaacgactttacgactggaaaatcttaactgatattctaggagacaatgcatcactggctgaagccagagtaaaatcatacgaaactcatcacgaacaactcgttgagttaaagagctttataaagaaatatttagacagaaaaatataccaagacatatttatcaacccaaacatcgcgaataactatcccgcatatgtgggacacacaaaaataaatggaaagaaacaagaactagaagtaaaacgcgccaaaagaaacgacttttacgcatatataaagaaacaagtaatcgatccgatcaaaaagaaagtatctgataaagcagttctagcacgattagccgaaatagagagcttaatagaagttaataaataccttccattgcaagtaaactcagacaacggcgtgataccatatcaaattaaactaaacgaattaagacgaatattcaataacttagaaaatagactaccagtgttaaaagaaaatcgagataaaattatcaaaacattttcctatagaataccctactacgtcggacctttaaatggcgttaaccgtaacggtaaatcaacgaactggatggttcgaaaagaaggggaagaaggaaaaatctacccatggaactttgaagaaaaagtcgatcttgaagcatccgcagaaaaattcatcagaagaatgacaaacaaatgtacatacctagtaaacgaagacgtactacccaaatacagcctcttatatagcaaatacctcgtcctatccgaacttaacaacctacggcttgatggaaggccattagaagtatcggtaaaacaagaaatttacgaaaatgtatttaaacggaacagaaaagtaacacttaagaaaatcaaaaattatcttcttaaagaaggtgttataagcgaaaaagacgaactaagtggactagcagatgacgtaaaaagctccctcacagcctaccacgattttaaagaaaaattaggacacttaaccctaacggaagaccaaatggagaaaatcattctaaacgtcactttattcggcgacgataagaaattactcaagaaacgactagcagcattatatcctaatatagatgaaaaatcgctctcccgaatggcaacatttaactatcgtgattggggtagactatctaagaaatttctaagcgaaataaccagcgtagaccaagaaaccggagaactacgaactattatccaatgtatgtatgaaacgcaaaacaaccttatgcaactactatcagaaccttaccatttcgtagaagctattgaaaaagaaaacccaaaagtagacctagaatcaatatcatacagaatcgtaaatgacttatatgtttcgccagcagtaaaaagacaaatctggcaaacgctgttagtaattaaagacatcaaacaagtaatgaaacatgaccccaaacgcatatttatagaaatggccagagaaaaacaggaatcaaaaacaacaaaatccaggaaacaagttctgtctgaagtatataaaaatgctgaaaaatacaaaaacttattcgaaaagttaaattcactgacggaggaacaactacgttcaaagaaagtatatttatactttacccagctcggaaaatgcatgtataccaacgatgcaatagactttgaaaatttagttagcgcaaattcgaactacgacattgaccatatatatcctcaatcgaaaaccatagacgattcattcaataatttagttctagttaagaaaggtataaacaacgacaaatctgacagatacccaatagacaaaaacatcagagacgacgaaaaagtaaaaactctttggaatacactcctatcaaaaggattaataactaaagaaaaattcgaaagattgattcgatcaacccctttctcagatgaagaattagcgggattcatagcccgccagctggtagaaactagacaatctacaaaagcagtagcagaaatactatccaattggttcccggaatctgagatagtatattcaaaagccaaacatataacaaactttaggcaagattttgaaatactaaaagtaagagaactaaacgattgccaccatgcgcacgatgcatacctaaatattgtagtaggaaacgcttaccatacaaaattcacaaattcgccataccgattcattcaaaataaagctaaccaagaatacaacctaagaaaattactacaaaaagcaaagaaaattgaatccaatggagtaatagcatggattggtcaatctgaaaacaaccccggcacaatagccacagtaaagaaagtaataagccgcaatactgtattaataagtcgtatggtaaaagaggttgacgggcaattattcgaccaacaattaatgaagaaagggaaaggtcaagtaccaataaaatcatccgacgacagactcatcgatatctcaaaatacggaggttacaataaagccaaaggagcatattttgtattcattaaatctgttagaagaggaaaaaccatcaaatctttcgaatacattccagttcatttggcaaagaaatttgactgcaacttagaactcttaaaagaatatcttgaatcagaaaaagacttaaataatgtagaaatactaatgcccaaagtaatgataaactcgttattcaactacaatggatcattaataagaatcccagggagatatgacaagaaatcattacttataaacgtcgacgtacccctattactcgaatcgcaacatataaaacaactcaaagtcatagaaaaatatatgtataagaaacgtgtatccaaaaacagcaacatactactaaccaaattcgcatcagatcaacttaaagatcttgatgccctatttgacgtcctatcatataaattgaacgaaaacatttataatgtaatcaatgacaaatatgataaactcgtaatctgtagagataaattcatcagtcttgacaccgaagtaaaatgcgaaatgatattcgaactactacatctattccaatgtaatagccaacttgcaaatatcacaaaaattggagccacttccaaattcggatcgatctcaatgagtaaaaatctaaaagaaaatgataaaatgtcaattatacaccaatctccaagtggaatattcgaacatgaaatcgaattaacagcactctga

SEQ ID NO: 5346 - RNA, 4053 nt, synthetic construct
  misc_feature 1..4053: note = Cas9 variant
  source 1..4053: mol_type = other RNA
atgaaaaggatcctcggcttagatttgggcacagcaagtataggctgggccttagttaatgaatctgaaaacgaaaaagaaaaatcagaaataataaaactaggagtacgcgtaaatcctctaacaacagacgaacaaacagactttgaaaaaggacgaccattaagcgttaatgcagacagaacattaaaaagaggcgcgagaagaaatttacaaagattcaaacagagaaggaaaaacctaatagaaatactcatcaaaaagggatttataaccaatatatcgctgttaacagaaataggttcgaacaccacatatcaaactctagaattgagagcgaagagtgtaaaagaaaagattgaaaaagaagagttcgcaagggtactactaacaatcaataaaaagcgcggatataaaagctcaagaaaagctaaaaatgatgaagaaggctctcttatagatggaatgtcggttgcaaaagaattatatgacaataacttaactgtgggacaatacgtataccaactactcgaaaaaggagggaaatatataccagatttctacagatcagacctccaaaacgaatttgatgtcatttggaactttcaaaaggaattttaccctaatatactaactggagaattatacaagaaattacaagggcaaggtcaacaaaactcccgcaaactcttcttagcaattcatcaaatatacaccgcagaaaataaagggaaaagagatacagtcaagaaacaacactacaaatggcgaaacgatgcaataaacacacaactcttaatcgaagaagtagcatacgtcctagtagaaatcaacaacaacttaaacaaatcaagcggctatctcggtgcaatctccgacagatcgaaagaattatacttcaacaaagaaacagtaggcgaaaatctatataaacaaatacaagaaaacccacaaacttccttaaagaaccaagttttctacagacaagattacctagacgagttcgaacaaatctgggaaacacaagcaaaattttactccgaattaaccaaagaactaaaagaagaagtaagggatgtagtcattttctaccaaagaaaattaaaaagccaaaaacacttaataagcgaatgtgaatttgagaaacaccataaagcaattccaaaatcatccccattatttcaagaatttaaaatttggcaaatactaaacaacattgaatttaaacataagaaaacaaaagaactaaaaatattaagcgaagaattaaaagaaactcttttcgaagaactcaacataagaggaaactttacatctgatgctgtgcttaaattcgtaaaactagataagaaagaatgggagctaaattacaagaaaggtatcgaaggtaataggacaaatgaagtcttatacaacgtctatcagaaaattgcagaatatgaaggctatggttttgactggtcaaagaaatcagcagtagagattaaagaagaattaaacaccatattcagcgaaataggaataaactcaaaaatactagacttcaacccagaaatcagcggcaatgattttgacaaacaagaatcataccaattatggcatctactgtatagcgcagaagaagacggattcttgaaacaaaaactacaagacaaatacgggttcaaatcagaatacgcaaacatgctagcaaacgtctctttccaatcagactacggatctttaagcgcaagggccattaagaaaatacttcctaatttgatcgccggccacgagttctccgaagcatgttcattatcaggctataaccatagcaactcattaactaaagaagaactggcaaacagaccgctaaaaggtaaattagaactattaaagaaaaattcactcagaaaccccgtggtggagaaaatactgaaccagatggtaaacctagttaatcaagtaatcgaaagttatggagaaatcgatgaagtcaggatagaactcgcaagggaacttaagaaatcagcacaagaacgagccctaatgactacaaacataaacgcaagcaaaaccaaatatgaatcctttagaaaactactacaaaaagattttggcattaaaaatccaacaagaaacgacatcatcaaatacagattatatgaagaattaaaagcaaacaaatatcatactatatacacgaataaatacataccaagagacaaactattctcgaaagaaatcgacatcgaacacataataccaaaagcaaaactgtttgacgattcattctctaataaaacactagcttttcgaaaacccaatcaggacaaaggtaacatgacagctatcgattatattctcagctaccaatctaaagatatagacaactataaatcaagaatcgaaaacttattcaaaaacgggaaaggcgatatatcaaaagctaaacgaaataaacttctcatggaagaaaaagacataccagatggattcatagaccgggacttaagaaattctcagtacatagctaagaaagcaaaacaactactggaagaagtcatacgcacagtaaacacgaccacagggtctgttacaaacaaattacgagacgactggggactaatcaacgttatgcaagaattaaacatgccaaaattcaaagcaatagacgaatcattaatagaacagatagagaagaaagacggaacctttaaaacacgtataaaagactggagcaaaagaaacgaccatagacaccacgctatggatgcgctaaccgtagccttcacacgatacaaccatatacaatatttaaataatctaaatgccaaatcagacaagaaaggtgctatatacggtattcaagaactagaaacttatgttaacagcaaaggaaaaagaaaattcataaaaccgatgcataatttcagggaagaagctaagaaacacatagaagacattctcattagttttaaagccaaaaacaaagtagtgactaaaaacataaataaaataaaaagcaaagacggattcataaagaaagtacaattaacgccaaggggacaacttcacaaagaaaccgtatatggcaaaattaatgaagtagtagtaaaagaagagaaaataaacgcaaaattcgacctcgagaaaataaataaagtaacaaaacccatttatcgaaacgcactattaaaaagattacaagaatttaacggagaacctaaaaaggcttttaccggtaaaaacagtttaagcaaaaatcccatatacctcgatgttgcacaaacaaaaaccctaccagaatccgtaaaggtacaattcttcgaagaaaattacaccatcagaaaagaaataagcccagacctaaaaatagataagatcatagataaaggcatccaaagaatcctattaaaacgattagacgagttcaacggaaagcccaaagaagcattttctaacctcgaaaagaaccctatatggcttaataaagaaaaaggtatcgccataaaaagagttaaaataaaaggagtcaaaaatgtagaatcgctccacaataaacgtgaccaccttggtaacgaaatacttcaaaaaggaaaatccgcaccaaacgactatgtatcaactggaaataaccatcacgtagcaatttatcaagacaaaaatgggaaactccaagaaaaagtggtttcattttatgaagcagtcgcaagagttaacaataaattaccaataattgatcaagactttaataaagatttaggatggaaatttttattcacgatgaagcaaaacgaaatgtttgtttttccaagcgaagattttaaaccactagaaacagatctcatggataagaaaaacaatagcaaaatatccaaaaacttattccgagtccagaaactaggcaacaaagactacactttccgacatcacctagaaactaaaatagaagatatcaagaaactaagagacttcacctacataagaaaacgaaatcccgaatcaatcaaaaacataattaaagtgagaatcaatcacttagggaacatcgtacacgtaggcgaatactga

SEQ ID NO: 5347 - RNA, 4056 nt, synthetic construct
  misc_feature 1..4056: note = Cas9 variant
  source 1..4056: mol_type = other RNA
atgtccaagaaatactatttaggccttgatataggtacgaactcagttggctgggcagtaactgatgaaaactacaacctatgcaaatatgcaggaaaaaggatgtggggtatacgattgttcgaaggaggagaaacagcggaacaacgaagaataagtcggtcgaaccgcagaagattaagccgaaagaaacaacgaatagatctgctacaagaactatttgcagaagaaatagcgaaaatggacccaaccttctttatacgattaaatgaatcacgacttcatctagaagataaatcaaccggggaaaaattccccctatttcgagacaaagactataccgatattcaatattacaaagaatatccgacaatgtatcatctccgcaaagaattaatagaaaatagcaaagtgcacgatataagattagtatatttagcctgccaccacattctgaaaaatagaggccactttttaataaacggcagtttcagtgacgtaaagaaactaagttctgtatgcgaaagcatgctcaattcattcaacggaatctccaaataccaaatcgagatcaacgacatagaacgactggaagaaatactatccgacaggaagaaacagaaaagcgtcaaagctaaagaattaatacaaatattcgagtgcggaccgtgcgaagataaaacagatgagaaaacttgcaaagcaattgtatcaaatctatgtaaatggttaactggcctcaaaggtaatatcaattcaatatttgatatgcaatttgaagaaatagataccagttctttctcattcacagagccaaaatatgaagacacaatatctgcagcattagaagaaaaatacccggattatgctgacgtaatccagaaaataaaagcagtctacgactggtctgtgctcgtagagataatggcaggagaagattatctaagttttgctaaagtcaacgcatataataaacacaaagaaaatctgtgtatactaaaagaagtgataaggaaatattgtgattcagaaatatatcataaattctttaacggattcgacgagaaaaatgggtatggaaactatataggttcaatctacaaaaatggacactcatacgcaatgaagaaatgcagtacagaagatttctataaaacactcggtaaaatactcgataaaatacaacccgaaaaagaagacgaaaatgtcctagaagagttaaaagttgaggtcaaaaatcaaacacttcttccactagcacgaacaacggcaaacggaacaataccaaaccaagtacacatccaagaacttagagcaattctggataacgcaaagaaatacctcccatttttaaacgaagaagatgaatacggaacagttgcagagaaaataataagcatagcaaaatttcgcattccatattacgtaggtcctctaagtacaagacacaaagaacaaggagccaattcatggattgttcgaaaacaagaaggtagaatctacccttggaacttcgaagaaatggtagacttagaacaatccaataaagagttcatacaacgaatgactaataaatgtacctatctaataggcgaggacgtcctgcctaaaaacagtttattatattccagatacatggtgcttaacgaattaaacaacttacgcatcaggggaaataaaataagtgtaaaactaaaacaagaactgtacaaagaactattctgcacaaaagctaaagtaactggaaaaggactctttaactacctcaagaaagaagacgaagaattagcactagaagatatcagcggttttgatatcgacttcaaaagttcgttaacttcttacctagacttcaaaaagcaaatactaggagaagaaatagaaaaagataaatataaaggtatagtagaaaatatcataaaatggaaaaccatttatgatgacgactcaaaaatgatgaagaaaatgatagaaagagaatatccaaatgtattcagtaaagacaaaataaagaaaatttgcagatttaaatacagcggatggggtaactttagcctatcttttctaaacggcataagaggagccgaccgagagacaggagaaagtttcacaatcatagaagcattatggaaaacgaattacaacttaatgcaactactgagcaaacaatttacttttcgagaagaaatcgatctaataaacgcggaaaaagttggaaaaattaataaagtaagctatgacaataccgtaaaagacttaatagtttcccctgccaacaaaagagcaatatggcaaacagtacaaataacagaagaaataaagaaagtcatgaaatgtgagccagagcgcatattcatagaaatggctagaggaggagaaaaagagaagaaaagaacggtaagtcgcaaagcgagattattagaactttatgcagcatgtaaagatgatgtaagagactggacaaaagagatagaagatcgcgaggaaagggaatttaattcgaagaaactatatctatattacacacaaatgggaagatgcatgtattctggagaggaaattaatatagacgaacttatgcagaaaaactcaaaatgggatatagatcatatatacccacaatccaaaataaaagatgattcattagacaacatggttttagcgaagaaagttataaacaatagtaaacaaaacaaactgttaagttcagacatcagaatcaaaatgaagaaatactggaacgcattatataaaggaaacttcatatcaaagaagaaatacgatcgcttaacaagaacggaagatttcacaaatgaagagttaagtggattcatagaacgacaaatagtagaaacaagacaatcatcaaaagcagtagccgaactccttaaccgactatatgaacatagtgagatagtatatgtaaaagcaggcctcgtatcagacttcagacatgacaacaaacttttaaaatcaagaagaataaacgattatcatcatgctaaagacgccttcttgaacatagtagtcggaaacgtttacaacgcaaaattcacaagcaatcctagaaaatggataaaagaaaataggggcaccaactatagtataagaagagtctttgactacaacgtaaaaaggggtaacacagtagtatggcaaggggttgaagatgggggccactcaatagacgaaatacgaaagacaatggccaggaatgacatactatacacggagtatacctattgcgataaaggggaattattcaatgcgacattaatcaagaaaggtaacgataaagcaataaacctcaagaaagcactagatagcgttaaatatggaggatacaattctccaaaaacaagcgcattcgccttcattgaatttgacggcaaaaagaaagaaaggaaaaaccacatagtagaaattccagtctacatagttaatatcgcaaaaagacaaccagacacaataaaagagtaccttgaacaaaagaagggatacaaaaatgtcgtagttaagaaataccctattaagaaaaacgcactaataaagatcgacggctatctggctagattaagaggggcaaatgaaacggacatcctactaaagaatgcagtacagctaattctaaacgacaaatattatgaaataataagacgagtagagaaatacctagaatataatgtaaggtatgaagcagaatctatgtttgaaggctttgaccacgcagacctaaacagcttatatgatgaattaacgagtaaattagagacaagtatatacaagaaaagacctgcaaaccaactaaatgcactagaaaaggggaaagagaaatttaaaaacattcaaaccttaagagaaaaagcgcaaatcataaaagaaatgctaataatgtaccgttgtgacgctgctacagtcgccaatctaaaggcgattggaggatccgcaaatgctggaagtatgaaaatcaagaaaaatacattaacatccagaagtctagtactggtcaatcaaagtataacaggactcttcgaaacagaagaagaactcgtttga

SEQ ID NO: 5348 - RNA, 4056 nt, synthetic construct
  misc_feature 1..4056: note = Cas9 variant
  source 1..4056: mol_type = other RNA
atgtataagaaatatggcataggactggatataggcacatcctcaattggatggagtgtagtagatgaatacggacacataataagagtaaaaggccaaaccggtctaggagttaggctattcagggaagggcaacctgcagcagatagacgtacttttcgtaccacccgcagacgtttgggtagaagacgatggagactaagattattacgagaaatttttgacccttacatagccgctcaagatcctaatttctttgcacgacaaaaggcctcagccatagctcctggtgattctagatttaaagctgtgtacagactattcaatgaccagactgatagacaattctacgataagtatccaacagtataccatttacgacaaaaattaatgacagagaaaaggcaatttgacatacgcgaaatttatttagcagttcatcatattgtaaaatatagagggcactttttaacaggcggagctgccaagaacttcaaaccaggaaaattagatctaaacacatacttcgcaactataaacgcgcagttagcagccatatttatggactcacaagtcgaattaccacaactagattgggatgcagtagtttctctcctaactaacgatcaggaaagtccatctgaccgtcaaaaagcattaacaaaaatgctcgttgctcaaggagatgccacccagaaaagattttacaccgagttctccaaagcactactaggcctaaaagctaaattatacgtcttaacaggattcgaaggtgacaagacagatcaaaaagcattaacgctttcactagaaacacttgacgaccaccaagacgatgtgacacaactacttggtgatgaacaaagacagttagtggaactcctagcacgtgtacaatcggcaattcaactggcaatcataataccaaacggcaaaacattttcaggccaaatggtgcaacaatatcaaacacattacgatcagctacgactgctcaaggactaccgcgaacaattaacagatcaaaaacaccgtagagcgttaaaacaagcctatgctgactacttagcaaacgatcaagatcaagacgcattagtaaaggccgttgaaaaagttttaaaacagaaccaacccctttccactgtaggagtacgtctacaaacagcaatagatgctggtgattttctccctaaacaaagaacgaaggcaaactcagtaataccacatcagatacatcaacaagaactagaccgaataattgaagcacaaagcgtttactatccctggttagcggaagaaaaccctgttgcagcccatagatcatacgcaccctacaaacttgacgagctagttgactttcgagtaccatactacgtaggaccacttgttcaaccacaagctgataaagccgctaaagaaacaaaatttgcatggatgacacgaaaagaggcgcaatccacaacccctataactccgtggaatttcgaacaagaagtcgatcgtaatgcatccgcaaacgctttcattcaaaggatgaaaacaacagacacatatttactcggggaagacgttcttccgaagaatagtctattatatcaaagattcgaggtattaaatgaactaaacaacgtaagagtagatggaaaattgttaactatagcagaaaagcaacgcctatttcaggatctttttgtcgatcgatcacaagctagcgtaacaatcgctcaactgcaagctaatcttattgcccacggcgctgcgaaagaccgcgtagaaatcaaagggttagccgacccaaaaagattcttatcttctttaaccacttatcacgattacgcacagattatacccgaagcattagagcagcccgacaaaagagcggacattgagaaaataataaattggagtacaatattcgaagatacatcaatattcaaagaaaaacttcaagaaatagcatggctcacaccggaccaacgtaggcagctctcacagaaaaggtatagagggtggggacaactatccgacaaattgttaacacaacttcgcgatgcaacaggccaatcagtaatggatttactatggacagaacctaacaattttatgcaaattatacgacgtactgaatttcaacaagcaatagcacgcgtcaatcaaactgatcttaaacaacaagacttagccactacaattaatgacctttacacatcacctcaaaacaaaaaggcgatccgtcaagtattattagtagtagcagacatacaaactgccatgcatgaagtggccccaagttggctctttatcgaggccgcaagaggacccgaacagaatccaaaaagaaaattagcaagacaacaacaactactagaagcatacaaaacatcagcaaaagaaattgtcaatgaagcagtaaaagaaaaacttttatcagcaatcgatgatcatcaaaaatttgaagaccaggtagttctatacttccaacaaaatggtttagatatgtacacgggtaaaccattagattttgaacgtttaagcaaataccatatagatcatataatacctcaaagcgtagtaaaggacgacagtcttgataatagagtactaacaactccagaagaaaatgaacgaaaaggagcaagagtaccaggccccctatacgcctcacaacaaggacgttggagattactacaaagagctggactaattagccaaagaaaactcgatcatcttctacttcgacctgaagagttggatcaacaggccacaggatttgtggcacgacagctagtagaaacacgacaagtaatcaaactaatcactaacattctatcgcaacaatatgatcccgaacaaactaaattagtatcagtaaaagctggcttatcccatcaattccgcacccggttaaatctcccgaaacttcgagaactaaacgactatcatcatgcccacgatgcttacctagcagcaagaataggaacgtatctcctacaaagatacccaaacctagaaagatttttcgtctacggccaatatcagaaaactagattcgacctaaaaagacactttaactttataggagagatgttaaaaggaaagccagaggacgcagtaatcgttaaagcccctcactccgaaacagtcatctgggataaacaagatgaagtaaaacaattaaagaaaataatggaatatagacatctattagtaactcatgaagtatatgataaccacggagccctattcaatcaaaccatacacccagccaaaaaccccaaaaataggaaactaatcccacgaaaaacaactcaatcaacagaactatacggaggatactccggagaaactacaggatatttagccatcgcacgaacggttacgaaaaacaaaatatcatatcaagtactaagagtaccgaccagactcgttggccgactacaaagatcatcagaatccgcacaaagacaaatactaacagactggttcgcaccatcattcgtttctagagggaagcaacaaccattcgaaatcgttttaagacatgtgttcaaaaatcagactgtaatagatgacatacatgaacaatctcatcgatttggtcttagatctgatacgtactactgcaatcaacaacaattagtactatcgttagaacaacagagaatgattatagaccaaaaattaaacaacacaaacaaattaatggtggtatacgaagccgtctgcgaccaagtagccaagtactttccattataccgaatgaatcactttaaagaatccttattagaagcaggcccaaaattagctgaactaccaataaacaccgttcaaagtaaaaacggtaagctgaagttaggtcaaagatccgtcctcctacaaacaatgcaaggactacacgccaacccggagacaaaagaccttagcattataggatgccccaaatacttcggtaaactacaggtaagctctggcatcaaattaaccgaaaacgcagtactaatacacgaatcccccactggcttattccaacggcgtgttcgtttatcagacctttga

SEQ ID NO: 5349 - RNA, 4056 nt, synthetic construct
  misc_feature 1..4056: note = Cas9 variant
  source 1..4056: mol_type = other RNA
atgaaaatcttaggactagacttagggacaaacagtataggatgggcagtagtgaacgaggcagaaaacgaaagagaaagctctagcataattagacttggtgtacgcgtgaacccattaacagtagatgaacaaaataacttcgaaaaaggaaaaccaataacaacaaatgctgacagaacactaaaaagatctatgcgcagaaaccttcaacgctataaactacgacgtgcgaaccttgtaagtttattaaaaacacaaggatggataacagatgagactcttctaagcgaacaaggcaataacagtacttttgaaacctatagactcagagctgaagcagccacaaaagagataacgttagaacaatttgcacgagtcttactaatgctaaataagaaacgcggttacaaatcttcaagaaaaatgaaacacgatgaggacggttcgttcgtcaataacttagatatcgcccgcgagctctacgacagtggtctaaccccgggacaatatgcttacaatcttcttaaagatggtaagaaatacatccctgacttctacagaagtgacctccaagaggaactagataaaatctgggcgtaccaatatgaatatcatgaaaatattctaactcacagccttcgatccgcaatcatagatcaaagcaaaacaggcactacaaaaatatttttaaaaactcatggcatcttcacagccgacatcaaaggaaaccgaaatgaacgaaataagcaactatttgaattgcgttgcggagctctagaaagagcattaacagcagaagaactagcgacagtaattgcagaggttaacggacaaataaattcaagcagtggctatctcggagctatatcagaccgtagtaaggctctttttataaaccatcaaacagtaggacaatacttaatgcaacagctagaccgcgacccaaacaaatcactcaaaaatcaaccattttacaggcaagactatctagatgagttcgaacaactatgggaaacacaagcacactaccatccagaattaacagcagccttaaaacatgaaatcagagacataataatattttatcaaaggagactaaaaagtcaaaaatggctcgtggctaattgcccatttgaacatagaaaagtatgtccgaagagttctccactgtttcaacatttcaggatatggcaagtcctgaataatgtgactgtgaccgtagataataaaacctatgtcctcaacgaagaacagaaaagtatactgagtaaagaactcctgtacaaagagaaaataagtaaaagagatgcactaaaaatgttattcgtaaaagcaaagggagtcgatatgaatttcgcgtctctagaaggagacagaaccatgtcgaacctactcaaggcagcccaagaaatagtgagcatctcaggacatggtgattacgacttcggaaaaatgcctgcggatgacatacataacatcataagaagtgtatttgggggtttaggattcgcgactgattggttgaatctcgatacagatgcagacgatctcgaacaagaaagtcaaatgaggttgtggcatttaatatattcatttgaaggagacaattcgactacgggggacacgaagctagtggaaaggctcatgtcacttttgaacctaccccaagaatatgctagattatttgctaacgtacatttggaagacgattattgcgggattagcagtaaagctcttaaacgaatactcccgtttatgaaagcaggccatatttattcagaagcgtgtgcactagcaggatacaaacatagcgaacaaagccttacaagggaagaaaataaaaacagacctttaaaagatcatctagaacaattacccaaaaacagcctaagaaatcctgtagtggaaaagatactaaatcagatggtaaatgtagtcaatagcataatagacacatacggtcgaccagacgaaatacgtatagaactagcaagagaattaaagaacaacgcgctaggaagacaagcaatattcgaagctataaacaggaacacaaaagaaagcgagcgcattcagcaaatactaaagaaagagttcggattgactcatgtatcaagaaatgatataataagatacagactttatcaagaattatctggaaatggatacaaaactctatactccaacatctacatacctcaagaaaaacttttcagcaaagaaatagatatagaacacataatcccccaagcaagactttttgatgattcattcagcaataaaaccctggaatatagagacgttaatataaagaaatcaaatacaacggcaatagacttcgtaagaaacgaatacggtgaaaatgaagtcgaacaatataagaaacgagtaaacgatttacttaaaagtggagcaatatcccaagcaaaagctaagaaattaaaaatgacagaagctgaaatacctaatgatttcatagaaagagatttaagaaatacacaatacatttcacggaaagcacaagaaatgttacgagacgtagctagagtggtcactgctaccacaggtagtgttacagacagattacgacaagactggcagctagtagacgtaatgcaagaactaaattgggacaaatacgaacgtcaaggactgacaacggttataaacggtcgagacggccaacaaatacgaaggataacagattggacaaaaagaaatgatcatcgacaccacgccatggacgccctcacaatagcctttaccaaaccagcatacatatcatatctaaaccatctaaacgcaaggagcgaggatgacataaggagcattgaaagacgatttctagaaagagacgcaaatggacacctaagatttatcagtccaatcgcccataattttcggagtgaagctaaaagacacctagaaatgatacttgtaagcataaaagctaaaaataaagttgtgacaagaaacaataatacaacaaaaaccaaaggaggaaggcgtaatagaatacaattaacgccaagaggccaacttcacgatgcaacagtctacggatctatactattaccacatacaaaaactatagccgtagacggtaaaatgacagccgaaataataggacaagtacaaaatccagtcttccgtcaggcactaagtcagcgattagaggcctgtggaaatgatccaaagaaagcattcacaggtaaaaactcactggaaaaagctccagtatggatagaccaagcacatacagaacatgtcccagcagaagtaacaatccaacgtctggaaccacaacataccatacggagagcagtaaacaaagatctgaatataaacaaagttctagacaaaggaatccaacatatattacaagcaagactagacgcctacggaggagacgcagccaaagcatttgcaaatcttgataacaaccctatttggctaaaccaggaaaaaggaattgcaattaaaagagtaacaacagcagagaatataagtggagaacccttgcaccacaaacatgataaagaagggagacctatactagacacaaatgggaaaccaatgccctcagattttgtaagattaatgaacaaccatcacgttgcaatatttcaagatgccgacggtaatttacaagagcacatagtatcattttatgaagcggtagctagagtgacggaactaggattgcccgtaatagataaagaatacaacaaagacaaaggatggcaattcctatttactttgaaacaaaatgaatatttcgtttttccaaatccagcacaaggattcaacccagacgaaattgatcttacggatgaaagaaattactcgcggataagcccaaatctatacagggtgcagaaaatgtcatcaaaatattatgtattcagacatcatttggaaaccactgtagaagataagaaagaactacaaggaataacttggaaaagaatccaaagcctaaataacctgaaagggatagtaaaagtacgaatagatcacataggaagaattgttcaaataggagaatattga

SEQ ID NO: 5350 - RNA, 4056 nt, synthetic construct
  misc_feature 1..4056: note = Cas9 variant
  source 1..4056: mol_type = other RNA
atgttttcacaacaaaataatctatactgcgaaagcctatcaaaactatattataatataacaaaaaattttctcagcaaaaacgaggtctgcagaatttatgaaatctttttctgttcaatattaacatacttcctaaaaaagtacaatcacgatatattcaaaaaaagctcaaccatgaaaaccatccttggcctagatctgggggtcacatcaataggttgggcagtaatagtaacggacgacgacaacacacccataaaaatactggggatgggctcaagaataatcccactaagcaccgctgataaagaagagttccaaaaaggtcaagccatatccaaaaaccaatcccgcacaatagcgagaacgcaaagaaaagggtacaatcggaaacaattaagaaaggaagaactaaaaaagatcttaggagaacttggaatcactccgagtaaagaattgctaaacctaccgtccatagaattatggaaattacgagctgatgccgccagtggaaatgcaccactttcagcagaacaactcggaagaatattctacatgctgaaccagaaaagaggatacaaaagtgcgagaagtgaagcaaatcaagacaagaaagataccgactatgtagccgctgtcaaaggaagacaccaacaactaaaagagaaaggccaaacaataggtcagcacttctatacagaaatgctaacattagaagagaacagcgggcacttccaagtaaaaaataatgtttacccgagagaagcatacctcgaagaatttaatgcaataatagctgcacaaaaaccccagcatgccttcttgacggatgacgtagttgaccgactgcgagatgaagtaatattctaccaaagaaaactaaaaagccaaaaaggcctagttagtatatgcgaatttgaaggctttgaacgaaccttttttgacaacgtgaaacaaaaagataaaacaatattcacaggtccgaaagtagcgccaaaatcgtcgccattatttcaactttgtaaaatctgggaaaccgtgaacaatattaacctaaaggtcaaaaatactgacggctcaaaaaacaaatgggccgattacgttcccactttagaacaaaagcaagaaattattgaacacctatttaaaaacgcaggaatctcgttagatgccttaagaaaaatattagggttcaataaagacgaaatattcgtaaataaacaaatagagaagggtctacaaggaaacacaacatatgccgaaatacacaaaatactcggcgacagtaagcccgaattgttaggattcaatattaacatagaaccatcaaaacattctgctctacttgttgacaagcgcaccggagaaatactagcagagaaggagggacaacaagtatctgcagaaatagaaaaagagaatttttaccagctctggcacacgatttactctataaaagacctagacgaatgtgccgctgccctaataaaaagattcaacatcgaccccaacgtagcagctcagttggcgaaaatcgatttctcaaaaggagccttcggcaacaaatctaataaggccatgagaaagatattaccgtacttaatgcaaggttacaattacgcagacgcatgcagtctagcgggttacaatcactcggactcacaaacaaaaaaagaaaaagaagaaaacgtggtagacgataaactaaaattgctagaaaaaaacagcttaagacaaccagtagtggagaaaataatcaaccaaatgatacacgtagtgaatgcaataatagataaatacggcaaacccgacgaaataagagtagagttagcgagagacctaaaaaaaagtaaagacgaacggaacgaagctgaattacaaaatgcctcaaacaaaaagttaaacgaagaagtcgcaaatagacttaaagagttaggattaccagttaccaaacggttcgtccaaaaatataaatttatatttcccgtgcgtgatagaaaaataaaagaagcacaattagtaaaccaatgcatttattgcggcgaaacattcaacgttacagaagcattatcaggcgataacttcgatgtagatcatatcatacccaaatcaatgttatttgacgatagtcaaacaaataaagtattagtccataggaaatgtaacgctaaagacaaaagtaacaaaacagcttatgatttcatagcggccaagggagaaaatgaacttgcaatatacctagacagagtagatgactggttcaaacgaggggtcttaagttacggcaaaatgcaacgtttgaaagtaagttacgagcaatacgcggaaagaaaacaactaaaaaaagaaactgaagcagatataaaactctgggaaaacttcatagaacgagatttacgacaaactcaatacatcgctaaaaaatcaaaagatctccttaagaaaatatgtaacaacgtcaccgtaacagaaggaaagataactgcacaattaaggaacctctggggttgggatgatgtactcatgaatctccaacttcccaaatacaaagcacttggccaaacagaaatcaaagaatggacatccgaacacgggagacgtctacacaaaaaagaagaaataacaaactggactaaaagagatgaccatcgtcatcacgctatagacgcgttagttgttgcctgtacaaaacaaggtttcatacagagaataaatacacttaactcttcagatacgaaagatgctatggatagagaaataaaagccgctaaggaaaaatacaatgaactttacgacaaaaaattactcaccgaaacaaacgaacaagtaaagaatcacacagaaaggttcaacaaactggaaacataccttaaatcacagcaacctccacttttcactacaagatatgtagaacaagaagcagacaaaatattcgtatcgttcaaagctggtaaaaaagcagcaacgtacggaatcagaaagataaaaaaagacggcaaaaaagtagtggtgcaagagaaaatagtagtaccacgaggagcattacacgaacaatctgtatacggcaaaataaaaactcaagaaaaagataaacccctaaaatatttatttgaaaatccagaaaccatagtagacaatcgaatcaaaattttagtaaaagaaagactagacaaattcgaaggcgatgtcaaaaaagcactcacctctctaaaaaaagagccgttattcattgacaatgaaaaaaacaccctactggaaaaagcagcatgctacacagatgccaccgtactgaaatacaaactacaagctttaaaagcaaaccaggttaatgatatagtagacgaaggcgttaaacgaattgttaaagcgcgacttgcacaacacaagaacgaaaaggaagcatttaaagatacagtctggttcaatcaagagaaaagaatacccattgtatccgtcagggtattcgcaagaccggatgcaagcaaattagcaataattaaaacagacgaaaacaacaaacctatcggtttcgcacttaccggcaataaccatcacatagcaatatataaagacaacacaggaaaattagtacaacacatatgcactttttggagcgcagtagaaagaaaaaaattcggagttccgacagtagtaaaaaacacaggtactctatggtctgaattattacataaggatcttcccggaacgttcctcgataaattgccacaagacgggttagaactagaatattcattacaacaaaatgaaatgttcgttcttggattaccgaaagaatcatttgaagacgcaataaagaacaacgacctaccgttattatcaaaacacttatatctcgtatggtccatctcagacaacgattactggttcagacatcatttggaaaccaaaaactcagaactcaaaagcacaacaggagctaaagaaagtaaacgatattacagatttcaatcagtaggaacattcacgaaggaaaatccaattaaagttcaattaaatcacttaggtgagataacaaaaataggagaaccatga

SEQ ID NO: 5351 - RNA, 4059 nt, synthetic construct
  misc_feature 1..4059: note = Cas9 variant
  source 1..4059: mol_type = other RNA
atgaaaaaaagaaaccgagaggagtactacgtgggacttgatataggcacaagtagtgttggatgggcagttgctaccccagactacaggataccaaagttcagaggacataaaatgtggggtagtcgtttatttgcggaaggtaaaagggcagcagagcgaagacaatttaggacaaatagacgtcgactcgctagaagacgagacagactacaaatcttagaagaactgtttgctgaggaaatggcgaaagtcgataacactttttttatgcggctaaaagaatctaaattcttccttgaagacaaaaccgtcaaagaaaaacacatactattttctacggacaaatttgacgctgaccgattttacaaagacaacccaaccatataccacgtaagaaagagacttatggaagaagaaccacaagacatcagagaattattcttggctgtacatcatatattaaaatacaggggacatttcctattcgcaggatcattagaacaaaacggagcaagcatagaagaactagtaagaacgttactaggaaaacaaggactcgccatattggacgacaccatagacagcaatgaaatggttaatatactcaaaaacacaggcgaaaccaaatcagatcgaaaaaaggatgtacaagaattatggaacccattaaaagataaagtaaaaaaagcacaagcagccgaaatggccggtttagtgctagggttgaaaagcgatataagcaaactattcgcaaactcagattataaagacctcgattcctcaataaagaatataaactttagctcaggagattacgaagaaaaacgtgatgattatgcaaatagtataggggatgacatagtattactggacacaatgaaagcactatatgacactttaattttatctcaaatactacaaggaaaaagatcaataagtgctgccaaagtcgaagattataacacacataaagaacaactaagagcactaaaagcgatattaaaaccacataaacgcttatacaacgagatgttcagggaaaataataagaaagacctaagtaattatgtagcatacatctctagttatagcgaaggaaaaagagttaatagagaaggattttataaatacgtacaagctgtattaaagcaagttgacgattcagattccaaacaggcaatacttgaagcaattcgcctagaaacattcctaccgttattacgagtaaaagataatgcggtaataccacatcaaattcatcaagccgaattagaagcgatacttgaaacagcgaggaaaaaatataatttcttaaatgacgtatcagatggggtaagcgtaaaagataaaataattcaactatttacattccgaattccttattacgtaggaccgttaaacccccacagtggggagacagtggcagacagaaagcaagggacaggatgggtagtaagaaaacaacgaggcaaagtatacccttggaatttcgcggacatggtagacgtaaaagccagcgcagaagcattcattacaaacctaacgaacaaatgcacatatttaataggggaagatgtattacccaagcgaagcttgttatacagtgaatttatgttactaaatgaactaaatatgatcaaatatgatggccatgaattgccagtagccataaaacaattgtatatagaacaagttttcaaacaagaacataaaaaacagacaaaaggtagagtacttgattttctcaaaagaaacggattaataacaggatcagcaaccgctgtcattacaggaatggatgatgctataaaaggagatttacaaagctacagagatatggtacgaatttttggcgcgggctttgatcattcaatggccgaaaggataataagatgggttacactatttggcgaagcaaaagatatattagagaataaaatccgtgaagtatacgggaattcaatatcagactcccaaatgcgagccatcaaaaaactaaaatacgcagattggggcagactgagccaagcattcctcatcgcagttaaaggatgcgacaaaagcggcgtagaaaggaacataataacatgcttacgtgcatcatcacaaaacctaatggaaatactcagcgatcaaggtacctatataaaacagataaaagcttggaatcaccaacataccacaaatatgatggatacactcgattatcaacttgtagacgatttatacgtcgctccttcagtaaagagatcaatatggcagtctctctgcatagtagaagaattagtcaaaataatgggtcaagctcccaagaaaatctttgttgaggtgactaggacaaaacaagcggaaaaaacaaaaaaagattctagaaaaaaaaggttggtagaattatacacagccatagggaaagaaggtgcagcatggaaaaaagaaattgaagctcatcaagctggagactttagaagaaagaaattatacctatattacacacagatgggaagatgcatgtatagcaacgagccaatagcaatggacgccttattcacaagtgcctacgatatagatcatatttatccacaatcattaacaaaagatggcagttgggacaatctagtacttgtaaaatcacaattaaacaaagaaaaatcagatcaatatccccttaggccagcaataagagagaaaaataaagctcattggcaatacctatgcagagctgggttcatctcagaaaaaaaatacgaaagacttatgagaacaacagaattaacagcagaagaattatcaggattcatcgctaggcaactagtcgagaccagtcaggcaactaaagcagttacagggctccttgaacgcatttataccaacacagagatatgttttgtcaaagctgaaacggtttcacaatttagacaccaacataatttcattaaaatacgcgaactgaataactatcaccacgccaaggatgcttatctaaacatcgtagtaggtaacgtttatcacgaaaaatttacaaaaaatccatgggaatttattgcgagaagcacagaaagaagaccgtataacctgaataggatgtacgactttgatttactaaaacaaggacgtgttatatggcaagtccctaaaagtttagaaaccgtacaagccatgatgaaaagcaacgatgtgagaataacaaaaaaattattagtccaaaaaggggagctgtatgatgcaaccataaccaaagcacataaagcaaaggagggaacttactttccactcaaaggagctgacgcaaggctaagagacgtgcatagatatggtgggtacgaaaaaataaaaatagcctattattctgtgttcagttgtagagaaaaagcctcaaacacaattcacacattaattatacctataccagtttacaaggcaggactattacagacggaagcagacttgactgcctacgcctggcaaacaaaacaaaaaactaaaccaattaaagacatttattcagcaatcactcccatctataaaaaactatgtataaatacagtggtaaaaatagacggttttaaatactttctaggcggaaaaacaggagactatatgtggctagatcctgcaattcctgtagtactcgacgaacaagctgcagcctacctcaaagccatatctaaagtggggcgtgcggatgatgttgaaaacacggcacaagccatcgatttaattacagcagaggcgaacgaagccttttacgatgtactattaaaaaagatggaagctaaaatatttgccaaggcgtaccaaacaatagttgaaaaactagcaagtgaaaccgcacgagaaagattcagggaactctcaataggcgcgcaatgttcgtgtctattagaaatactaaatttacttgcaaacaataaaacaacattcaccttcttcaaggataaaatgggcgtaaccatgtcaagaagaaaacagccaatggacttaactaaacttgaagaatgtatcgtgtatgagacaagtatcacaggtctttatgaaaaagcagtatcacttctatga

SEQ ID NO: 5352 - RNA, 4059 nt, synthetic construct
  misc_feature 1..4059: note = Cas9 variant
  source 1..4059: mol_type = other RNA
atgggaaaacgataccatataggactcgatataggcacatcgagtatagggtgggcagtaatggatgacgacttcaaaataatgcgagtaaaaggaaaaaaaggtatcggagtacgcctctttgaagaaggaaaaaccgctgcagaaagacgaggacacagaaccactagaagaagatacagcagacgaaagtggagactcaacttattagaagaaatattcgatccggaaatcgcaaaagtagatcccactttcttcgccaggctaaaagagagcaatttatcacctaaagatgaccgaaagcaatacagtggcaatctaatatttccggaaaaggcaaaagaagaaataagagaatggacagagaaatatccgaccatataccatttacgaaacgcgctaatgacagaaaatcgacaatttgatatcagagaagttttcctagcattacatcacatcgtaaaatatcgaggaaatttcctcttcaatggcaatttccaaacaggcgaagtaaacctcagcgaccgtttcgacgacattaacagcgcatttatatcagcatgcggagaagaagaagccccccaaatcccatctgagttatacaatgatattcaagaattactctttgataaaaataccagaaaattagacaaccaaaaacaattggcaacaaaactctcacaagataacgataaagattggtcaacacaatttagtaaagcgctcttcggctacaagactaaattcaaagtcgttcttcaaagtaacgaagatcttgacgactttcaactagactcagacgacgcagatgataaaatagcatcaatcagcgaacaaatagacgacgacaggggttcaatcttagataatataaaaatattatattcacggataactctcaacgaaatagtcccagatggtaagactctaagccaaagtatgatcgaaaaatacaacttgcacagagaccacctaaaagagatcaaggatcagctaaaacatacagacaactgggtcaaatttgatgacctctattcccagtatgtaaacggaaaactagaaagtgaccgccataagaaattatcatcagatgacttctacaaaaaagtactaaccttatttgacggtgaactaaaaacaagagtcaaagagtggcaagagaaaggcgaatttctcccaaaacaaaggaccggatcaaacggagtgatcccacatcaattacaccaaaatgaacttgatcaaataattgaaaatcaaagtaaatactacccatggctagctactctaaacccaaatgaaaaaagacagagagtcgcaaaatataaacttagtgaacttgttgcattcaggataccttactatgtaggcccaatggtgaccaaagaccaatcagacttcgcttggatggtaaggaaatcagacgaaaaagaaattactccatggaattttgatcaggtagtagacagagacaaaagtgccgaggaatttatcaatagaatgacaacgaaagatacatacctcataggtgaagacgtccttccagcaaaatcactcctctatgaaaaattcacagtcttaaatgaactgaacaacatacgtataaatggcaaacccctaaccaccgacgaaaaacaccaagtatacagggacctgttccagaacgccaaaagcatatcaacaaaaaaatttcacaattatttagtatgtaaactaaacaaacccaaccatctaaatataacaggattctctgatctgactaaattcaactcttccctagattcatacattgacttgaagaaaatattcgcagaccaaatagacgatcaaagtcttcaggatgacttcgaaaaaatgatacgatggagtaccgtattcgaagataaacaaatatttgaaagaaaattatcagaaatcaactggttgactgaccaagaaagatcagaagtagctaaattaagatacagagggtggggcagactatcaaaaagactattagcgggaatacatgacgagaatgggcagcgaattattgacgcgctatggaattcaccaaaaaactttatgcaaattcaagccgaggttgctttcaacaaacaaatcaacgaccttaacacaaaagaactgtcagataacaacgtcgaagacgtcttagcagacgcatatacaagtccccaaaataaaaaagcaataagacaagttctacttgtcgtagaagacatacagaaggccatgcatggagatgccccaacatcaatcagcctagaatttgcccgggaagaacaagaaagtagcagaacacgaagcaggagagcagccttaagcgcaacctataggcaaataagtgatgaaatagtctctgcaacagttaaaggagaattaggaaaagctacgagtataagcgacagactatacttatacttcacacaaggaggtagggatatgtacacaggcgaaccgatcaacatagacgaaataagtcgtggatacgaaatagaccatatactaccacaatcctttataaaggatgattcgctagataatcgcgtattagtaaaaggagccattaacaatggaaaatcagcaaactacgtaatggatcaatcgtgggccccagatagactagcatggtggaaaaaattactcgacaatcgattaatttccagaaaaaaataccaaagtttaacattaacccccggaaaaataaataagtactctcaaaacggcttcataaatagacaattagtagaaacaagacaagtaatcaagctcgtagccaatattctaaatgaccaatattcaaacgatgatacaaaaataatcgttgtaaaagcagcattaaactcacaattaaggggctttttagaactctttaaaaatagaaacataaatgactaccatcatggaatggacgcgtacctaagcacatttataggtaattacctttataaaaaatatcccaaactaaggagttacttcgtttacggagaattcaaaaagttttccggcaaacagaatttaaagtcattcaattttttacacgatttagaagacgatagtataaatataataagcaacgatgatggagaaatagttggtaaccatcacgaaatgatcgaagaactagagaaagcctatcaatacaaatatatgctagtgtcaagagaagtcttcgaaaaaacaggagatctgttcaacgtgacagtttacagccgaaaagccaaaaaaaccctaataccgataaaacaagataaaccaataaatatctacggcggatattcagggaacaatgacgcatacatggccatagtaaaactcccaggtaaaaaaggaaaaccagacacctataaaatcgtaggcataccactcagatttgccggagaacttgaacgagcaaaacaactaggtgagtcagcatatagagagaaattaagtgcagtaataacaccccaattcacaaaagagaaaaaagataggaaaacaggtgaaataacaaaagtagtcgatgattttgaagttgtactagatagagtaccataccgacaactatttaaagattcagacaagtggtttatgttaggatccgctgcataccaatacaacgcaaagcaattagtattaaacaatgatgacgtgaagttactaaacgaacaaggcagaaagaaattagaacttccaaacgaaaaactctcatcagcactgaacgacgtatttgaccacataatacaaataatgaactctaagttcgggctatatgataaaaacggattcagaactaagttaacagaggcagcaagtatattttacgatttaccgcttagagcagagtataatggaaataaaaaagtaacagacggcaaactagaagtactagacaatatactaattggattacacgctgacccatcattcggaaacttaaaacaattaaacatgtccacaccattcggacagatgcaaacaaaaggaggagtggtcctaaacggaaattcaacccttatataccaaagtccaacaggtttattcgagagaagagtcaagcttaaagacctatctaaatga

SEQ ID NO: 5353 - RNA, 4059 nt, synthetic construct
  misc_feature 1..4059: note = Cas9 variant
  source 1..4059: mol_type = other RNA
atgaaaaaaatccttggattagatttaggaacaacatcaataggatgggccttcataaatgaaggcgaaaacgacaacgaaaccagtagtataataaacgcaggagtacgcatcgtgcccttaacaaccgacgaagaggcagatttcaaaaaagggaatactatctctataaacgcagacagaacactaaagcgcggagcaagaagaggccttcagcggtttaaacaaagaagagatgcattactacaaagtttcaggggtataaactttatatcatcgaattacgtttacgcagaaactggaaaacaaacaacattttcaagttacaaactaagagcaaagagcgcaaccgaacttgttactaaagaagaattagtccaagtactcttaatgcttaataaaaaaagaggatataaatcgtcaagaaaagcaaaaactgctgaagagggagacgcaatagatggaatgaaaattgccaaggagatattcgaaaacaacctaacacctggacaatgggtatataacagtttatcaataggagggaaattcattcccgacttctaccgatcagacctacaaaaagaggtagaaaaaatagtaagattccaaaatcagtttcacccagaacaaatgaacgaaaaattattggaaaacatacaaggaaaagcaagaactgtcacttcccaatactttagtcgaattctaaacatcccattagccgaaaataagggcactcgtgaagaaaccaaactccaacattacaaatggagaaacgaagctctaaccgaagaactagacttaaaagtattagcctttattatcacagaaataaacaatcaaataaaccaatcaaatggttacttaggagctattagcgacagatccaaagagctctatttcaaccaagaaacagtcggccaattccagtataatcagctgaaggaaaatgcacatacaaaactaaaaaatcaggttttctaccgacaagattacctagatgagtttgaaaaaatatgggaaacacaatcaaaattctaccctgaattaaatgacgaattaaaatcggaagtcagagacatcacaatattttaccaacgaaaactaaaatctcagaaacacctcgtctcattctgcgaattcgaaaaaggacacaaagcaattcccaaatcaagtccactcttccaagaattcagaatatggcaaaacataaacaacatagtcgtcaaaaacgagaccacaaaagaaccatttctactcggagaagatttgaaaaaggtaatagcccaagagctaagtttcaaagagtcaatgaccgatagccaactattaacattttgcgaccttaagaaaggaacacacacagtgaattttaaaaagatagaaggaaaccgaaccaacacctcattatttaaagctttcgaaaaaatactggtattagaaggatatgacgaactcgatctatcaaaactagacgcgagcgacataaaaagcattataaaatcagccttctcggacctagaaatatcaacagcaattttagactttgacccgacaatacaaggaaatgactatgacaaacaaagttactaccagctgtggcacctgctatatagtagtgaagaagatgatttcctaaagaaatctctgatggataagtttggcttcaaagaatcccacctaccatttcttttgaacataaacttacaagccgattacgggtccttatccgcgaaagcaattaaaaaagtcctaccccatttaatggatggtcacatatatgataaagcctgcacacttgtaggatataaccacagtagttctctcaccacagatcaaaacaatgagagagtactaaaagatactcttgaattgcttaaaaaaaacagtctcagaaatcccgtagtagaaaagatactaaatcaaatgatcaacgtcataaacgcgatcataaaagatcccgcaatgggtaaaccggatgaaataagagtagaacttgcaagagaactgaagaataacaacgaacaacgatcggaaatgacaaaagcaataaacaaatcaacgacagaacacgaacagatccgaaagttattacacacagaatttggaatacatagagttacaaggaacgatataatacgatacaagttatggaaagaatgtgatgggatttctctatacacgggaaagcccatagagcccagcaaactattcacgaaagactatgatattgaacacataataccaaaaagcagattattcgacgactcctttagtaataaaactatatgcgaaagacaactcaacatcgacaaatcaaataaaacggcctatagctttttccaagaaaaactaagcgccgaagaatttgaccaattcgaaaaaagagtcaaatcacttttcggaaaaataagcagaaccaaacaaaataaactcttaatggccaacaacgagatccctgagggatttatagatagacaactccgagaaacccaatatatagcaaagaaagctaaggagatactattagaagtatcacgaaacgtgacagcaactatcggatctgtaacagacaaacttagagacgattgggaactcgtagatgttatgaaggaattaaactgggaaaaatacgacaagctcggactaacatacatagaagaaggaaaaaacggcgaaaggctatataaaataaaagactggacaaaaagaaacgaccatagacatcatgctatggacgctataacagtagctttcacaaaacctgcatacatccagtatcttaacaacttaaacgcccgaaccaatacagataaaaaaggaaattccataatcggaatagaaaataaatacctaaaaagagataaaaacaataaactacgctttatagaaccaataccaaatttcagagaagtagcaaaaaaacaactcgaaagcatattaatctcttataaagccaaaaataaagtagtgacaaagaataaaaatgtcacaaaaaaatcaaatggtacaaatcaaaaaatccaacttactccaaggggacaattacataaggaaacggtatatggcaagctacaacaatacgtaacaaaagaagaaaaaataaacgccaatttcacaccagaatacgtaacaaaagttgcgaaaaaagaataccgagaagcactactcaaaagacttatcgagaacgaaaatgatcccaagaaagcattcacaggaaaaaacgcactatctaaaaaccctatttacataagcctagaaaataacatattagtaccagaaaaagtaaaaatagtctggttaaaatccgattacaccataagaaaagacataaccccagatttaaaaatcgataaagtcatagatatcggactaaaaacaatactacagaatcggttaaacgagtttaatggagatacaaaaaaagcatttgtcaacttagatgaaaaccccatttggcaaaacaaagaaaaaggaatagcaatcaaacgcgtaacaatatcaggagtatccaatgcacaagcattacacacaaaaaaggatcacctcggaaatgaaatattagatgaaaacggacaacccctaccagtagactttgtcagtacaggaaataatcaccacgtagccatatatagagatgaaaaaggaaacctacaagaagaagtcgtaagtttctttgaggcagtaactcgtaacaatctagggctatcaataataaacaaaaaccatgaaaaaggatgggaattcttattctcaatgaaacaaaatgaatttttcatattccctacagacggatttaacccacatgaaatagacttacttaacacagaaaattatcatctcatctcaagaaatatgttccgagtccaaaaaattgcgactaaaaactatatgtttaatcatcatctcgaaaccaaatcagtagacggggaaatgcttaaaacaaagaaacaactctcaaaaatctcataccacttcatccaaacaccaagctaccttaactacataataaagatccgtataaaccatctcggacagatagtgcaattgggtgagtactga

SEQ ID NO: 5354 - RNA, 4059 nt, synthetic construct
  misc_feature 1..4059: note = Cas9 variant
  source 1..4059: mol_type = other RNA
atgaaacaagattattatataggattagacatgggtacggaaagtgtaggatgggcggtgaccgacgttgattacaatttaatcaagaaaagaggtcaagactattggggtgtatatttattcgacgaagcacaaacggcacaaggacggagggcattcagaactaatagaagacgacttgcacgagtacgtcatcgattaaacttactccaagaactattcgatagcgagatatcggcaaaagattttggattcttctacaggttagaaaattcaaaatacttcgacgaagataaacccgaaattgcgaggggaaaattcttactatttaacgataaagacttcggtgacaaagaatattacaaaaactaccctacaatatttcatttaagaaacgcattgagaacacaagaaataaaagacgttcgattattatatttggcggtacatcacatattgaaaaacagaggacactttctatttggggaacaagactttaatgtgaatgacgcgagtgatgtatcaggggaatttgagaaaataaacagattcctaagcgaaaacgacggggctggattcgatcgagagaaaataccagaaatattcgaaacactctgcaatgaaaacctagccaaacgtgaaagaaaagagaaaatactagaattagcagggaacagcaaaaataaactattaggtgaagcagtaaacgctgttgtaggactaaatttttcgctatccaaaatgttcggagaagaccgcgatttccaaggagaaaacaaaatgagttttacagatagtagtttcgaagaaaaactagctaaagctagaatggcactagatgatgatgaagcagacttccttgaaacattgaagaaagtgcaaagcgtagcttcattacataacatattacacggtaaagaatttatcagtgaagctaaaaccgaagcatacgaaacgcacagaagagacctatctgaactcaagaaatatgttagagaaaattgtccagaaaaatatgctttggtatttagacgacaggtcaagaaaggtaagaaaaatacttcaggggctgacgaaaacgaaaaagacgataagaaagtaaataactacgcagcatacattgggatggacaaaggaaaaggtttcgaaaaatgcaagaaagaagacttctacgcattcctaaagaaagaaataggaattaatgatgaaagtttactagccaaaatagacgaaggtatatttttacccaaacaaatttcagcggaaaactgtgatattccatatcaagtacacctagccgaattaaaagcgattctcgcaaacgcagaaaactattttcccttcttaaaacaaaaagatgaaaattgcgaaatgacagtatcggagaaaataatatcattaatgaaattcagggtaccatattatgtaggacctttcacagacaaagaaacaagattttcttggatgatcaagaaagaaggtttatcaacacagaaaataacgccgtggaatttcgatgatgtagttgatcgagatgcctccgagaagaaattcatagaaaggatgaccaacttctgtacatacctaacgggtgaaaaagtactacctgcaagctcatttttatacagcgagtacgcattcttaaacgaactcaataaccttaaagtaaacggaactaaagacttaagggtcaaaaacattttatttgactttgcaaaaacaaacaagaaattaacattgaagaaatgttgcgaacaactggttaaaaatggactactaccagaaggtagtaaagcaagagatgtatttagtggaaccgacggcgattttaaaaatagtttaagctcatatatagatttcaaaagaataattggtgataaagctgacttatacagagatatgtgcgagaaaataattttatggataaccgtaattagtgacaaagaaaggctagtcaaaatcatcaaagataaatacggaacggttctatctgatgaagaaataaaaggattaaaagcactaaactacactaaatggggccgactttcagaaaaactattagatgggatattcgaaaccgactcagaaggagaagtaggaaacgtttctattatagagaaaatgagaaccgatacggaaaattttatggaattactatctaataaacacaactataaaagagcaatagaactggcaaattcggaaagtatagtagacgagagagtgacataccgagcggtagaagaattatactgttccccagctgttaaaagatccatatggtcagcactaaaaatagtacgtgaaattgttaaagtacaaggacatagcccgaagaaaatattcgtagagacgactagagaaaaacccgatgtgacacgaaaaggtcaaaggacagtttctagaaaacaacaattattagacaaatacagagagaatttgcgcaacgagacagaactaatcaagaaaattgaagaaacagaagactctaaattcaatagtgataaactattcttttactttacccaaatgggaaaagatgcatacactggagagaaaatagagttcgatgacgtattcaaaactgaaaaatacgacatcgaccacatatacccaagatcaaaaataaaagatgatagtctcgacaatcgtgtgttagtcagaaggaaaataaatcagagcgtaaagaaagattcatatccactatcagccgaaattcgcaatcgtatggaaggcttatggagacaactgagagacaagaaattaattagtgacgagaaattttacagacttacaaggtcaactccattaacagaaaaagaatgcggtgattttattaatgctcaattgatagcaacaagtcaatcggcaaaagcagcaatccagctcttaaaaagaatgttaccagaatcagaaatagtatacagtaaagcaggaaacgtcaacgagttcaagaaaagattagaatttgtaaaaatacgagaattaaatgacttacaccatgcaaaagatgcatactttaatatagtggtaggcaacgttttcaacacgaagtttaatcacaacccagcagtctttcaaagaagtaacggaacaggaaattatgattttgaaagactatatgacttcgatataacaaatgcctggaagaagggggatgaaaaccgaatcagaagtgtcgcagagaagaatacatgccgggtagtcagattctcaaaaacggaaaaaggccaattttatgatgccacaatttacccagccggcaaaaacgataaactcgcgcctgtaaaaggaaaagcaccgttaaatgacacttcaaaatatggaggatacgataaagagactacagcttatttcatgcttgtaaaatcaagagacaagaagaagaaagataaaacattactaagtctggagtgtgtaactgttctagccgacaaaaattttcgtactgcagaagataaactaaaatattgtgaaaaagaacttgggttaaaagagccagaaatacttatagagaaaataaaattaaacactttatttaaaataaatggaagctatgcgtggataagaggacgaaccaatgacaggttagtactatgcaacgcaaaccaattatggctggataatggatcagcaaaagaactaaagaaaatatcaaaccatttccgggacgtcaagaaatataacaataaggatttaccggtaagagaagaagaatttagcaaagaacaaaatctcgcactatacgatttgtttaccgaaaaattaggtggaaaaatctatgcaggacttccagtacaaggccaaatcaaaaacctcgaaaaaggacgggataagttcgaggctttagaactaaaagatcaactatttgttttaatggaaattctcaaatttatgcagtgcaattcaatgacttcgaatataaagttaatcggaggtgccgaaaatgcagggaaaaatagaatatctaaactaatacaagactcggatgtaaaaatgatattttgctcgccaacaggatacttctgtaaagtagtggactttaaaagatttctatga

SEQ ID NO: 5355 - RNA, 4059 nt, synthetic construct
  misc_feature 1..4059: note = Cas9 variant
  source 1..4059: mol_type = other RNA
atgaagaaaatactcggacttgacctcggcacaacatccataggatgggcttttataaaagaaccagaaaaagatgttgtgggttcagaaatagtagacatgggcgtcaggatagttccactttcaagtgacgaagaaaacgactttgcaaaaggcaacaccatatcaattaatgcagatcgaactctaaaacgaggtgcaagaaggaatctccaaagattcaaacaaagaagaaatgcactcctagaaatttttaaagagaagaaacttataagtacaaactttaaatacgcagaagacggaccctcttcaactttcagcacgctaaatctacgagcgaaagcagcaaaagagaaaatagaactacaagacctcgtaaaagtgttactacaaataaacaagaaacgaggatataaatccagccgcaaagcaaaaagcgaagaagatgatggaagcgcaattgatagtatgggaatagctaaagaactatatgaaaatgacctcactccgggccaatgggtatacgaagcattacaaaaaggacgcaaaaacgtaccagacttctaccgctcggatttacaagaagaatttaagaaaattgtaaactatcaatccgaatttttccccgacatattcaacgcatcatttgtcgaagattggatgggaaaagcatccacccctactaaacaatacttcaacaagaaaggagtacaactagctgaaaacaaaggaaaaagagaagaaagaagacttcaagaatacaagtggagggcagaagcagtaaacttcaaaatagacctctctgaaatcgcattaatacttagtcaaataaatagccaaatttcaaatagctcaggataccttggagccatcagtgacaggtcgaaagaattatactttaaaaatctcactgtaggccaatatttatatcaacaaatcaagaaaaatccccacacccgattaaaaggacaggtattttacagacaagactatcttgatgaatttgaaaggatctggagcgtacagtcatcattttacccacaattaaatgacgcattaaaaagagaagtaagagatatcacaatatttttccaaagaagactcaaatcacaaaaacatctaatatccaactgtgagttcgaagaccatcacaaagtagtacccaaatcgcacccagtctttcaagagttccgaatatggcaaaatctaaacaatttacttcttataaagaaagataacctcaatgaaaaattcgaccttgaactagaatcaaaaatagcactagcgaacgaactagcatttaaaagagaactcaacgtcaaagatgccttaaaaatattaggcttaaaaccaaacgaatgggagttcaacttcacgaaaatagaaggaaatcgaacaaatcaagccttcttcgatgcgtttgcaaaaataatagaactcgaagacggtgaaccaattgatctaggtgacttgaaagcagatgacatactagatcaattctcagaggcatttttaagaattggcatcgataccgaattactacaagtaaattcagatatcgaaggagcagaatatgaaaaacagtcttacattcaattctggcacttactatattctagtgaagatgatcagaaattaaaacttaacttgatccgcaaattcggatttaaaccggaacacgcaaaaatattagcaagtatcagcctacaagacgaccacgcctctctctcctcaagagcaatcaagaaaatactaccccacttgcaatcaggcctcatatatgataaagcctgcacatatgctggatataaccatagctctagttttactaaagacgaaaacgagaaaagagaactacgcgcagaactagaattactcaagaaaaactcactccgtaaccctgttgtagagaaaatactaaaccaaatgattaatgtagtaaatgcaatactcaaagatcccgaacttggacgaccagatgaaattcgtgtagagatggcacgcgaactaaaagccaatgcagaacaaaggaaaaacatgacgtctaatattgccagtgcgacaagagaccacgacaaataccgtgaaatactcaaaagtgaatttggactaaaacgagttaccaaaaacgatctcctaagatataaactttggcttgaaactgacggcatatcactatataccggaaaacccatagaagcctctaaattattttcaaaagaatatgacatcgaacatataattccgaaagcgaggctattcgacgatagtttttcaaacaaaacaatatgcgaaaggcaactaaacatagacaaagctaacgtcacagcgttctctttccttcaaaacaaattatcagcagacgaatttgaacagtaccaaagtcgcgtaaaatcattatatggaaaattatcaaaagcaaaaatacaaaaattactaatggctaacgacaaaataccagaagattttattgcgagacaactacaggaaacccggtatataagcaagaaagccaaagaaatacttttcgaaataagcagacgagtatcagtcacaacaggaacaatcacagacaaacttagagaagactggggcttagtagaaataatgaaggaactaaattgggaaaaatatgataaactaggattaacctacactatcgaaggtaaacatggcgagcgactaaacaaaataaaagattggtcaaaacgcaacgatcatcgacatcacgcaatggacgctcttacagttgcactcacaaaaccagcatacatacaatacctaaataaccttaacgctaaaggactaaacaataagaaaggtacagaagtattcgcaatagaacaaaaatatttaaaacgagaaaatggaaaactatgctttattcccccaatagaaaatataaggtccgaggccaagaaacatttgagtcgcatcctagtttcatataaagccaaaaataaagtagtgaccatcaacaaaaacaaaacaaaatcgaaagcaggactaaacgaacaaattgcattaaccccaagaggacaactgcacaaagaaacggtatacgggaaatcctttcactactctaccaaattcgagaaaataggagcatcatttaacgtacagaaaataaacacagtcgcgaaaaaggaagaaagagaagccctactcaagagacttgcagaaaacggaaatgacccgaaaaaggcatttacaggcaaaaacaccctaaacaaaatgccaatctacttagatctcgggaagaatataaaactgtccgaaaaagtaaagacagtagtacttgaacaaaactacacaataagaaagaatatagaccccgacctcaaggtagacaaagtgattgacgtaggaatcaaacgaatcctagaatcaagactcgaagaatttggaggcaatgctaaattggccttcagtaatctagaagaaaaccctatctggttaaataaagaaaaaggaataagcataaaacgagttaaaatatctggtgtatcaaatgtagaaagcctccacgtaaagaaagatcactttggcgaacccattctggaccaagaaggaaacgaaattccagtagatttcgtaagtacaggtaacaatcatcatgtggcaatatatgaagatgaaaacggaaatttacaagaagaagtagtatcattctttgaagcagtagtgagacaaaatcaaggactcccaattattaagaaaaaccatacactcggctggaaattcctatttaccttaaaacaaaatgaatacttcgtatttccatcagacgattttgttccagccgatgtagacttaatggatgaacaaaactaccatctaatatcacccaacttattcagagtacagaaaatagcaagaaagaattatgtcttcaataatcatctcgaaacaaaagcagtagataatgacttgctcaaaagtaaaaaggaactctcaaaaatcacatatcacttttatcaaacacccgaacatctccgaggcataatcaagatccgcataaatcatttaggaaaaattatacaaatcggggaatattga

SEQ ID NO: 5356 - RNA, 4059 nt, synthetic construct
  misc_feature 1..4059: note = Cas9 variant
  source 1..4059: mol_type = other RNA
atgaacaagaaatattatctaggattagatataggaaccaactccgtaggttgggcagtgacagacgaaaactacaatctctataaatacgcaggaaaaagaatgtggggaattagactttttgaagcagcagatacagcagcagaaagaagaatgaaaagatcaaatagaagacgactctccagaaagaaacaaagaatagacctacttcaagaactattctctgaagaaatagtaaagaaagacctaacatttttcataaggctaaacgaaagcagactccacttcgaagacaaaagtactggagaaaaatatcccttatttgtagataaagagtatacggatatagactaccacaaacaatatccaacaatgtaccatctacgaaaagaactaatcgaaaatccagagccacacgacataagactcgtttacttagcttgccatcatatacttaaaaaccgaggacacttcctaattaatgggtccataagtgacgtcaaaaatttatcattcgtatgcggggaaatgataaaagagttcaatagcgtcagtgaatacgaaataagcctgacagatataagagaactagaaaggatactgagtgacaagaaaacagcaaaaagcgtaaaagccaaacaagtcgctcaactattcgaatgtacccctgcagaggataaagagcaacaaaaatgcgccaaagcaataatcacaaacctcagcaaacttatagttggtctaaaagggaacataagtaaaatgtttcatcaacccctggaagagatatctactaaatcatttaaatttacagaagccaaatacgaagatgaaataatgccagcgatagaagaaaactatcccgactacgcctcagtcattgatagaataaaaggtgtatatgactggagcgtcttagtggaaatacttgatggagaagactacttatccttcgcaaaagtcaaagcatatgaaaaacacggtaaaaatctccacatattgaaaaatgtgatgaagaaatattgcaaagatgaagtataccaagcattctttaatggaataaatgagaaaaatggatatggaaactacataggtgcaatccgtaaaaacggacatacgtacaaaatggacaggtgcaaatcagaagaagacttctacaaaggcctacagaaaattctaagtacaatagtacccgaccaagaagacgaagaactcctagaaaaacttaaagcagaggtagaaaatcaaacccttctaccattagctagatcaaaagaaaacggaacaatacccaatcaagtacacttacaagagctcatgaaaatactggacaacgcaaaagaatacctagactttctaaagaaagaagatgaatacggcacaattgcggagaaaataatatctatagcaaaattcagaatcccatactacgtgggcccattatcaagaagacataaagaagaaggttctaacagttggatgatacgaaaagaagaaggacgaatatacccatggaactttggagacaaagtagacgtagaacaaagtaacaaagagttcattgaaagaatgactaataaatgcacatacttgattggagaagacgtactccctaaaaactcattattatactcgaaatatatggttctaaatgaattgaataatttaaaaatacgtgggaacaaaatttcagtcgaacttaaacagagaatctataaagatctattctgcaccatggcaaaagtcacaggaaaaagaatactagagtacttaaaaatggaagacccagaaattgtccaggaagatataagtggcttcgatatagacttcaaatctgccctagcttcatacctagactttaagaaacaagttgtgggaaacgaaatcgaaaaagaccattataaagaaataattgaagaaatcatcaaatggaaaacaatatatgatgacgattcaaaaatgatgagacgaatgatcgaacgggaatatccagaagtatttgacaaagaacaaataaagaaaatctgtcaactgaaatattcgggatggggcaacttcagcgacaggttcttaaatggagtaagaggagcagataaagagacagaagagagttatacaataatagaggccctatggaaaacaaattacaatttaatgcagcttctatctaaacaattcagcttcaaagaagaaatagatcaaataaatgcagagaaagcaggcgatgttggaaaaattaactacgaaaatacagtgaaagaccttatagtatcaccatcaaacaaacgagccatctggcaaactatacaaatagcggaagaaataaagaaagtgatgaaatgcgagccagaaagaatttttatagagatggcaagaggtggagaaaaagagaagaaaaggacagtaagccggaaaactagattacaggaactctacgcaggctgtaaagacgacacaagaaactggatgaaagaaataggagacagagaagaaagagagttcaatagtagaaagttatatctttactatacccaaatgggcaaatgcatgtacaccggagacgaaatagatgttgacgctttaatgaaaggcaacagcaactgggacatcgaccacatatatccacaaagcaggatcaaagatgacagtctagacaacatggtcctggtgaggaaagatgtaaacaataagaaaaggaataaaattttatcaccaaaaatcagggaagatatgaaaggctattggaccatgctgtgtcaaaaaggtctaataagcaaaagaaaatatgatagactaacaagaacaactgatttcacagacgaagaactgtcaggattcattgaaagacaattagtggaaaccagacaaagcagtaaagcagtagcagaactacttaatcgactatacaaagatagtgaagtcgtatacgtaaaagccggacttgtaagcgactttagacacgacaatgatctattaaaaagtagaagagttaacgactatcatcatgccaaagacgcatttctaaacattgtagtagggaatgtatatcacgtaagatttacatcaaaccctcgcaaatggatcaaagataacagagactcaaattattccattagacgtgtgtttaattacgacgttaaacaaggagacaaaatagtctggcatggtagtgaaaacggcggacacagtatagaccaaattaagaaaataatgagccgaaacgacatcctctacactgaatacacgtactgtgaaaaaggccaacttttcaacgaaactctagccaagaaaggaaatgaaaaagcaatcgcactcaagaaaaacttggacccagtaaaatacggtggttatacaactcccaaaacttctgcattcgcattcgtagagttcgatggtaagaagaaagaaaggaaaaaccatattgtagaaatccccgtttatgtagtcaatatagctaaacgtgaacccgacgccgtaaagaaatatttagaagaacgcaaaggatactcaaatgtagtaataaagaaatatcctatcaaaaagaactcactaatcaaaatggacggttacctagccagattaagaggagcaaatgaaaaagacattatactcaaaaatgcggtacaactaatacttaataaagacttatatgaaatcgtccgcaaaatagaaaaatatctagaatacaacttacaataccaagcagatgcaaaattcgaaggatttacaatgaaagacctcaacatgatatatgaagaattataccttaaactaaaagagtcaatatttcaaaaacgacctgctcaacaaatgaaaacactagagaaaggcaaagaagccttcatatcaattgaaaacctcggtgaaaaggcaaaagtaataaacgaaatcatagcaatgttcagatgcgatgcaacaactgtggcgaacctaaaagtaattaatggctcacaaaacgcaggatccatgaaagtaaacaaaaatacactcacttccaaatcactaaaattagtacatcaatcaataacaggactattcgaaacagaagaagaacttgtatga

SEQ ID NO: 5357 - RNA, 4062 nt, synthetic construct
  misc_feature 1..4062: note = Cas9 variant
  source 1..4062: mol_type = other RNA
atgaaaaagaaatactacttgggcctagacatcggtactaactccgtaggatgggccgtaacagacgaaaactacaacctatgcaaattcaacggcaagaaaatgtggggaataagattatttgaagacgccaaaacagcagcggaaagacgaacgaaaagaagtaatcgaagacgaattgcaaggactaaacaacgaattgatcttctacaagaactatgcgaaaaatcaatatttgaaaaagacccaacattctttatacgtttaaacgaatcatccctacacttagaagacaaatcaacgggagaaaaatatccattattcgtagataaagaatatactgacatagactatcacagagaatacccaacagtttatcacctaagaaaagaacttattgaaaatccagaaccccatgaccccaggctagtgtacttagcttgctgtcacataataaaatcacgcggacacttcctggtaaacggatctattagcgacgcgaaagacctctcatttatctgcgaaaacatgataaactcattcaacgctgctagcgattataaaattaacatacaagacatgactgcattagaaacaatactgacggacagaaaaatggcaaaaagtgtcaaagccaaacaaatagttcaactattcaaatgcataccatgcgaagacaaagaacaacaaaaatgctgcaaagcaataataactaacctaagtaaactaatagtaggacttaaaggagacatatccaaaatctttaacgagtcatttgaagaaatcaaaagttttaaatttgcggaaactaaatacgaagacgaaatacttccgacaatggaggaaatctacccagatcacgcagaaataatagagaaaattaaatcaatatacgattggagcattctcgacgaaatcctagatggagaagagtacttgagctttgccaaagttaaagcatacgaaaaacacaagaaaaatttacatgatctaaaaattctaataaagaaatactgcgatgacgaaacataccaatcctttttcaatggaatgaatgagaaaaataaatactcaaattatattggctcgatcaggaaaaacggacatacatataaagtagaaaaatgcaaaagcagcgaagacttctacaaagaactactaaaacttctatcatcagtaaaccccggacaagaagacgaatcacttctagaacaaataaaatttgaaacagagaaccaaactctcttaccactcttaagaacaaaagaaaatggaacgataccgaaccaagtacatatgcaagaattgataaaaatcctagataacgcaagcaaatatttagacttcctaaatgaaaaagatgaatacggcacaacagcagacaaaataatcagcatagccaaattcaaaataccatactatgtaggtccactaagtgacagacataaagaaaacggatcaaattcgtggatggtaaggaaagaaaacggaagaatttacccttggaactttgacgataaagtagatgcagagaaatcgaacaaagagttcatacagagaatgacgaataaatgtacctacctaattggcgaagatgtattacccaaaaattcattactatattcgagatatatggtattaaacgaactaaataacctcaaaatccgaggtaacaaaatctctgtcgaactaaaacaacaaatatataatgatcttttctgcacaaaagcaagagtgaccggcaaaaatatcttaaactacctaaagaaagaggatccagaattagcggcagaagatctatcaggcttcgacgttgactttaaatcagcactcacaagctatctagactttaagaaacaagtagtaggaaacgaaatagaaaaagattactataaagaaatcattgaggaaattatcaaatggaaaactatatataacgaagattccaaaatgatgaaacgtatgataggtagggaatatcccgaaacattaaatcaggatcaaatcaagaaaatttgccacctaaaatataacgggtggggcaacttcagtgaaacattccttaatggaataaaaggagccaataaagaaacaggagaatgctatacaataatagaagcactatggaagacgaattataacctaatgcaacttctaagcaaacaattctctttcaaagaagaaatcgaccaaattaatgcagagaaaactggagcaattggtaaaattacatacgaaaacctagtaaaagatctcgtggtatcacccgcaaacaaacgcgccatatggcaaacgattcagatcacagaagaaatcaagaaagttatgaaatgcgaaccagaacgcatttttatagaaatggcaagaggaggagaaaaagagaagaaaagaacagtctctcgtaaaacacgactccaagaattgtatacgggttgtaaagatgatacaagagattggatgaaagaaatcggcgaccgagaagaacgtgaattttcttctagaaaactatatctatattatactcagatgggaaaatgtatgtatacgggggaagaaattgacgtagaccttttaatgacagccaactccaaatgggatatagaccacatatatcctcaaagtagaataaaagacgactcatttgacaatatggtcctagttcgaaaagatatcaataacaacgttaaaggaaacaatatagtaccatcttcaatacaaaaagaaatgaccagctactggaaaatgcttctacaaaaagaattaataagtaagaagaaatatgaacgactaacgagatccacagattttacagacgaagaacttagcggattcatagaaagacaactggtcgaaactagacaatcttctaaagcagtggcagcactgttaaacagattatacaaaaatagtgaaatagtttatgtaaaggcaggcttggtttcagacttcaggcacgataacaagttactaaaatcacgtcgtataaatgattaccaccatgcaaaagacgctttcctgaacattgtagtaggaaattgttacagaacaaagttcaccgccaaccctcgacaatggatcaagaaaaacagagacacaaactacagtatcagacgagtatttgactttgatatcaagcaaggcgataaaatagtctggtatggtaataaaaacgaaaatggaaaacacaccatcgaccaaataaagaaagccatgagtaggaacgatatactttacactgaatacacatactgtgaaaaaggaaaattatttgatgaaacactaaccaagaaaggaaacaagaaagcaatccccctcaagaaaaacttagatcctttaaagtatggaggatatacttcagtaaagaccagtgcatttgcatttatagaatttgacgataagaagaaagaaaggaaaaaccacatagttgagatacccatatacgtggcaaacatcgcaaagcgagaaccagaagcagtaattaaatatctagaagaacaaaaaggttacgtaaacattgtagtcaagaaatacccaatcaagaaaaattcactattgaaaattgacggttacttagccagactaagaggcggcgatagctcaataataacactcaaaaacgcagttcaactcgtattagataagaaaagttatgaaataattagaaaagtagaaaaatatctagaccataactcaaaatacgaggcaaattctaagttggaaaaatttaacgaaaacgacctgaatattatttataatgaactatgcctaaaactaagaaattctatttatcagaaaagacctgtacatcaactagaaacattagaacaaggaattgacaacttccgatcgctcgagagcttaaaggacaaagctaagatcatcaatgaattattggccatgttcagatgtgatgcaaaaacaggaatggatcttcgattaataggaggagcaagtaattcaggacgaatgcgtatatcaaaaagcagactaacatcaaaatcattaaaacttataaaccaatctgtaacagggcttttcgaaacagaagaagaacttgtgtga

SEQ ID NO: 5358 - RNA, 4062 nt, synthetic construct
  misc_feature 1..4062: note = Cas9 variant
  source 1..4062: mol_type = other RNA
atggagaaaaattattacctaggattggatatggggacttcatcagtagggtgggccgtcacagacgaaaattacaatctaatgagaaagaaaggcaaagacttatggggagtaagattgtttaaagaagcaaaaaccagtgcagaaagaagagttaaacgaacttcacgaagaagactacaaagagaaaaagctcgtataggttatctaaaagaattatttgctgatgaaataaataaagtagatgcaggtttctatcaaagaatggaagatagcaaatttatatcagatgacaaaacggtccaccaaaaattcaccttattctccgacacaaactataccgatgaagattattacaacgattatccaacgatatttcatctacgaaagaaactaatagaaagtgacgatgaatacgacgtaagaatggtcttcctggcactgctaaacatgtataaacatcgaggacatttcttaaacgcgaacttatcagacaacgggatgggagatataaatgaacaatacgatcgtttaaaagaactttgctcagaatatctcaatgtagaatgggaaaacaaaccagataaattcgaagaaatacttaaagaatgcaactgttcaaactccctaagaaatgaaagattactagaaacatttaatctcaagaaaacagataaagaaaaatgtgaaatgctaaaactaatatgcggactatcaggaacactaagcaaaatattcaaagacctcgatgacgactcagaaaccaagaaaatgacaatcagctttaggtcctccaattatgacgaagaagcaataaatgtggaagaaatcataggcagtgaaaacttcgaaataattgcagtactaaaagaaatccatgattggtcgatgctcgcaaacataatgagaggtaagaaatatttgagcgtagcgagggtagaagaatacgaaaaacacaaagatgacctaaaaatactaaagaaagtgatcaaagaatactcaattgaagaatataataacttctttcgagttatggcagacaataactactctgcatacgttaatagcgtaaatagtaacaaagaaagcacaaggcgcggagcgaaatgcgacaacgacaccttctttaaagaaatcaagaaaatagtgaataaatgttatgattcagaagaaaaagaatatatacttaaagaaatagaaaaaggaacattcttaccaaaacaaataataagttcaaacggagtaatcccaaaccaagtccacaaaatcgaaatgaagaaaatactacagaatgctgaaaaatacttaccatttctcacagaaaaagatgactcaggcctctctgtatctgaacggatattacaaatgttttcattccaaataccgtattatattgggccaatatctggaaaaatcggaagtgacgagaaaagcaaaaacagctggtctgtacgaaaagaaaaaggaagaatctacccatggaatttcaaagataaaatagacgaaaaagaaagcgctgaaaaatttatcgaaagaatggttaatcattgtacttacttaaataacgaaatggtactacccaaaaactcacttctgtatgaaaaattcatggttcttaacgaattaaacaatttgaaaataaacaatgaaaatatttcagttgaactaaaacaaagcctatacaataacttattcaaaacaggcaagaaagttacagcaaaaggtataaaaagttacctagaaagaaacggcttatgtgagccaaacgaagacataaacttaacaggaatagatggggacttcacaaacagactcagcaattacgcaaaattcaaaggaatatttaacacagatgaactaacatatgagcaatggaatatggccgagaaaataataaaatggtcaactatatacggagattcaaagaaattcttggaagagaaaataagaaacgaatactccgaaaaattggactctcaacaaataaaacgaattttgggaataaaatttagagattggggaagactaagtgaagaactactaaacatggagggagcggatgttaacacgggggaaatcaaatcagttatcggacgcatgtgggatgagaattataacctaatggaattaatcgctacggacaatttcacctacaaacaagtaataaaagaaaaacaaaacggactagacaaaagtctatcagaaatagattatgacgacttagatgagctatatgttagtgcaccagtaaaacgaatgatctggcaaacgctactaatcataaaagagctagtcagcgtgataggttatgaaccaacaagagtcttcgtagagatggcaaaagacgtaaatacagagaagaaacgaacagatagtaggaagaagaaatttttggatttatataaacagtgtgaaaaagatgaaagagatttttggattaaagaaatcgacgataaaagcgaagctgaatttaggaagaagaaactatacctatactatacacaaaaaggaagatgcatgtacaccggagagcaaataaaccccctagacctaaccaatgacaacctctatgatatcgaccacatatacccacgacactttgtaaaagacgactcaatcgaaaataatctagtattagtcaagaaagagaaaaacgctcataaaagcgataccttccccattgaagatgacataaggaaaaaccaatacgctttctggaaaatgctatacgagaaaaacttcataacgaaggtaaagtaccaacgattaaccagaaaagaaccattctccgatgaagaaaaagccaatttcataatgagacagatcgtcgagacccgtcaaggcacgaaagtaataacagatatactagagaaaagtttcgacaaaacacaaatagtatatgttaaagcagggaacgtatcgttattcagacagaaatacgaatgtataaaatgtagagaaataaatgatttccatcacgcaaacgacgcttatttaaacatcgtagtcggaaacgtctatgatacaaaattcacaagtgatcccagaaatttcataaaagaatacaggaaaaatccccaaaagaacgaataccacatgtacaaattattcgactacaacgttcaaagaggcgaccgagttgcttggactgcatcaaacggggaaagtatgaaagtcgtcaaaggaacattaaagaaaaatacacctttagtaacatttatgtcctacgaagaacatggaggactttatgaccaaaacatcataagtgcgaaagatatagaaaaagtaaaaggaaaaggatatttgccaataaaatcgagcgactcaagattgaataatacggaaaaatacgggggatatgcaaaagtgagcggagcatatttcttcgtagttgaacacactgttaaaaacgtaagaataaggactatagaaccaatgccctgttatttgacaaaagtactaacaacaaaagaaaagatagaagactattgttgcaatattcttaaatacgatagcccagtagtcaaatacgaaaagataaaaatgtacagcctaattaaggtcaacgggtacccaatgtacctcacaggacgaacggggaaccagttaatagtatctaatggaatacaattagtgctttcatatgacgaggcgaaatacatcaaagacttactaaaaataaatcaagaggagtttgatcaaaatagattagaaaacttaggaatcaataaattccgaaacgagaaactatacgacactcttaataagaaatacacaaacgaaatctataagaaacgaccaaacagtatgggcaacaaaatgatagagtggaaaaatacgttccaaaatttatcaatcaaagaccagacagaagtacttctccaacttatccaacttggacaaaaacaaaatagcggagtgaacttagaaaaactaggcgcaagcaagaaaacaggagtcagtttggtgtcaaagaaaattactgataaagaatcattcgaacttataaacaaatcaataacaggtctatatgagaataaagttgatctactcagagtctga

SEQ ID NO: 5359 - RNA, 4062 nt, synthetic construct
  misc_feature 1..4062: note = Cas9 variant
  source 1..4062: mol_type = other RNA
atggctgccttcaagtattatctcggtctcgacatgggaacaaactcagttggctgggcagtcacagacccaaattacaacctattaaaagctaagggaaaagacctatggggaattcgagaatttaacgaagcatccactgccgtagaaagacggactcacaggatttctagaagaaggagacaaagagaacaagttagaataggtcttctaaaagactacttccatgacgccatcggagaagttgacccagacttttttcaacgattagctaattcaaaataccacttagaggacaaagatacagaagttagatacaaaaataatgtcttcaacgacgatgactacactgataaagactacttcgatcaatacccaacaatatatcacttaagaaaggaattaatcgaatcaacagataagcatgatgttagattagtcttcttagcgttgcttaatatgtttaaacatagaggacacttcttaaactcgggacttggagaaaatagtggtgaaaataatataaacaacgcttacctcgagttaactaacctactttcagaattcactcaatataatctgaacgaaactatagacggcaaaaaaatagaagacatcttaagcagaagagacatgtcacgaactcgaaaagccgaaggcttagcggaaatcttaggtgtcgactacaaaaacaaaccatacaaagaattaataaggggcctttgtggattaaaattcaacgcatgcgcaatattccctgaaatacaaagtgacgaagtacccaaattagacatatgcctgtcggaagcatcgttcgatgagaaaagcgatgaaatcgccaatatactaggggaagactatttcgaaattattatggcaatgaaagacatttacgacattggatcattagcagggataatgaaaggtcataactacctttcacaagctagggttacatcatacgaaaaacataaggaagacctaagattactcaaaaatgtcataagaaaatactgcagcaaagaagattatgataatttctttaattccgaagcagatggaagctatgcatcctatgtcggttcttacaattcaaaaacaaaacaaagacgtgtaggaaacaaaaggtccagtgaggaattatacaaagcaatcaaaaaaattctaaaaaatgtaccagcagaggacgccgacgtacaaaggatactaatgagcatcgaaaacgaaacatttttgccgaaacaattaactgcctcaaacggagttataccaaaccaagttcatgcgaaagaaataaaaaaaatattatcaaatgctgaaaggtacctacctttcctacgagaaaaagacgaaactggactatcagtaagcgaaaaaattatgaaattattctcattccaaataccatattacgttgggcctactactgaaaaatcgagcaaggacgggggaaatggctgggttgtacgtaaagaagaaggacaagtactaccttggaatatagacgaaaaaatagacatgaaagcgacatctgaagcatttatatcaagaatggttaggagatgcacatacataagtggggagccagtattaccaaagagctcactagaataccaatctttctgtgtattaaatgaaataaataacataaaaattgacggtgaacgaatatcagtagagcttaaacaagatatatacaaagaagtcttccaaaaaggcaaaagggtcacaaaaaaacaattgtgcaaatacctccacactaggggaataattgaagcggaagagcaagtaacaggaatagatgtcacaataaacaacgcactaactacttatggaaaatttaaggcaatactgggagacgacatatcaaaagacagcgtgcaaaaaatggttgaaaacatagtattttggtgcacagtatatggagactcaaaaaaatttctaaaggatcgaatagaagaaaaatatggcgaaaaattaacaaaagagcaaataaaaaggattgtggggttcaaatttaaagattggggaaacctatcaaaaaatttcttagaattaagtggagcagacgtttcaacaggtgaatctgtctccataatacgagctttatggaacaataacctcaatctcatggaattaataaatagcagactgtataactataaagaaagactcgcagaatatcaaaatacaatgatgaaaactttaagtgatatagaagcggaagatctagacgaatattatttcagtgcaccagttaaacgcatgatatggcaaactattctaataattaaagaactggttaaagtactagggtgcgaaccagataggatatttgttgaaatgacaagaagaccagatgaaagaaaaatgagaaccgaatctagaagaaagaagttcgaagaactatacaaaaaagtgaaagacgaagacgtagattggatgaaagtcatagcacatgcagacgaaacaggctcaatacgaagcaaaaaaatgtacttatacttaacacaaaaaggaagatgcatgtacacaggcaaacatattgagctaagcgatctctttaacaataatctatacgatatagaccatgtttatccgagacatttcgtaaaagatgataatattgataacaacctcgtcttagtatgtaaggaaaaaaacgcacataaatcagatatttatcccctagaagatgaaatactagcctcccaaaaaaatatgtggagcgaattaagaagatccggattcattactgaagagaaatataaccgactaataggacgcaacagtttcaccgacgaacaaaaagcaggttttatcgcaagacaactagttgagacaagtcaagggacaaaaggtgtagcaaacattctacagcaactactaccagaatctaaaattgtttatgctaaagcttcaaatgtcagtgagtttcgaaatactagggacattccaaaaagccggttaataaacgaatttcaccacgcacacgacgcatatctaaatattgtagtaggaaatgtttactatgtaaagttcacacagaatccgctaaattttataaaaaacgattacgatcgagacaaaacaaagaataattacaacttatcaaaaatgttcgattgggacgtagaaagaaatggcgaagtagcttggatagcacagaaaaaagatggcgaggcaggtacaattgcaacagtaaaaaaagtactaggaagaaacactccgttaatgaccagatactcgtttgagggtaagggaggacttacgaacgagaccctctattcagcaaaaaaagcgaaagaagaaggatacattcctttcaaatcaagcgacgaaaaaatgaaagacgtaacaaaatatggaggatttacatcggtcacaggtgcttatttttttctggtagaacatacagaaaaaaaaaaaagaagtaggatgatagaatccgtaccgctatatttagcacaaaaaatagaacaaaatccgcacgaattggaaaaatactgtgaacaagtcctagggctaatagattttgatatacgagtaagaaaaattaaaataggttccttaattaaaagaaagggatacttcttctacatcactggcaaaacaggacatagacttatattacgaaatgcagtaaacatgtgcttaaaaaaagaatgggttaaatatataagcaaactggaaaaggcggtagataagaacaatgtagaagggataatcaccaaagaaaaaaatgaactcttatattcagaattaatcgaaaaattcaaaaacagcatattcagtaacagaccaaacccagttggtgataagttagatgaagctaaagaaaaattcattaacctagacatagagaaacaatgcatcgtgctatgccaaatattacaattaagcagtgttctaggaagcgaatgcgacatgaccttgttaggagaaagtgcgcactgcggcaaaatattaatatcaaaaaaaattggtgatgaagacatctacttaattaaccaaagcgtaacagggctttatgaaaaaaagataaatttacgaactgtatga

SEQ ID NO: 5360 - RNA, 4065 nt, synthetic construct
  misc_feature 1..4065: note = Cas9 variant
  source 1..4065: mol_type = other RNA
atgaaaaaaatactcggacttgacttaggtacaaactccataggatgggccttcattaacgaagcagaaaacgaaatagaagtttcatcaattgtaaacaccggcgttcggatcgtacctttaactaccgacgaagaatcagactttaaaaaaggaaatacaatatcaataaatgctgatagaacattgaagagaggcgctaggcgaggccttcaaagattcaaacaaagaagagaagcattattagaaacatttaacagaattaaattcatagctaccgactttgtatacgctgagacaggagccgcaacaacattcagcagctaccaactaagggccaaatcagcggtagaggcagtaaccaaagaggaactcgtgaaagtcctccttatgctaaacaaaaaaaggggctataaaagttcaagaaaagcaaaaactgctgaagaaggagatgctatcgacggaatgaaaatagcaaaagaaatatttgaaaacaacctaacgcccggtcagtgggtatataattccttgtctaaaggcggaaaattcataccggacttttaccattccgacttacaaaaggaactagagaaaatagtaagattccaaaatcaattccactcagagcaaataaacgacaaattactagcagacatacaaggtaaatcacggacacaaacatcacaacatttctctaaaacacttaatataccactagcagagaacaaagggactcgtgaagaaacaaaattacagcactatcaatggagaaacgaagctcttgcaaatgaactagatatgaaaatacttgcattcataattacagaaataaacaaccagataaatcaatcaagcggatacctaggagctatttccgatcgctctaaagaactctactttaaccaagagaccgtaggtcaataccaatacaaacagttacaggaaaacgtccacgcaaaattaaaaaatcaagttttttatagacaagactatctagatgagttcgaaaagatttgggagactcaagcaaaattccatagcgaactaaatgaaaaattaaaagccgaaatacgagatattacaattttctaccaacgcaaactaaaaagccaaaaacatctcgtatcattttgcgaatttgaaaaaggccataaagctatcccaaaaagctcaccattattccaagaatttagaatatggcaaaatctcaacaacgtagtcgtgaaaaacgaaaccacaaaagaagtatttgaactcagcgaagaattgaagcaactcatcgcagaggaactccagtttaaagaatcaatgacggatgttcaaatgctgacattttgcgaactaaagaaagggacacacaccgtaaacttcaaaaaaatagaagggaatcgaacaaatacaagcatctataaagcatttgaaaaaattctagaagtagaaggatatgaaatagacttttcaaaaatgaaaccacttgaaataaaagaaactgtcgctcccatcttcgaaaccctcaacatcaacacagtaatacttgacttcgatcccacaatacagggaaacgacttcgacaaacaaccttattaccaactctggcacttgctgtatagtgcagaagacgacgacaaattaaaagaaacacttaaaaccaaattcggttttaaagagaatcacctcccatttatactcaatataaatttacaagcagattacggttcattatcggcaaaagccataaagaaaatattaccacatttaatggatggacacatatacgacaaagcttgccttatggtaggatacaatcacagttctagtttaacaacagcacaaaataatgatagagtactgaaagatacgctagaactacttaaaaaaaacagtttacgaaatccagtcgtcgaaaagatactaaatcaaatgattaacgtaataaatgcaataatgaaagacccagccatgggaaaaccagacgagatccgagtagaactcgcaagagaactgaaggctaacaacgaacaaagaaaaaaagcaacctctgatattaatacagcaacaacagaacatgaacgaatacgaaaactactacatagcgagtttaacatcccaagagtaaccagaaatgacataatcaggtataaactatggcttgaaacaggtggaatcagtctttatacaggtaaccctatcaaagcttctgacttattctctaaaaattacgacattgaacatatcataccaaaatctagattattcgacgacagtttttcaaacaaaacactatgtgaaagacaactcaacatagacaaatctaacaaaactgcatactcatttttacaggaaaaactatccgagaacgacttcgcagcatatgaaaacagagtcaaagacctatttaaaacaggcaaaataaaatcatacacaaaatacaaaaaattattaatggcagacaacgagattcccgaaggcttcattgaccgacaactccgcgaaacacaatatattgcaaaaaaagcaaaagaaattttacttgaagtatcaagaaatgtcacagctactattggatcagtaacagataaattaagacaagattgggaactagtagatgtcatgaaggaactcaactgggaaaaatatgacaaactaggattaacacacatagaagaaggtaaaaatggggaaagactgtcgaaaataaaagattggacaaaaagaaatgaccatcgacaccacgcaatggacgctataaccgtagcttttacaaagccagcatacatacaatatctaaacaatttaaatgcaaaaacacaaggagaaaacaaagccaattccataattggaatagaaaataaacatctgtatcgggacaagaacaacaaactacgattcattagcccaatgaaaaactttagagaagaagcgaaaaagcagcttgaatctatacttatatcatacaaagccaaaaacaaagtggtaaccaagaataaaaatacaactaaaaaatcgggaggaaccaaccaaaaaattcaactaacacccagaggacgactacacaaagaaacagtgtacggcaaattgcaacaatacgctacaaaggaagaaaaagtaaacgcttccttcacagaagactacatacaaaaagtagccaaaaaagaatatagagaggcactacttaagcgattggaagaaaacgataatgatccaaaaaaagcgttcacaggtaaaaacgccctaaataaaacaccaatatatataagcttgaaagacaacataatagttcccgaaaaagttaaaaccgtttggctggaaacagattacacaataagaaaagatatcacgccagacctcaaaatcgacaaagtaatagacgttggaataaaaagaatattacaaaacagacttaatgaattcaacggggatcccaaaaaggcatttgtgaacctgggcgagagcccaatttggttaaacaaagaaaaaggtattgccataaaaagagtcacaatatcaggagtctccaatgcacaagcgttacacacaaaaaaagaccacttaggcaatgaaatccttgacaaaaacggaaacccaatcccagtagacttcatatcaaccggcaataatcaccacgtggctatttacagggacgaaaaaggaaatcttcaagaagaagtagtaagtttctacgatgctgtaataagaagaaacctagggctaagtgtaattaacaaaaaccacgagaaaggatgggaatttttattctccatgaaacagaatgaattttttattttcccatcagacggattcaatccccacgaaatagatctgctcaaccccaataactaccacctaatatcccctaacatattccgtgtgcaaaaaatatcaacgaaaaactatatgtttaatcatcatctagaaacaaaagccgtcgatggcgaaatgcttaaaagcaaaaaagaactctcaaaaactagctaccattttatccaaacaccaaccaaccttaacggaatcattaaagtaaggattaatcacttaggcaagatcgtgcacctaggggagtattga

SEQ ID NO: 5361 - RNA, 4065 nt, synthetic construct
  misc_feature 1..4065: note = Cas9 variant
  source 1..4065: mol_type = other RNA
atgaagaaaatcttaggacttgacctaggaacaaattcaattggatgggcttttataaatgaagccgaaaacgaaattgaagtgtcatcaatcgtgaatacaggggttcgtatcgtacctttgacaacagacgaagaatcagacttcaagaaagggaacactatatctataaatgcagaccgtaccctgaaacgaggagcaaggcgaggcttacaacgtttcaaacaacgcagagaagcactattagaaacttttaacagaatcaaatttatagccacagactttgtctacgcagaaacaggagcagcaaccacatttagttcatatcaattaagagcaaaatctgcagtcgaagcagtaactaaagaggaattagtcaaagtactactcatgttgaacaagaaaagagggtacaaaagttccagaaaagcaaaaactgccgaagaaggcgacgctatagatggaatgaaaatagccaaagaaattttcgaaaataacctaacaccgggtcaatgggtatataatagcttatccaaaggtggaaaatttatcccagacttctaccacagcgatctacaaaaagaactcgagaaaatagttagatttcaaaatcaatttcactctgaacaaataaatgacaaactactagcagacatacaaggaaaaagccgcacgcaaacaagccaacacttcagtaaaaccttaaatatacccttggcagaaaacaaaggcacgcgtgaagaaacaaaattacagcattatcaatggcgaaacgaagcactagccaatgaactagatatgaaaatactcgcattcataatcacagagataaataaccagattaatcaaagttcgggatatcttggggccatctcagacagatcaaaagaactatacttcaatcaggaaacagtgggtcaataccaatataaacaattgcaagaaaatgttcatgcaaaattgaaaaaccaagtattttatagacaagactacctagacgagttcgagaaaatatgggaaacccaagcaaaatttcacagtgaactaaacgaaaaattaaaagcagaaataagagacatcacaatattctaccaaagaaaactcaaaagccaaaaacatctcgtatccttctgtgagttcgaaaaaggacacaaagcaattcccaaaagcagtcctctattccaagagttccgaatatggcaaaatctcaacaatgtagtagtcaaaaacgaaacaaccaaagaagtctttgaattatcagaagaattaaaacaactcattgctgaagaacttcaattcaaagaatccatgacagacgtgcaaatgctaacattctgcgaactcaagaaaggaacacacacagtcaatttcaagaaaatagaaggcaacagaacaaatacctgcatatataaagcctttgagaaaatcttagaagtcgaaggttacgaaatggactttagcaaaatgaaaccactagaaataaaagaaaccgttgcaccaatatttgaaaccctgaatataaatacagttatactcgacttcgacccatcaatacagggaaacgacttcgacaaacaaccttattatcaactatggcatttattatactcggcagaagacgatgataaactgaaagaaactctaaaaacaaaatttggttttaaagaaaatcatcttccattcttactaaacattaacttacaagcagattacgggtcactttccgctaaagcaattaaaaagatactaccccacctaatggatggccatatatacgataaagcatgcctaatggttggctacaaccattcatcaagtttaaccacagctcaaaataacgatagggtacttaaagacaccttagaactactcaagaaaaacagcctaagaaacccagtagtagagaaaatcctgaatcaaatgataaacgttatcaacgcaattatgaaagatccggctatggggaaaccagatgaaataagggtagaacttgcacgagaattaaaagcaaacaatgaacaacgaaagaaagcaacaagtgacatcaacacagccacaacagaacatgaaagaatcagaaaattacttcactcggaatttaatatcccgagagtcacacgcaatgatataattcgctacaaattatggctagaaacaggcggaatctcattatatactggaaatccaatcaaaggatcagacctattttctaaagactacgatatcgaacatataataccaaaatcacgactattcgacgacagcttctccaacaaaacactatgcgaacgtcaactaaatatagataaatctaataaaaccgcttactcgtttctacaggaaaagttatcagaaaatgacttcgcagcttacgaaaaccgagtgaaagaccttttcaagacaggaaaaataaaaagctacacaaaatacaagaaacttctaatggccgacaacgaaatacccgaaggcttcatcgaccgacaattgagagaaactcaatacattgctaagaaagcaaaagaaatactcctcgaagtaagcagaaacgtaaccgcaacaataggatcagtaaccgacaaattgcgagaagattgggaattagttgacgtaatgaaagaattaaattgggaaaaatatgataaattaggcctaacacacatagaagaaggcaaaaacggagaacgattatcaaaaatcaaagactggacaaaaagaaacgaccatagacaccacgcaatggatgccataaccgtagcattcaccaaaccagcttacatacaatacttaaacaatctaaacgcaaaaacccaaggggaaaacaaagccaattcaataataggtatcgaaaacaaacatctatacagagacaaaaataacaagctaagatttatcagccccatgaaaaattttagagaggaagcgaaaaagcaacttgagagtatactaatttcctataaagctaaaaacaaagtagtcacgaaaaacaaaaacacgacaaagaaaagcggtggaaccaaccagaaaattcaactaacaccaagaggacgattacataaagaaactgtttacgggaaactccaacaatacgcaacaaaagaggaaaaagtcaacgccagctttacagaggattacatacaaaaagtcgcaaagaaagaataccgagaagcactacttaaaaggctagaggaaaatgataatgatcctaagaaagcatttacgggcaaaaacgcgctaaacaaaacaccaatatacattagcttaaaagacaacattatcgtcccagaaaaagttaaaacagtatggttagaaactgactatacaataagaaaagacatcacacctgacttaaaaatcgataaagtcatagacgtaggaatcaaacggatcttacaaaaccgactaaacgaatttaatggtgacccaaagaaagcctttgttaacttaggcgagagcccaatttggctaaataaagaaaaaggaatcgcaataaaacgagtcacaatatccggagtaagcaatgcccaagccctacacacaaagaaagaccacttaggtaatgaaatcttagacaaaaacggcaaccccatacctgtagacttcataagcaccggaaataaccaccatgtcgcaatctaccgagatgaaaaagggaacttacaagaggaagttgtctcgttctatgacgccgtaatacgacgtaacttagaactgagtgttataaataaaaaccacgaaaaaggttgggagttcttattttccatgaaacaaaatgagttctttattttcccgtccgacggcttcaatccacatgaaatcgaccttctaaaccctaacaactaccatttaatatcaccaaacatcttcagagtccagaaaatatccaccaaaaactacatgttcaatcaccacttagaaacaaaagccgtagatggagaaatgttaaaaagtaagaaagaacttagtaaaacatcttaccattttatacaaacgccaacaaatttaaatgggataattaaagtaagaataaatcacctaggaaaaatcgttcacttaggtgaatattga

SEQ ID NO: 5362 - RNA, 4065 nt, synthetic construct
  misc_feature 1..4065: note = Cas9 variant
  source 1..4065: mol_type = other RNA
atggcagattttgcaaaatatcaaccaggtatggtcgctgacgggagaaaaattccactagactggacactgtattatctaagaaaaaaagcgctaactcaagccattagaaaagaagaactagcatggatacttctcaacttcaaccaaaaaagaggatattatcagttacgaggtgaagaagaagaagaaaattcaaccaaacatgaagaatattatgaactaaaagtagtttcggtagaggcggcagaagaaggtaaaggagggaatacatggtacaatgtaaccttagaaaatggatggatctacagaagacaatcaaaaatagaattaaacgattgggtaggtaaagtaagaccattcatagttaccacggaatacgagatagatggagtaactataaaaaaagataagaatggagaagtaaaaagaagttttagagcaccttcagaaaatgactggggcttgagaaaaaagcgtaccgaatccctattagaagaatcaggtaaaacggtaggtgctttcatatataaccacatcttatcagaaccagccgacaaaatacgaggtaacttcataagaaccatagaaagaaaattctacaaaaaagaactcgaagcaatacttcgagaacaatcgaaacatcaaaaagaattaaaagatattgatactctaatcgcttgtatcaaggaattgtatcccaataacaaaccacatcaagacagcttaatcaaaaaagacatgacatacttgttaattacagacctaatattttatcaaagaccccttaagtcgaaaaaatcgttaatagcagactgtccatacgaatattatgagtacgtaataaaagaaaccggtgaaaataaaagacaatcaataaaatgcatagctaaaagtaacccatattatcaagaatttagactatggcaattcataataaatctacgtttattcgaccgaaacaacgataaagaagtcacaagtgaatacctaagctcaatggaagactacacaagattatttacttacctaaacgatagaaaagacattaatcaagaaacactccttaaagattttttcaaacaaaaaaaagtaaaacgtggtatggaaaaagaatttcccattcgttggaattacatagaagacaaagaaaaaaaatatccctgtaatgaaacaagacatgagcttttaacagcactagggaaagtcggaatagaccactcgtggttagacgataaggaacttttttaccggttatggcacttattatattccgtagaaagcaaagaagaagccgagggagcactaagaaaattagtagacaacgatgatttcgtgaatgctttcctaaagataaaaccttttaaaaaagaatacggtgcatatagtgaaaaagctataaaaaaactattagcagtaatgcggatgggaaacttatggaacgaggtggacatatgtgaacagacaagagacagaatacagaatataatcaaaggagatatagatgaaaaaataaaagaccgaatgggcagaacatttagtcaactttcagattttcaaggactaccagaatggttagcatgctatgtcgtttatggacaacacagtgaggccacagacatacaacggtggaccaaaccggaaaatctaatggcgtacattaacggattcaaacagcactcgctaagaaatcccatcgtcgaacaatgcatcctcgaaacactacgcacagtccatgacatctggaaagaagcaggccacatagatgaaattcacattgaactaggtcgcggaatgaaatccacagctgaccaaagagcaaggatgagtaaaagcataatgcaaaacgaaaatacaaatttaagaattaaatccttactaatggaacttaaaaatgcaaaagaattcgaaaatgttcgcccatattccccaatgcaacaagaaatattgagaatatacgaagaaggagcactacaagaactgacaaaggaagacgcccagtataacgaaattagcaaaatatcacaaatggcacaaccatcagcaaatgaattgctaaaatacagactctggcttgaacaaaaatactgtagtccatacacaggaaaacccataagcctatccaaactttttactagtgcataccaaattgaacacataatcccgcaaagtcgatatttcgacgattcattcacaaataaggttatatgtgaagcagaagtcaaccaacttaagtcgaacatgttaggatacgaatttataaagaaacacgggggagagatagtccgatgtactatgattggtgacgtcaagctcttagatgccaaagaatattataacttcgtaacagagcactacaccaacaataggagaaaaaaagagaaactactcatggaggatattcctcaggaatttttaaacagacaaatgaatgacagtagatacataagcaaaaaggtaatggcaatattgagcaacatcgttagggaagaagatgaacaagaagcaaaatcgaaattcgtaatagcgtgttcgggagggataaccgataggttgaagcaagattggggtctaaacgacgtatggaattctatagtgtatccgcgatttgagcgactaaataaactgacaaacacagagaactttggtagatgggaaaacaaaaaaggaaaacaagtattccaaacaagtgtccccttggagctgcaaaaagacttttcaaaaaaacggatagaccacagacaccatgcaatggatgcacttgtaattgcctgcgccagtaacaacataataaactatcttaacaatgaaagcgcaaaatcacaagaaaaaagggaagacctacggaaaaaattgtgtgacaaaaatcgaataataagaaaaccatgggaaacattcacgcaagatgcacatacagctctagaaaatgtggtagtaagcttcaaaaactatattcgtgtaataaacaaggctactaattactatgaaaaatatgacaaaaatggtaaaaaagaaatagcagaacaaaaaggacaagatatgtgggctataagaaaacccatgcacaaagaaacagtattcggacaagtaaatcttagacgaaagatcacaataaaattaaaagatgccttagaaaaaatacctgccatatgcgataaagaattaagagactatataaacatacttgtagcaaaacaatttaacaaaaaacagatcttagcacacttcaaatccatcaactatagattaaatatgaaaagcgtcgataaagtagatgtatggcaatttagtaacgaaaaggagcccatggtcgccacaagaaaatctgtagatacaagctttgacaccaaaagaatagcgacgatcaccgataccggtatccaaaaaattcttttaaactacttaaaagcaaaaaataatgatccaaacatagcttttacaccagaaggaatcgcagaaatgaacaaacatataacagaatacaataacggcaaacaacaccaaccgatactcaaagtcagagtatcagaaccaaaaggagccaaataccaagttggagaaacaggtaacaagcgatcaaagtttgtcgaagctcaaaaaggaacaaatctttattttgccatatacgaagacaaagaaggcaatcgatcctataacacaataccacttaacgaagtgatagaaagactcaaacaaggtttgagcccagtacccgacgcaaacgagaaaagtataccattaaaatttcacttgtcccctaatgacctagtatatgtaccaaaaacagatgaggaaaatgagataaaaatgggacaaatatataaattcgtagacagcagtggtacaacagcaaactttgtcccacacagggtaagcaatctcatctacaacgtggataaaaaaattgcagaaaacttctgcaaccacgaaattattcaaaatgaatacggaatcggctcaccacaatccaaaaatcaaaaatcaattacaggagaaatgataaaagcagtatgctggaaactagaggtcgacagacttggaaatatacacaaaataataaagtga

SEQ ID NO: 5363 - RNA, 4065 nt, synthetic construct
  misc_feature 1..4065: note = Cas9 variant
  source 1..4065: mol_type = other RNA
atgaagaaaatattaggactagacttaggcacaacaagtataggttgggcatttataaaagaaccagaaaaagacgttgtaggatcagaaatagtagatatgggggtacggatagtaccactatcctccgacgaagaaaatgattttgctaaagggaacacaatttcaattaacgcagacagaacattaaaaagaggagcaagaagaaacttacaaagattcaaacaacgacgcaacgcactgctcgaaacttttaaagagaaaaatctaataccatcgaacttccaatatgctgaagatggtccaagctcaacattctcaacattaaaactgagagacaaagcagctaaagagaaaattgaactagatgactttgtaaaagtacttctccaaattaataagaaaagaggatataaaagttcaagaaaagctatgtcagaagaagacgaaggtacagcaatcgactcaatgggaatagccaaagaattatacgaaaatgatttaacgccaggacaatgggtgtatgaagcactcaaaaacggacgcaaaaacgtacctgatttttatcgatcagaccttcaagaagaatttaagaaaatagtaaattatcaaagcgaattttaccctgatatactcaacacatctttcgtagaagattggatgggaaaagcatcgaccccaacaaaacaatacttcaacaaaagaggtgtacaattagcagaaaataaaggtaaaagagaagaaagacgactccaagaatacaaatggagagcagaagcagtaaactttaaaattgacttatcagaaatagcactcatactctcccaaataaactcgcaaatatccaattcttcaggttacttaggagcaatatcagaccgttctaaagaattatactttaaaaatctaacggtcggacaatacttgtaccaacaagtcaagaaaaaccctcatacacgactcaaaggtcaagtcttttatagacaagactacctagacgaatttgagaaaatatggtctgtacaaagcagtttttacccacaattaaacgatgaactaaaacaagaagttagagacgtcactatcttctttcaacgtagacttaaatcccaaaaacatcttataagtaattgtgaatttgaagaacaccataaagtcgtaccaaaaagtcacccaatatttcaagaatttcgcatatggcaaaatctaaacaacctcactctaatcaagaaagacaacctaaatgaaaaatgcgaattagcactagaagataaaacagcactcgcgaacgaactagctttcaagaaagaactatccgttaaagatgccttaaaagtactagggctaaaaccgtccgactgggaatttaattttacaaaaattgaaggaaatagaaccaatcacgcattcttcgaagcctttgctaaaataatagaattggaagatggtgaaccaatagacctaggaaatctcaaagcggatgacatactagatcaattctctgaagcgttcctacgtataggcatagatactgaactattacaagtcaacagtgacatcgaaggagcagaatatgaaaaacaatcatatatacaattttggcacctattgtatagtagcgaagacgatcaaaaattaaaacaaaacttaataaggaaattcggctttaaaccggaacacgccaaaatattagcttcaatttcactccaggacgatcatgcctcactaagtagtagagcgatcaaaaagatacttccacacctccaaagcggattaatttatgataaagcctgcacgtatgcaggatataatcacagcagcagttttactaaagacgaaaacgagaaaagagaactaagagcagaactagaattactaaagaaaaatagcctgagaaatccagttgtagagaaaattttaaaccaaatgataaacgtagtaaacgccatactaaaagatccaaatctagggagacctgacgaaattagagtagaaatggccagggaactaaaagccaatgcagaacaaaggaaaaatatgacgagcaacattgcgagtgcaaccagagatcatgaaaaatacagagagatattaaagaaagaatttggtctaaagcgcgtaaccaaaaacgaccttctacgctacaaactttggctagaaactgacgggatcagtctctatacaggaaaaccaatagaagcatcgaaactctttagcaaagaatatgacatagagcacattatccctaaagcacgattatttgacgattcgttctcaaacaaaacaatatgcgaaaggcagttaaatatagataaagcgaacgtaaccgccttcagcttcttgcaaaataaactctctgcagacgagttcgagcagtatcaatcaagagtcaagagcctctacggaaaactgtccaaagccaagatacaaaaactcctgatggcaaatgataaaattccagaagactttatagcacgccagttacaggaaaccagatatatctcaaagaaagctaaagagatattattcgaaataactatgagagtaagtgtaacaacaggaacaatcaccgacaaattacgagaagactggggcctagtagaaataatgaaagaacttaattgggaaaaatacgacaaactaggactaacctatactattgaaggcaaacatggcgaaagattgaataaaataaaagactggaacaaaagaaatgaccacagacatcacgctatggatgcattaactgtagcattaaccaaacctgcatacattcaatacttaaacaacttaaacgccaaagcaattggaaataagaaaggtacagaaatattcgcgattgagcaaaaatatcttaaacgagaaaacggcaaattatgctttattcctcccatagaaaatataagggcagaagcgaagaaacatttgtccaaaatcctcgtatcatacaaagctaagaataaagtagttacaataaataaaaacaaaaccaagaaaaaggcaggtttcaacgagcaaactgctttgacaccaagagggcaattacacaaagaaacggtatacggaaagagcttccactactcaaccaaattcgagaaaataggagcatcatttgacgcacagaaaataaacactgtagcaaagaaagaagaacgagaggctttactgaaacgcctagcggaaaacggaaacgatcccaagaaagcatttacaggcaaaaacagcttaaataagatgcccatatacttggacttaggaaagaatattaaactaagcgaaaaggtaaaaacagtggtactagaacaaaactatacgattaggaaaaacatagacccggatctaaaagtagataaggtaatcgacgtagggataaaacgaatcctcgagtcaagactagaggaatttggaggaaacgcaaaattagcattcagcaatctagaagaaaatccaatttggctaaacaaagaaaaaggaatacccattaagagagtgaaaatttcaggggtatcaaatgtagaaagtttacatgtcaagaaagatcatttcggagagaaaatactagacgaagaaggaaacgaaatacctgtagacttcgttagcacaggaaataaccatcacgtagctatatatgaagacgaagatgggaacctacaagacgaagtagtaaacttttatgaagctgtaatccgaagaaatcaaggtgaatcaattataaaatacagacacgaagaaggttggaatttcctatactcaataaaacaaaatgagttcttcgtctttcccagtcaggacttcaacccaaatgacttcgaccttctcgaccctaagaactatgacttaataagccctaacttgtaccgagcccaaaagttcagtaaggtcatgtacggaaactcagctgtaagagattacgtatttcgccatcatcttgaaacagtactaaacgacgtaaaagaattaaaggatgttgcttataaacaattaaaaagcctgcaatatcttaatggtattaagaaagtaagactcaatcatcttggtcaaataatccaagtaggagaatactga

SEQ ID NO: 5364 - RNA, 4065 nt, synthetic construct
  misc_feature 1..4065: note = Cas9 variant
  source 1..4065: mol_type = other RNA
atgactctccattataacgtaggtctagatatcggaacaaatagtgtaggctatacaattgttgatgacaatggaaaaatactacaagtcaaaggcaaaaacggctatggagtacgcgtatttaaagaaggcgcaactgcagctgaacgcaggattttccgaacgacacaccgcagattaaaacgtcgaaaatggagactgcgcttactacaagactttttcgaaccatacatattaccacaagatgatggattcttcatacgcagaaaagagagcaatctagtactaaacgatcgtgatgaagatacggcctcgttattcaatgacagatcagacagagatttctatcaagcatatccaaccatctaccatctaagacaagcactaatgacagaaaaacgtcaatttgatgtacgcgaaatatatctagccatgcaccacataatcaaatatagaggccacttcttattaaatggaaccgttaacaatttcactaacaacaaaatagatctccacagtgatttcgaagagctcaatgcgctactcctcaacgttataccagaattaaaattccaaatagacctagaccactcaactatgttccaaacaaccctactaaatacaacaattagcaggtcgggacgacaacgagatttagttaaatcattttataacggaagtgatgataaacagttagccaaacagcaaaaatcagtagccaccgaactcctaaaagcaatactcggactaaaagcaaaatttcataaactttttaatctagacttattagagaccacagaatgggaattctcattcgacgctgaagacatagatgacaaattagctaaactggaacctttaatgactgagaaccaacaacaagtaatggacatacttcaaagaatattcgccgcaattaccttaaacgggattgtgccagaaggtaagacactatcagcaagcaaagtagactcatatcagaaacataagcaagacctaaaattactaaaagcaatcgctcaacattctgataaaaaaactgctaccgttctacagacagcctataacgaatacattaacggaatagcttcgaaacccctaaaacaagaagatttttacaaacgactaacaaacgcagtcaaaaaatcaagcgaccctcaagtagcagacatgctcgctctcatagaccaggaaaaattcctaccaaaacaacgaactaaagaaaacggagccattcctcaccaactgcaccaactagaactggaaaggataatagacaaccaaaaagattactatccctggttagccgaacttaatcccaaccaagctcggcaaaaagtagcgaaatacaaactaagcgaactagtagcatttagagtaccctattacgtcggacctttaattgaaccagaagtacaacaagccaccagtaacgcacacttcgcatggatggctcgtaaggaagccggacctataacaccttggaattttgaccaaaaggtagatcgtaacgttagtgctgaaagattcataaaacgcatgactacaaaagacacatacctcttagctgaagatgtcctaccgctacattccctattatatcaaagattcatagtactaaacgaattaaacaacgtccgagtcaatggccaaaaattaacaaaaaaacaaaaacaagccgtttaccaagatctattcaaacgacaacctcacgtaacaaaaaaacaatttaaaagctacttagttcaaaccggggaattcgcagaatccagtaaaattgaaggcctagcaaacgaaacctcttttaattctggcctaacgaccgagaatgaactccgtaaaatatttggagcacaattagacgaagcaagataccaagtcgactttgaacaaataatagaatgggcaacacttttcgaagacgctaaaatcctaagaaccaaactagccgaaatcacatggttgaccaccgaacaaattgaaaaacttgcgggaatacgatatcgaggctggggtagattttccagaaaacttctagccggactacgagatcaaaacggacaacaaataatagacctattatgggatacaccaaacaacttcatggtcatagtgtcacaagcagccttctctgaagccataacaaaagaaaatgaaaaactaattgatcgccgcggagcgcaagacgttatcacagatttgtatacatcaccacaaaacaaaaaagctctacggcaagtgctagctattgtagcagacgttcaaaaagctatgggaggagtgcctcctcaaagaatttttatagaattcgctagagaagacgaaaaaaacccccgacgatctgtagaacgctcaagacaattggaaaaactctaccaaactatatccaacgaattcctcattaattctgaagtgagacaagaacttaaagaagcagtagatcaaaaagtcaatttcaaagacagactattcctatatttcttacagggcggagtggacttatactcaggaaaaaggataaatattgatcaactatcacattatgatatagatcacatactaccacaatcattcattaaagacgatagcctagacaaccgtgtactcgtttcacaaaaactaaaccgtagcaaaagcgattccgtgcccttatctgaatttgcgaactataagttcggaccggccatgcaagccaaatggcttcaacttaaagaagcaggtctcctcagcaaacggaaatatgacaacctcactttagatccaacaaaactatcaaaattcgcacctctcggatttgtaaaccggcaattagttgaaactagacaagtaatcaagttagccgccaatttactcgcatccgaagaaacaaaagtagtaacaattaaagccaatatgacacaccaggtacgaaaagaactagattttcctaaaaatcgcaacgtcaataattaccaccacgcattcgacgcctaccttaccgcattcgtcggaatatttctatcaaaaaggtaccccaaattaaaaccatattttacttacggcgacttccaaaaaggaaacaaacttcctgacctaaaaaattttaatttcctatatgaacttaaaaataaagaccgtagcattgactctaatacaggcgaaatcatctgggacaagcaacgcgacctcgcctatatgaataagatatacaactttaaaaaagtaacggtagtccacgaggtgttaacgaaatcaggagcattatacaaccaaacactatataaagcttcagaagacaaagccagtggaagaggtacaaaacaacttataagaaaaaaagacaatatgccaaccgaactgtacgggggatatacaggttccacctctgctttcatgtccatcgtaagactatggaaaaaagacaaaccctactacaaagtcgtaggaattcctacacgaatggcagccaagttagcaaatcaagcacaactattagattacttaacaaaaaaatttacaacacgaaaactagtaaaaaaaacaggtgactataaaacaaccgtagaacggttcgaacttgtagttcctaaagttggttttaatcagctcgttatcgacggaggtcaacctttcatgcttgggtcagcaacataccaatacaacgcaagagaactatttatatccaaagaagcagttaaagcactaaacaaacaactctccacccacgttgacctagttcaagtatttgatgaaatactcgtccaagttaaccgctggtttcccctatacgatacaaatggatttcgcgaaaaactgtcacacggcagagacagattcatgaaactgaatgactcatttgaagaaaaatcagacacacaaatagatgtactcaacagaatcctcataggattccacgccaacgccgccagaacaaacctcaaaatattaggtctaggaacagacctaggattcatgacgcaacaggctggcattcgcctaaccgaaaaagcaatcctcgtacatcaaagtcctagcggactattcgaacgcaaagtagcactaagagacttaaaaggcctaaggtga

SEQ ID NO: 5365 - RNA, 4068 nt, synthetic construct
  misc_feature 1..4068: note = Cas9 variant
  source 1..4068: mol_type = other RNA
atgacctactccatcggcctagacataggaactggaagcgttgggtgggctgttataggagacgactacagactcaaaagagctaaaggcaaaaacttaattggagtacgattatttgactctgcaactaccgctgctgagcgaagaggatacagaaccactcgcagaagattatcaaggcgacattggcgcctaagactacttaacgacatattcgcgagcgatctcgccgaacaagatgaaaatttcctcccaaggttaaaatacagctgggtaaacccagatgacgagcaaaacccccaactgaactcagacgtcgcaaatggagcactctttggatcgtcagagactgacaaggcttttcacaaaaattatcctactatttatcatttaagacacgaacttatgacagacactgcgaaacatgatctgagagaagtctacttagcaattcaccacatagttaaatacaggggaaactttttaaataccgctgacaaaataaatgcagaaaacagctttaatgtagaccttttcatcgctgcattagatgaatacaacgaatttcttgaaacccccataactagcataaaagacgctcagctattctcagacaaactgacagatataaatgcaaggaacaaaagcgtgagagtcgaaaatgctatgtcagaaacatatgacgacaaaagcaaaatattcaaggcgatacttacagccctagtgggaaatacagctaactttcaaacgatattcgacctttcagacctagaaaaagacgaagctaaaaatttcaaattcaaactcgacttagaagacgtagaaacgaaactcgacgtagtaagggcaaaattatccgatgaacaaaacgcattcttagaagcagtattgatagcatacgatggaataacactaaaaatgatactaggcgactacaaatcaatatcccagtccatgattgaatcgtacaaaagccaccaacgtgattggaaatatattaaaaataacgtgagactaaacgaacaaaagatagaacccgacaaaaacagtgtaaaattcttcaaattagaccccaagaaactaatatatccatccaatctagcatatctccaagtaatatcctcaaatgaagatgaacatagaaaaggattagactactttaaaacagcaatacaagacgcagatatcctacaacgaatagaaaacgacacattcctccctagacaacgaacgaagcgaaacggagttttaccataccagttacacctcgcagaacttgaacagatcatcaaaaagcaatcaaaatactatccttttctcgcaaacatatacacacaagacaataaaacagaaaataaactaataggtctattgaaattcagagtgccgtattatgtcggaccactcgtggaggcagaaaaagtaacaggagatggcaaaaatcattggcttatcaaaaaggaactacaagaaaatacccccataacaccattcaattttgatgatgttgtagataaagataaaagtggagaacaatttataaaaagaataacaggcacggatagttacctaataggcgaaccgaccctaccagagaacagtctcctctaccaaaaatacaacgtactacaagaactaaacaatgtcagaaacgaaagacaccaacgactgccaataaaagtaaaacaagacatatttgaacatgtcttcaaaatagacaaaaacgtaaacgcaaagaaagtaatggcatacttaaaattaaatggctatggcgacttccaaattgccggtctttcagacactcgaaccgggaaatttaattccaacctatcgtcctataactactttgttgatttattaggaagagaaaagacagagaaaataagagaagataggttagaagaaataatcgaaatacaaacagttttcgaagacaaaatacttgtcgccaaacgactaagcaacctagacttcctcacaccccaagagaaaagcaaacttagcgctaaacactacaccggttggggtagactaagccaaaaattattaaccacacaattcataaaaacagctttaagcgaagcaggagacatcattccacaatcacactccataatagacttattatattacacagataaaaatttaatggaaatactaaacgataaaacattcaatgtcagaaattggttaaccgaacaaaacaaaggcacggaatcaggaaatagtctatacgatcagatagacgcattagctggacccaaagacattaaaagaggaataacgcaagtattttccattattgatgacataaagaaagcaatgggtagtaatccagaaactgtatacttggaatttgctagagaaacacaaacatcacgcttaacaaatagccgattaaaccgtgtacaagaaatatacaattcaccagaactaaaaacagagttcgcatatctagcaaagaaattagaagctgaaaccaaagaaagcattcatgatgaccgcctatatttatattatttacaagaaggacgtgacatgtataccggaaaagaaatacctttcgatcaaatctcatcaaactatgacatagatcacataataccccaggcattcacaaaagacgattcattagacaatcgagtgttagtaaacagagcaaccaatgcccgaaaaagcaactcaccaacattcacaaatgatataatagacaacaggaaatcttggtggcaatcactcgtaaaaaggggtttaatgtcgaaagagaaatttgaaagattaacggataaaagaaaaaccttctccgaaaaccaaacaaaccacttcattgcaagacagctagtggaaactcgccaaatcatcaaaaacgtagctgatctaatcaaaaataattacgatggaacacaagccgttgcaatacgagcttcattaacgggcgaaatgagacgatatctagactggcctaaaaatcgggacatgaatgactaccaccatgcgcatgacgcacttatgatggcaacagttgggaaatacgtagatagacgcggattcttcgacaatggatcagtttcagacggagcaggcaatgcatataacctctacactaaagattggttagtagcagcgagagtaggcacaagaaacgattctcaacgagtaaatccatacggatttatagtaggatcaatgaactcaaaagcagtaagacaacaagtcaacaaagaaactggagaaatagtatgggggaatgaaaacctagattacttacgacacgtattaagctacaagaaaatactcgtcactcgacgtttatcaggatcttcgggacgtttatacgcagaaacactatttagtccaaacccaaaagcgaaactgatagcacaaaaagcaaacaggtcagtagctctttacggaggatttactaaggctgaaagcgcatacacggccctagtagaatttaacaaaaagggagaccgatcatacaaactgatcaaagtaccaatggcaatcgcaaacagagtgaatgacaaacaaatcacagtaacagcatatattgcatcacttaacttaagggacttcagtagggtagtactagaacacttgccattaggtacactcatccgagaatctgacggaagcgaattttacgcagcatcatccgaatataaacacaatgcaaaagagctttgggctcccaaagaaattctacgttccagcaagaaattagacaaagccaccgcggacaatttaatcgacatttttgattttctgactaacgataaaacaatctcaaattttaaattctacgaaaaagatcttcttcatctcaaaaacgtaagagataaattcgtagaggcttcagacgaaatcaaaattaaagtactatcagatgttatttatgaattgcacaatgatgccggatggagagacccattcaaacacatacaagaaaaaccggcctggactatgctccaagtcaaaggtggaataaaactttcagaaaaagccgcaatagtctaccaatcacccacggggttattcgaaactataacaatagtgggggaatga

SEQ ID NO: 5366 - RNA, 4071 nt, synthetic construct
  misc_feature 1..4071: note = Cas9 variant
  source 1..4071: mol_type = other RNA
atgaaaaaatttgaagaatactacattggtcttgacatgggaacaggaagcgtaggttgggctgtaacagactcagcttacaacatcatcaaaagacacggaaaagcactatggggaattcgtctatttgaatctgccaagacagctgaagaaagaagaatatttcgaacaagccgtagaaggacagaaagacgaaaaaaccgcttacatttattgcaagaaatttttgcagaagaaattagtaagaaagacatgggcttttatcaaagaatgaaggaaagtaaatattggcacgaggataaaaaagacataaatggaaacatgcctgaacttccatacgccctctttgcagatgatggttttacagacaaagattattataaaaaatatccaacaatttttcatctcagatatgctctcgcaacaaacacaacagataaacctgacatcagactcttataccttgccttacatcatataataaagcacaggggtcacttcttatttgaaggaaaaaaattaagcgaggtgaaagaattttctacagcaatagaagctctagtacaacaagcggaagaacaagaaattgacctaaagagcctaacccaagaagaagtgctaacacaattagaacatataatgagtgatgctcaatgtacaaaatcagataaaaaaacacaggtaagtaaacttattgtaggaacagataaacagaaacaaaaacaagagaaagcaatagctgcattaattacaggctgtacagtaaaattatcagatatatttgccgacccagaacttgataaagaagaaatctcaaaaatatgtttttcagataacggatacgaagaaaaggaagttgaaatagaatcagtactagcagacagattccttcttatagctgccgccaagggagtctatgactggacggtattacatgacattctaggggacgctcgatttttgtcagaagcaaaagtaaaaacctatgaaaaacacagagatgatctaagaaaagtgaaacaactactaagaatggataaagaagtgtacgaggccgttttcggtgtatcagaaaaaaatgaagctaattacagcgcatatattggaatggctaagaaaaatggcaaaaaacaacctatagaaaaaaagtgcagccaagaagatttttacaaattccttaaaaagcaattagaccgtctaagtgttgatgaaatgggacaggaaataattgatgaacttaaagcggaaatggatttgggtacgctatttccgaaacaaatgatacgcgataacggagtaataccttaccaattacatgaaaacgaactcaacgccatactagacaatgcacagaaattctatccattcttgttagaaaaagatcaggatgggtacacaccagtagaaaaaatacaaaaaatctttaggtttagaataccttattacgtaggaccactgaatacagcacaccaagataaaggaggacacagctggagtgttcgtaagaaagaaggcaaaatatacccttggaattttagcgagatgatcgatgaagaagaatcagcaacaaaattcattgaaagaatgactaataagtgtacatatttaataggagaagacgtcttaccaaaggaatctttattgtatgcaaaattcaatgtactaaacgaactaaataatctaagaatagacggcgaattgatcgctcctgaattaaaacaggacatttataacaatgtatttaaaaaataccaaagggtaacgggcaaaaaagtaaaagactacttaagaataaatggtgtcatatcaaaagaacaagagctaagcggatttgatcaaaactttaaatctagtttaaaagcttatcacgacttcaagcagatagtaggaacaggcgtcctcagcgaatctgaacaagaagatattgtacgcgacataaccctcttcgcagatagtcaaaaaatgctaaaacaacgaattcacagaaagtaccccatgttgtccgacaaacaaattgcacaattagcgaacaaaaaatacgcaggatgggggaggctctctcgaacattcttagaaaatatagaaagcgtgaacaaggaaacgggagaagtcatgaatattattacagcgttatgggagactaacgaaaacttaatgaaattacttagtggaaaatatgattatactaaacaaatcgaacaatggaatgcgaggcaaatgaaaaaaggggaaatagaataccaagatatagaagagttatatgtatcacccgcagtcaaaagacctatatggcaaacaataaagattgtgcgagaaattacaaatataatgggaggagcaccaaaacgaatcttcgttgaagtggctagagaaccaggagaaaaaggagtccgtaaagtaagtagaagaaaccaacttctagatctatacaaagcatgcaaaaaagaagcacccgaattgtacgatagacttgccaataaggaatctgataatgcattaagatcagataaattgttcctatattattctcaaatgggaaggtgtatgtactcaggtgatgctatagatttggacgaactgtttaccaatcgatatgatattgaccatatatacccacaatctaaagtgatggatgatagtattgataatagggtactagtaaaacgcgacttaaatagtaaaaaaacagacaccttccccgtctcagaggaatacaggaaagctggtaaagcattatggagcactctactaaaaaaaggtctaatttccaaagagaaatataaacgactaacaagaaccgaacctttcggtgaagacgaactagcaggtttcattgcaagacaactcgtagaaacacgtcaatccacaaaagccgtcgcacacttactagaagaagcatatcctgatgcagaaatagtttatgctaaagcccgcgcagtttcagaattcagacataaatttgatatgataaaagtaagagaggtaaacgatttccatcatgctaaggatgcctaccttaacatagttgtaggaaacacatactacgttaagtttacgaaagatgcagcctggttcgtaagaaacaatccaggacgcacttacaatttaaaaaagatgttcgagaacgaaaccgtcaagcggggaaatgaaactgcatggatacccggagataatggaacgatctgtacagtaaaaaaatggatgcgaaaaaataatgtattatttactcggagagcttatgaagtcaaaggaggtctatttgaccaaaacatcctgaaaaagggaaaaggtcaaatacccattaaaggaggtgctgatgaaagattaagaagcagagacaaatacggagcttacaataaagcctcaggcgcatatttcatgttagtcgaaagcgacggcaaaaaaggtgaacgaaaacgaacaatagaattcgtccccgtatacctagctaaatccctcgaagaatccgtagaactaagaagaaggtactgtgaagaagaactaggactagtaaatccggatgtgcgtctaagcaaaataaggaaaaatgcactcatagacgtagacggtttcaaaatgcacctagtcggtaggactgaaaataggttattactaataggtgcgacacaactagtgctcagcgaagatgaccaacaattaatcaaaaaaattggaaaatactgcctagaccatcgagagaacaaagatgcagtattaagtgaaaaatacgaactgactatggacctcttcgaaaaactttatgatatatttgtatttaaactagaacaaacagtgtatgcagtcaaattgagcaaacaagccaaagacttaaaagaagtaaaagaagaattcttagcactggatgatgaacaaaaatgcttattattgatggaaatactgcatttatttcaatgttcaccacaactagcgaatctgacaaatataggtggagggaaaagcgcaggatcactaaaaatcctctccgatataacaaaacaacaatcagtacttttaataaaccaaagtataacaggattttatgaacaagtcatagacttaaaaactatatga

SEQ ID NO: 5367 - RNA, 4071 nt, synthetic construct
  misc_feature 1..4071: note = Cas9 variant
  source 1..4071: mol_type = other RNA
atggaagtcggaaactattatttaggaattgatgcaggaacagacagtgttggctgggccgttacagataatcaatacaatgtgataagaaagaaagggaaatcactatggggtataagactatttgatggcgctaatactgcccaagaaagaagaacattccgcgcactacgacgacgtaacgaacgaaagaaacaaagaattaatttattgcaagaactattctgtaaagaaatatgcaaactagaccccaatttctttataaggctcagagactcatccctatggtccgaagataaagaagaaaaacaaatatattccctatttaacgataaaaactttaatgaccgcaattatcataataactacaaaactatctaccacctaagagcagacctaattaaaaacaaagaaaaacacgatgcacgcttagtgtacttagcaattcatcatataatgaaaaaccgcggtcactttttgtttaatggaaacatcgaatccgtcacctcatttgaaaatacattcaacgaatttaaaaactgtctacttgatgaacttgaaataaacttagagtgtccatcaatatctgagttcgaaaacatcctaaaagatagaacattcaaaggcactcaaaaatgtaagaaactaaaagaactttgctcgattccaagttcagataagaaattagataacatcttcaaattaatttcaggactaaaagctgatttatcaataatctttgaagacgagtctttcaaagaaaacgaacataacaaaatatcattcgcagacagtaactatgaagaaaccagggaagtattaaatagtgaaatacaagagaaaacactgataatagacatatttaatagtatatacaactgggtaatattatctgatatactatccggtggtgaatataacggtggactatacttaagcatagctaaagtaaatacctacaataaacacagtaaagacctcaaaatattgaaaagcgttatcaagaaatacttccctcaaaaatacacagacatcttcgcctcaaataaagaaaataactactgtagctacataggcatgtacaaatcgggaggtaagaaatattcagtcaagaaatgctcagacaaaccagaagagttctataaaactatcaaaaacataataaataaaaatacagcagaagaaatatcaaatgacaaagatgtacaatacattctgtcagaaatagaaaacaactcatttctacctttacaaataaataaaaacaacggagtcataccatatcaagcaaataaaatcgaactagaaagcatactcaaaaacgcagaaaactatctacctttcctgaaagaaattgataccgaatgtaacaaaaccacatcagagaaaataatagatttattcgagttcaggattccatattacgtaggaccccttaacacttcaaaaggtgaaaacgcatggatgataagaaaagaagatggaacaatccgaccgtggaacttcgaacaaaaagtagacatagacaaaacggccgctgaatttattacaagaatgacgaaccaatgcacatacttaaataatgaaacagtattaccaaaatattcactcttatattctgaatacacggtcttaaatgaaatcaataacatccgtattaacggagagaaaatttcagtagaacttaaacaagacatattcaacatattgtttaaaaataacaaacaagtaacctgcaagaaattgctgtcacatctaaattcaaacgggtacaacttaaagaaagatgatctctcggggttcgacgggaactttaaatcatcgctaagtagctacatagatctgaaaaactatatcttcggagacaacatagacaaacctcaaatatacaatctcgccgagaaaatcatcctctggataacattatatggagatgactcaaaactactaaaacgggttttacagaaaaattgtagcgaacaacttaaccccgaacaaatcaagaaaataaccaaattaaaattcaaaggatggggaagattatcaaaagcattcctaagtgaattacgaggggcagatagagaaaccggagaaacaatgactataataaaaggcctcagaaacactcaaaacaacctaatgcaacttctatcacaaaactacaccttcacagaagaatgcgagaaaataaattcagggtacttcattaatccaaacgaaatctcatacgattccatagttaaaaacatagtagcaagcccatcaataaaacgaagtgtctggcaaacaatacaaatcgtcgaagaaatacaaaaagtaatgggatcaaaaccacgaaaaatattcgtagaaatggcacgaggagaagaagaaaaagtccgaacaacgtcaaggaaacaaaaactacttgacctatacaaaaatatatctgacgaatgcgccaaaggaatgtacgacgaaatatattcaaaagacgaatccgacttcaaaaacattagattatacctatactatacacaaatgggatgttgtatgtatagcggaaaacatattgacttaagtcaattatccaacacaaatatttgggatcgagaccatatatacccacagtcaaaaactaaagacgacagcctagataacctagtactcgtatacaaatcgataaattctgagaaatcagacgatataatatcccctacaatccaaaataacatgagaaccttttggaaactcttattcgacagaaaatttataagcgaaaagaaataccacagactaacaagaacaacaccactaaccgacgaagaattagccggattcataaatcgacagctagtcgaaacaagacaatcaactaaagtaatggccagtatatttaaaagaatttaccctaacacagaaatcatctatgttaaagccaaaaacgtctcagactttagacatcgaaaagactgcgaaaacggcgttaaagttagagagttaaacgattaccatcacgcaaaagacgcatacttaaacatagtagtaggaaatgtttatagcagtaaatttaccaataacccgctaatgtggctcaaaaataatcgaaacgtcaaatatagcctaaacagaatgtacgacttcaacctcacagtaaacaatgaaaacatatgggtagtaggtaacgagggcacccagaaaacggtaaataaatatctaggcaaaaacgatatactatatacacgttatgcaatgaccaacaagggtgaattattcgatcaaaacccactcaaagcaaccggagacaaatccaaacaaaccaccttagtacctctcaagaaaggcaaagaagtatggaagtacggaggttacaactctataaccccaagctatttcatgcttgtagaaagtaaagacaagaaaggcaattatatcagaaccattgaaaccatgccactctacagagagaaagagttcagcaaaaacgaagagttccttctaaattattgcaaagaagtacacaagctaaaagagcccaaaatcatcctcaaatgcataaagaaaaatgcgctactgatagttgatggatttccaatgcacctgaaaggatcaactgggttacaactaaaactgcaaggcgccgtacaactaatccttgagtcagatatggtgatatacctcaagaaactaatgaagtttgtgaatgaaaataacataaacaaaaataaactagaagtaacaccatatatggaactatccgcaaaagaaaacattaaactatacgacatattcatccaaaaactaactacaggcatctatagtaaaagacccgccaacccagtagaaaaactaattaacgcacgagacatttttatagaattaaccgtaaaagaacaatgcatcgtactaagtgaaattctacaccttttccaatgcaaacctttaacctcagcaaacttagtatcaataaacctcaagaaaacagtgggaataatacaaatagccaaaaatatcacagccaaaaatgtaaaacttgtgcaccaatcaccaacaggaatatatgaatatacagtagacttaaacaaaatttga

SEQ ID NO: 5368 - RNA, 4071 nt, synthetic construct
  misc_feature 1..4071: note = Cas9 variant
  source 1..4071: mol_type = other RNA
atgacaaaaaaggaacaaccatacaacataggactcgatattgggacctcttcagtaggttgggcagtcaccaacgacaactatgacctcctcaatataaaaaaaaaaaatctatggggcgtaaggttattcgaagaagcacaaaccgctaaagaaaccagattaaatagaagcactagacgccgataccgaagaagaaaaaacagaattaattggttaaatgaaatattttcggaagaactagcaaaaaccgatccttccttcctcattagactacaaaactcatgggtaagtaaaaaagatccagatcgaaaaagagacaaatataacctattcatagacggcccatataccgataaagaatactatcgagaatttccaaccatcttccacctacgaaaagaactaatacttaataaagacaaagctgatatacgactcatctacctggcactccacaacatactaaaatacagaggaaactttacatacgagcatcaaaaattcaacatatctaatctaaacaataacctatcgaaagaattaatcgaactaaaccagcaattaattaaatacgatatctccttcccggatgactgcgactggaaccacatatccgacatattaataggacgcggcaatgccacccaaaaatcatcaaacatcttaaaagatttcacactggacaaagaaacaaaaaaattactaaaagaggtgataaacttaatccttggaaatgtcgcacatctaaacacaatctttaagacatccctaacgaaagatgaagagaaacttaacttttccggaaaagacatcgaatcaaaactcgacgatctagactcaatcctagatgatgatcaattcacagtcctagatgctgccaatcgtatatattcaacaatcacattaaatgaaattctaaacggggaaagctatttcagcatggctaaggttaaccaatacgaaaaccacgcaattgacctatgcaaacttcgagatatgtggcacactacaaagaacgaagaagcagtagaacaatcaagacaagcatatgacgattacataaataagcccaaatacggtactaaggaattgtacacaagtctaaaaaaatttcttaaagtggctttgccaaccaatttagcaaaagaagcggaagaaaaaataagcaaagggacatacttagtcaaaccacgtaattccgaaaatggagtagtgccatatcaacttaacaaaatagaaatggaaaaaatcattgacaatcaaagccaatactacccgtttttgaaagaaaataaagaaaaacttctatcaattctatcattcagaattccatactacgtcggaccactacagtcagccgaaaaaaatcccttcgcctggatggaacgaaaatcaaacggccatgctcggccctggaactttgacgaaatagtagacagagaaaaatcatcaaacaaatttatccgaagaatgacagtaacagattcttacttagtcggtgaaccagtcctccccaaaaattctctaatctatcaacgttatgaggttttaaacgaactcaacaacatcagaataacagaaaacctaaaaacaaaccctataggttcacgactaactgtggaaactaaacaaagaatttacaatgaactcttcaaaaaatataaaaaagtaactgttaaaaagctaacaaaatggttgatcgcacaaggctactacaaaaaccccattctcataggactatcccaaaaggacgaattcaattcgacacttaccacatacttagacatgaaaaaaatttttggcagttccttcatggaagacaacaaaaactacgatcaaatcgaagaactaattgaatggctaaccatattcgaagataaacaaatactaaacgaaaaactacactcaagtaaatattcctacacccccgatcaaataaaaaaaatatctaatatgagatacaaaggctggggtagattatccaaaaaaatactaatggacatcaccactgagactaacacaccccaactattacagctaagtaactactcaatattagacttaatgtgggccacgaataacaacttcatttctataatgtccaacgacaaatacgatttcaaaaactatatcgagaaccacaacctcaataaaaacgaagaccaaaacataagcgacttagtaaatgacatacatgtatccccagcactgaaaagaggaataacgcaaagcataaaaatagtacaagaaatagtaaaatttatgggccacgcacccaaacatatcttcattgaagttaccagggaaactaaaaaatccgaaataacaacctccagagaaaaaagaataaaacgcctgcagtccaagctactgaacaaagccaacgacttcaagccacaactgagagaatatttagttccaaacaagaagatacaagaagaactaaaaaaacataaaaacgacttaagcagcgaaagaataatgctgtacttcttgcaaaacggaaagtctctttattccgaagaatctttaaatataaacaaactctctgactatcaagtcgaccacatcctgccacgaacctatattccagacgactcactagaaaataaagccttagtattagcaaaggaaaaccaacgaaaggcggacgacctactcctaaactctaacgtcattgacagaaatctcgaaagatggacctacatgctaaacaacaacatgattgggctaaaaaaatttaaaaaccttactaggcgagtaatcactgacaaagataaactaggattcatccatcgtcagctggtacaaacgtcccaaatggtcaaaggagtagctaatattctcgacaatatgtacaagaaccaaggaaccacttgcattcaagcccgtgctaacctaagcactgcctttagaaaagccctatccggacaagacgacacctaccacttcaaacacccagaattagtcaaaaacagaaatgttaacgactttcatcacgcccaagatgcatatctagcatcattcctaggaacatacagattaagaagatttccaacgaatgaaatgttgctcatgaacggcgaatacaacaaattctacggacaggtgaaagagctttattccaaaaaaaaaaaactccctgattctcgaaaaaacggatttataatatccccgctagtaaacggcacgacccaatacgaccgtaacactggcgaaatcatatggaatgtaggattcagagacaaaattctaaagatattcaactatcatcaatgtaatgtgacacgtaaaacagaaataaaaaccggccaattttacgatcaaacaatttactctcccaaaaacccaaaatacaaaaaacttatcgcacaaaagaaagacatggatccaaacatatacggtggattctccggagataacaaatccagtataaccatcgtaaaaatagataacaataaaatcaaaccagttgcaataccaataagactaataaatgacctgaaagacaaaaaaacactacaaaactggctagaggaaaacgtaaaacacaaaaaaagtattcaaatcataaaaaacaatgtaccaataggacaaataatctactcaaaaaaagttgggctactgtctctcaattcagaccgagaggtagcaaacagacaacaactgatactacctccagagcattccgctctattacgactattgcaaattcccgacgaagacctcgaccaaatactcgccttctacgataaaaatattctcgtagaaatcctacaagaactaataacaaaaatgaaaaaattctaccccttctacaaaggcgaacgagaattccttatagccaacatcgaaaatttcaatcaagcaactacttcagaaaaggttaactcattagaagaactcataaccctcttacacgctaatagcacctcggcacatctaatattcaacaatattgaaaaaaaagctttcggaagaaaaacacatggattaaccctaaataatacagactttatctaccaatcagtaacaggtctctacgaaactcggatccatatagaatga

SEQ ID NO: 5369 - RNA, 4071 nt, synthetic construct
  misc_feature 1..4071: note = Cas9 variant
  source 1..4071: mol_type = other RNA
atgacaaaaaaagaacagccatacaatatcggcctagacatcggtactggatcagtaggatgggccgtaacaaatgataattatgatctattaaatatcaaaaaaaaaaatttatggggagtacgattattcgaaggcgcacaaaccgcaaaagaaaccagactaaacagatcaactagaagacgctatcgaagacgtaaaaacagaatcaactggctaaatgaaattttttcagaggaactagccaatacagacccaagcttcttaattcgtctgcaaaacagttgggtctccaaaaaagacccagacagaaaaagagacaaatacaacctatttattgacaatccttatacagataaagaatattatagagaatttccaacaatattccacctaaggaaagaactcataataaataagaataaagcagatataagactcgtctatctagcactccacaacatccttaaatacagaggtaattttacgtacgaacatcaaaaatttaatatctcgactctaaattcaaatctatccaaagagctcatagaactaaatcaacaactaataaagtacgacatcagcttcccagacaattgcgactggaaccatatatcagacatactcattggaagaggtaatgcaacacaaaaatccagtaacatcttaaataacttcactctagacaaagaaactaaaaaattactaaaagaagttataaatctaatactcggaaatgtagcacacttaaacacaatctttaaaacaagtctgactaaggacgaagaaaaattatcattttccggtaaagacatcgaatcaaaattagatgacttagactcaatactggacgacgatcaatttaccgtactagatactgcaaatcgaatatactcaacaataacattgaatgaaatcttgaacggagagtcatatttctccatggctaaagtcaatcaatacgaaaaccatgcaatagacctatgtaaattacgcgatatgtggcacacaacaaaaaatgaaaaggcagtaggtttatcaagacaagcttacgacgactatataaataaaccgaaatatggaacaaaagaactatatacatccctcaaaaaatttcttaaggttgcactccccacaaacctcgcaaaagaagcagaagaaaaaatttcaaaaggtacatatttagttaaaccacgaaactccgaaaatggcgttgtcccataccaattaaataaaattgaaatggaaaaaataatagataaccaatctcaatattatcccttcctaaaagaaaataaagaaaaactcttatcaatactttccttcagaattccatactatgtaggaccactccaaagttcagaaaaaaacccatttgcttggatggaacgtaagtcaaatggtcatgctcgtccctggaacttcgacgaaatcgtagaccgagaaaaaagctctaataaattcatacgccgaatgactgtaactgatagttatcttgtcggggaacccgtactccctaaaaactcgttaatctaccaaagatatgaagtactaaacgaactaaacaatatacgaatcacagaaaacttaaaaacaaatccaactggtagtaggctaaccgtcgaaacaaaacagcatatatacaatgaactatttaaaaactacaagaaaatcacagtgaaaaaacttacaaaatggctaatagcccaaggatattacaaaaatccgattctaataggtttaagccaaaaagatgaattcaattctactctaacgacctacttagacatgaaaaagatcttcggaagttctttcatggaaaacaacaagaattacaaccaaatagaagaactcatagaatggcttacaatattcgaagacaaacaaatacttaacgaaaaacttcactcatcaaattattcatacacctcagaccaaataaaaaagataagcaatatgagatacaaagggtggggaagactatcaaaaaaaatattaacctgtatcaccacagaaacaaacacacccaaatccctacaactatcaaactactcagttctggacctgatgtggacaactaacaacaacttcatatcaatcatctcaaacgacaaatatgatttcaaaaattatattgaaaatcataacctaaataaaaatgaagaccagaatattagcaatttagtaaatgacatccatgtctctccagccttaaaacgaggaatcacacaatcaataaaaatcgttcaagaaatagtaaaatttatgggtcacgcaccaaaatatatatttatagaagtcaccagagaaacaaaaaaatccgaaatcaccacttcaagagggaaaagaatccaaagactacaatccaaattactcaataaggcaaacggttttaaacctcaacttagaaaatacttagtacccaatgagaaaattcaagaagaactaaagaagcataaaaacgacctcagctcagaacgtataatgttatacttcctacaaaatggaaaatccctctactcagaagagagtcttaacataaataaactatcggactatcaagtagatcacatcctaccacgaacatacatacctgacgacagcctggaaaacaaggctttagttttagccaaggaaaatcaacgcaaagcagacgatctcctgctcaactcaaatgtaatagataaaaatcttgaacgttggacttatatgctaaacaacaacatgatgggtctcaaaaaattcaaaaacctcactcgaagagtaataacagacaaagataaattaggattcatacatcgccaactcgtacaaacctctcaaatggttaaaggagtcgccaacatcttaaactcaatgtacaaaaaccaaggaacaacctgcatacaagccagagctaatctctcaacagctttccgaaaagcactcagtgatcaagacgacagatatcatttcaaacatcctgagctagtaaaaaatcgaaatataaatgatttccatcacgcccaagacgcctatctagcatcattcctaggaacttatcgattacgtcgcttcccaacagacgaaatgttactcatgaacggcgaatacaacaaattttatggccaagtaaaagaactctactccaaaaaaaaaaagctaccggactcacgcaaaaacggcttcataataagtccactagttaatggaactacccaatatgatagaaataccggggagattatctggaatgtaggatttcgcgacaagatactaaaaatattcaactaccatcaatgcaacgtcacacgtaagaccgaaataaaaacagggcaattctacgatcaaacaatttattcaccgaaaaatcccaagtataaaaaactgattgcacaaaaaaaagacatggaccctaacatatacggaggattttcgggtgacaacaagtccagtatcaccatagtaaagatagacaataacaaaataaaacccgtagcaattccaataagactaattaatgacctaaaggataaaaagaccttacaaaattggcttgaagagaacgttaaacacaaaaaaagcatccaaataatcaaaaacaacgtcccaataggacaaataatctattcaaagaaagtaggacttttatctctaaactcagaccgcgaaatagctaaccgacaacaactaatattacccccggaacactcagcactgctacgcatcttacaaattcctgacgaagaccctgaccagatactagctttctatgacaaaaacatactagttgagatactacaagaattaatcacaaaaatgaaaaagttctatccattctacaaaaatgaacaagaatttctagcatccaacattgaaaactttaaccaagcaaccacatcagaaaaaataaactcactagaagaattaataacattacttcacgcgaattctacttcagcacacctcatcttcaataacatagaaaaaaaggcattcgggagaaaaacacacggattaacattgaatgatactgactttatctaccaatctgtaaccggcctatatgaaaccagaattcatatagaatga

SEQ ID NO: 5370 - RNA, 4071 nt, synthetic construct
  misc_feature 1..4071: note = Cas9 variant
  source 1..4071: mol_type = other RNA
atgagcaagaaagacagcgaatactacataggattagacataggaacaaactcagtcggctgggctgttacaaatggcaaatacgacctacttaatatcaaaaagaaaaatctctggggcgttcgtctattcgaagccgcagaaagtgctgccggccgccggataaatcgctcaacacgaagacgctaccgcagacgccgaaatagaattaattggttaaacgaaatcttcgcagacgaactaagtaaagtggatccttctttccttacgcgcctcaactcatcatggataagtaaaaaggattcctccagaacgcgtgataaatataatctatttatggatgccgactacacagacaaaaattaccaccacaaataccctacaatataccaccttcgccgggatctcatgttcgacgacaaacaattcgacataagactcgtctacctagccctccacaatataataaaatacagaggtaactttacatacgatcatcgaaaattcaatgtatcagaaatgtcaagtaatcttacaaaagccctcgaaaactttaatcaagaattaatggagttcgaagacgcattcccagacaatactgactactcagctatttcagaagtcttgctaaaatccaataacgtatcaacaaaaatagacgaaataatctctaatttagaacttgataaagataccaagaaataccttaaagaagtgctgaaattaatactaggaaatagcgctaatctcaatactatattccacacttctctcgataaagatgacgaaaaactttccttaagcgcaaaagacatcgaattgaaactcaacaatttagactcattattatcagacgaacaaatacacttcatatcatcagctaatgaactatactcatcaatcactctcaacgacatactagacgggaaaacgtacctatctctggcaaaaattaaacaatacgacacccattgctcagatctccaagaacttaaagaaatgtggtataaaacaacaaacccagacctcataaagaaatctagaaaagcctacaaagaatacgtacatggatcatataatacagaagatttctataaagcaatatccccttttctcaaaatagccatacctgaagacctcgccaaagacgcactgaagaaaatagacgccaatacctatcttccaaaacaacgcacttcaaataatggagtcatacccttccaattaaatcttatagaactagagaaaataatagataatcaatctaaatattatccctttttaaaagaaaatcgggagaaaataatcagtatactctcctttcgcataccatactacgtaggacccatccaagcaccaaccgataaaaacttctcttggatggtaaagaaaatccaagccaaagctcgcccctggaattttgacgaagtaatagatcgagaaaaatctagtaacaactttataaaacgaatgaccacgaccgatacatacctagtaggcgaaccagtactaccgaaaaactccttaatataccaaaaattcgaagtactaaacgaactaaacaacataagaatatctaaaaaccttagtcaagatccacttggaagtaaactctctgtagaagtgaaacaacaaatattcgaagaattatttaaacgttacaaaacagtaaaatctgaccaactaaagaaatggctgataagaaactcttactttacagatcccacaattataggcctctctaaaccctcagaatttaactcctcactatccactttcatagatatgaaagcaatattcggaatggatttcgtcaacaacccacgcaacagcagtcaactcgaagaactagcagaatggttaacagtttttgaagacaaacaaatcctatcagagaaaataagacattcaaactatccatatagcgaccaacaaatcagaaaaataagcaacatgagatacagaggctggggacgtataagcaagaaactactgtgtgacatcaaagtcgaaagtacgatatataaatcacatcaacttcatccctattcaatcctagacctaatgtggtcaacaaataacaacttttactccatacttcataaagacaaatacaactttgaatcaatccttgaagattataatctagggacagacgataaaacagatataaacgagttagtagacaacatacacacatcaccagcactaaaacggggcatcatccaaagtataaacatagtaaaagagctagtcaaattcatgggacacgcccctcaacatatttttctggagttcacaagagaagacaaaacttcaacactatcagaaagtaggaagaaacgactcaagaaactctacaacaatctgtctgaagacactaagaaatttaaactagacctaagagattacctcgtacctgataaatcaattcaaaaagagttagaatcacatgataaagacctatcaaaagaaagactcatgctctactttttacaaaatggtaaatcattatattccgacgaagcattagatatcaataggctttcggaataccaagtagaccatattctcccgcgcacttacataaaagatgactcactagaaaacaaagccttagtactagccaaagaaaatcaacggaaagcagacgacctattattacaaccctcaataataaacaaaaacatggaaagatggatatatatgaaagatcatggaatgatctcaccaaagaaatttaaaaacctaacacgcactactataacagaagacgacaaagtacattttattaaccgacagctagtacaaacatcgcaaataatcaaaaacgtagccaatatactagacaacatgtacaaagaacaaggtacaacctgcgtcgaaaccaaagcaaacctttcatcggcctttagaacagcctttagcgaacaagacgacaaataccactttaaacaccctgaatttattaaaaacagagatgtgaatgacttccaccacgctcaagatgcatacctggcatgtctattaggtttatacagaatccaacgcttcccatcagacgaaatgctactgataaagaaagaatatagaaaatttttcgcacaagcacaaaactcagtaaagaaccacggaaagattccagactctcaaaagaatggattcatactcgcacccctagtaaatggtgaaacgctgataaacaataaaacaatggaaaccatatggaatatggactataaacgtaaagtcataaaaatttttaattataaacaatataacatcaccaaaagaacagaaatcaaaacaggagagttctacaaacaaaccttatacagcccccacgatgaaaatgttaaaaatcctattccacaaaagaaaaatctagaccccaaaatctacggaggttacagcggcgtacaatcaagttatctggccataatcaaagtcgaccaaaagaaacccactatggtttcagtccctatacgattctcgaaaatgatcgacgatggaaaactatccctccaatcatggttagaaaataacataaaacacaagaaaacaatagaagtactcaaaaccaaaatccccattggtcaattaacatacaacccgaaaaacggttatctttcagtacaatctgaaaaagagatcgctaatgcgcaacaactcttcctacctttcgaacacgttgctctcctaaccttactccatgcgccaacttctgaatacgaccaaattctatccttttatgacacagatatcctccttgaaatatttgatgaaattacaaataaaataaaaacattcttccccttttatatagatgagcaagaatacttagtctcaattcgggaaaacttccaatccgccaccgttatagaaaaagtcaacgtcttacaacaattactaataatgttacatgctaattcttcaagaatatcgataaaactcggagaagttagcaaaaaggatctcggaagaaagaagaaacgaataccacttgaaaacactgatctagtctatcaatcagtcactggactatatcaaacaaaatttcacattgattga

SEQ ID NO: 5371 - RNA, 4074 nt, synthetic construct
  misc_feature 1..4074: note = Cas9 variant
  source 1..4074: mol_type = other RNA
atgaacgaccgcaacaaaaaatacaatatcggactcgacataggaactggctccgtaggttgggctgtaacggataacaactacaatttgctgcacgcaaaaaagaagaacctttggggcattcgattattcgatggagcagaaaccgcagcatccagacgaacgttccgttccacacgccgccgttacagaagaagaagaaatagaatcaattggttaaacgaaatttttgccgatgaattagccaagaaagaccaatcattcttagtaagaatgaactcaagctgggtatcaaaaaaagacaaaattcgacaaagagaccaatacaatttatttatggactcagactacacagacgtcgaatatcaccgtgaattcccaaccatatttcacctaagaaaacgtctaattgaagataaatcccaagcagacattcgtcttgtctatctagcactccacaacataataaaatatcgtggaaatttcacttacgaacaccagaactttgacgtatcacacatggacagcggcctcgcactactcctaaatcaactcaaccaacaattacaggcatttgaagttgcgtttcctgacgaaaccaattttgaatcaatgtctacaatcctactagaaaaaaagaccccaacccaaaaaatagatgagatcgtcgatcaaattcaaccagagaaagacttactacaaattactaaaaacataatgaaaatgttactaggaaataaagcagatcttgtaaaaatcttttctctcgatagcgatgataaaataactgtagaattctctagcaactcaattgagcaagatctaagcaacctcgaagaaacactatctgacgaacaatttaatataatcactctagcaaattctatctatagctcaatagtactaaacgatattctatctggcgaaacatacctctcgtttgcaaaagctagacaatactcagaccacaaaaaagatttagccaaactaaagactatgtggagagaaagcccggatagaaaagcagttggcaaagcgaaaaaagcgtacgatgactatttacactcgggaaaatatggaatcgaagacttctataaagacatgtctaaatttctagaaacagcaacaccagtcgaattagcaaaagaggcaaatgaaaaaatactaaacaaatcatatttgctaaaacaacgaaacaacgaaaacggagtgatcccatttcaattaaataaaaatgagatgattgaaattatcaataaccaagcaaaatactatcccttcctcgccgaaaataaggacaaattactgtctatattatcgttcagaatcccatattatgtcggacccctccaatcaaaaaaagacaacccattcgcatggatggaaaaaaaatctcaaggaaaaatccgaccatggaacttcgatgaaattgtagatagagaagcatcatccaataattttattagacgaatgacatcaacagatacatatctaatcggagaacccgtcttacctctaaaaagcccaatataccaaaaatacgaagttctaaacgaattatccaacgtacggataaacgcagatgaagtagacaatcctctaggagacaaactatccgtagatttaaaacaagccatatataacgaactatttctaaaacatagaagtgtaagcaaagctctacttaccaaatggctcatcaaccaatcctacttccaaaatccgcaaatatctggattagcagacagcaaaaaattcaattcaggactaaccacttaccacgatttcaaaaagatattcggagaagacttcgtcaacgaccccacaaaccaaagccaactcgaacaacttgccgaatggctaacaatatttgaagacaaaaaaatcttaaaaataaaactagacgatagccaattcaattgcacacccgaacaaataaaaaaaattgcaggtatgagataccaaggatggggtcgcttatcaaaaaaactcctctgcgatataaaaaccacaacagtgacctccaaaaatcatcaacaagcttcttactcaatattagatctaatgtggaacaccaatcgaaatttcatatccgtcctcaagaacgatacatataaatttgaagataaaatacaaactttcaacctggacaaaaatgaagcggccacaccacaagctatgatagatgaattacaaacaagcccagcgctaaaaaggggaatcagacaaagcgtaactataatacaagaacttgtcaaatttatgggacacgcaccagaacacatatttctcgaattcactagagaagacgacgtaagttcattaaccaaaagccgagactcccgattaaataaattatatgcacgaatagctaaaaacacgaaaaaaactgacgacgagctgaaaaagtcattactaccttcatccgacattaaagccacattaaaagcaaacaaaaacaatctttcaaatgacagactaatgttatactatttacaaatgggcaaatcactatacagcaaccaacctttagacatcaaccgtctcagtgaataccaaatcgatcatatacttccccaatcatatataaaagacaactcattagagaatagagcacttgtactcgcatctgaaaatcaacacaagtcaagtgacctactacttaaaccagaaataataaaccaaaacattgctcgatggcgttacatgaaggacgccggcctaatgggacctaaaaaattcaaaaatttaacaaggatacaaattacagattcagaccaaaataattttatcaacagacaattagtgcaaacttcacaaataataaaacatgtatccaacatattagattctatgtacggagaccaaggaactcaatgcgtagaaactagagcccatctatcaacagaatttagaaaagccttttccaatgaagacgataactatcacttccaacatcccgaattcgtaaaaaacagaaacataaacgactaccaccacgctcaagatgcatacctagcatgtctattgggactctaccaaatgaaaaaatatccgaccgacaacatgattctgttaaaaaaagaatacaagagattttttagtaatacaaaaaaaatatacgacaaaaagcatcatttccccgactatgtaaaaaatggatggatcattggctctatgttcaacggagaaaagtacgtcgacgaagagacaggacaaatcatctgggaccaacaaaccaaagacatggtatcttgtatttttcaatataaacaatacaacgtcacaaaacgcacagaagctgcaaacggagaattctacaatcaaactgtatataaaaaagaccccaacgaaaaaagaaagctcataagccttaaacaaggcctcgatacaaaattatacggaggctatagtggtgacaacccggcatacatcgtacttgtcaaaatcgatgacaaaaaaaacaaattagtaaaaatgccaattcgactagcggaacaagttgacaacaaaacaatagacttacaaacttggcttgaagagaatgtccctcataaaaaaggaatacaagtacttaagaccaaaattcccctaggacaagtcatatatagtaaaaaaaacggatacctcgcactaaaatccgatacagagatagtcaacgcacaacaactagttctcccatacggctacgttgccctcttaaccctgttacaaaaaatgccagaaaacaagtacgacgaggtgttagcctgttatgatgacggaatcctggacaacatctttgtagcaattattgacaaaatgaaacatttttatccttattacagcggcgaactaaaaacactaagcgataatatagataatttcaaagaatcacctgacgtaaacaagataaaaacactccaacaactacttctactcctccacgccagttcaacaacagcgtcgatcgaatttaacaatgttaaaaaaaactccttaggtagaaaacctaattcaataaatatacaaaatacagatctactaagcttttcagctaccggattatacgaatctcgcatccacatcgactga

SEQ ID NO: 5372 - RNA, 4074 nt, synthetic construct
  misc_feature 1..4074: note = Cas9 variant
  source 1..4074: mol_type = other RNA
atggcagctaaaaattataatattggcctcgacataggaactagctctataggctgggcaatcgttgacgataattaccaattaatgcatgctaaaggaaaatacggatacggaactagaatttattcagaaggtcaaacagctgcagacagaaggggattcagaacaactaggaggcgacttaatcgcagaaaatggcgactgagactactccaagatttctttgaaccatacattctcccacaagatgaagcattctttatccggcaaaaacaatctaatttagtaccacaagacactaaaaaacaatacccagaatcagtcctattcgatgacacttcggataaggatttttatactgagtacccaacaatctaccacctgaggcaagcccttatgaccgaaaatcgccaattcgacattcgagaagtctatctcgcaatacaccacattgttaagtacagaggacatttcctaaataatgccccagtcaaaacctttaaatctggaaaccttgacttagccataaaatttaacgaactaaacgaagaattcaaatctgtttatcctgatctagagttacaatttaacttagaccaaatagatgaaataaaaaaaatacttctggatagtacaaaaagtagatttgacagacaaggcgaagcagtaaaattaatatatacagttagcgaagtaaaaacaatagaaaaattacaaaataaaatagtaaaacaatttctttccggaattttaggcttaaacacaagattcgacgtattaacgaacaccgagagtgatgattcaatgtggaaattctcattagactcagaatcctcagacgatgcactagacgaaataattgcccaacttgatgaccccgccatacatgtagtagaactcgtaaacgaaatacatagttctattaccctagcaggtatagttccagagggtcaaggtctatcagagagcatggtagaaaaatacgaagcacacaaagctcacctccaattactaaaagcagtcgaaaaattagtagacaaaaaagccgctgacaaactggaagttgcatacgaccagtatataaacggaaaggactcaaaacaattcattaaagaagacttctacaaagcagtacaatcagaaattaaaggggttgcaggagatgaagttgctgagataaatcaacttatagagttagaccaattcatgccaaaacaacgaacaaaagaaaacggagcaattccccaccagcttcaccaacatgagctcgacgtaataatagaaaaccaaagtaaatactacgattggcttggcgaaaaagtaggaaacgaatacaaactagacaaactcgtatcattccgagttccttattacgtaggacccctagtggacacagcaagtaaggaaaaaaaagacgaaacaagattcgcctggatggttagaaaaaacccagaaagtacagaagcaataactccctggaactttgaggatattgttgacaaaaacgcatcagctgaaaacttcattaagaggatgaccactaaagataaataccttttaaatgaagatgtattaccaaaatgctcattactaacccaagacttcgaagtctataatgaactgaataatatccgtgtgaacggagaaaagtttaccgccgaacaaaagcagctaatccatgacgaactatttacaaaacacgcatctgtatcaatcaaacaattaaaagatttcctagtatcggaactaatgtatgtccgcgataatttaaaagttgaaggtttagcagatgaaaaaaagttaatgagcagcctatcaacacaatttgactatcagaaaataatccccgaccaaattaacgacgtaaaataccgcgaagatatagaacaaataatagaatggagcactatttttgaagacgcagccatatttaaaactaaattaaaagaaatagactggctaaccgatgaacaacgaaacaaactagcaaataagagataccgtggctggggaagcctatcaaaaagactattagcctgtcttgtagacgaaaacgggcaacgaataatagatattttacgagattcaagtgataacttcatgatgatagtaaacagacctgaatttaaacaagcaatctttgacgaaaacgctaatttaactgaaactaattcaaaaaaagacatgttcgaaatgatagataatttctatacgtcgccacaaaacaaaaaagcaattaggcaagtactgttagtcgtacaagatatccaaaatgcgatgggcggtgtagccccacaaaaaatcttcatcgaattcgctagggaggatgaagtaaacggcagaagaacaaactcaagatattctcaaataagagaaatgtatagcaaagtaacagatgatgttataaataaaacagtccgtggagaattagaagcaaacaaaggatcacttaataaagaaaagctattcttatattttttgcaaggaggcatagatctatactcaggaaagacaataaacatagataatataagtagttacgatgtcgatcacgtcttgccacaaagttttataaaagatgatagcataaataataaggtgctagtaaatgcaaaaggtaatagagtcaaaaacgacaatgtacccatggaattatttggcgcaaagatgtatccgacctggaaaaggatggtagatacaggaataatgtccaaggccaaattcaaaaaccttactttaaaccccgataacgtggataagtttaaagcagaggggtttatcaaccgacaattagtagagacaaggcaaatcatcaaattagtcgcacaaatactaaatgataaattaggagatgatacaaaaatagtctcagtgaaagccaacctaacacacgatatgcgggtattctttgatttcccaaagaatagaaatgtcaataattaccatcacgcatttgacgcctatttatccgcattcgtagggacttatctatataaacgctatcctaaattacaaccatactttgtatatggagagttcaaaaaaatggacaaattaaaaaacatgacaagtttcgacttcttaagagacttaaaacacacagacaaagttgtagacaaagacacaggagaaataatcgccgacaaactagcggtaatcacaaatatgaataagatatatgactttaagaaagtattagtaacccacgaagtccacgaaaattcaggagccatgtacgatcaaacactatacccagctaagttggataaaagtctaggtagaaaaggagccaaacaactaataccaaaaaaagacgacatgccaacggctctctatggaggatacacaggaagtaaggacgcatttatgagtatcgtaagactaaaaaagaaagacgaagtatattataaagtaataggaataccagtaagaatagcagatagcgtacaacacggtaaagaagtcgacgtcgaagcattaactcaatttatcgagacgaaatttaccaaagaaaacttaaacaaaaaaacaggagaaattaccagaaaagtagaatggttcgaattagtattaccaaaagtactatttggtcaagccgtatttgacggaggacaaccattcatgctaggaagctcaacgtacccgcacaatttacgagaactggttttaaccaaagattcagtaaaaaaaatcgcaggcaaggaaagtaacaagtcatatctggacgcctacgacgaaataatggaagccatgaataaatactttcccctctatgatacaaataaatttagagaaaaagtcatagaaggtcgatctaaatttatagatctaccagataaggatgaatatgaaaataacaaacttgtacaagtaggaaaatcaactataatagacagaatgtttataggactacatgcaaacgcggctagaacagatttaaaaaatataggcatcactactccattcggattcatgcaacaagcaagtggtattaaactcactaaagacacagttgtcttattccaatcatctacaggactgttcgaaagaaaagtagcattaaaggatctatga

SEQ ID NO: 5373 - RNA, 4077 nt, synthetic construct
  misc_feature 1..4077: note = Cas9 variant
  source 1..4077: mol_type = other RNA
atgaaagagccttacggagtaggtttagacataggtacaaattctgtgggatggactgtagttgatgcgagtggtcatgtcagaaaaatcaaaggacaaacaggaattggagtaaggttgtttaaagaaggggcagcggccgctgatagacgcggtttcagaaccacaagaagacgtctcaaaagagttaaatggagactaagactactaagagaatttttcgatcagccaatatcaaaagtagacataaatttctttgcaaggagaaaatactcagacgtgtcgccacgagatcctaattataatggccttgagaaaaccttatttaatgatagatcagatcaagatttctaccatgattatccaactatataccatctacgagaagccctaatgacacaacatagaaaatttgacgtaagagaaatctacctcgccatacatcacatagtcaaataccgaggaaatttcttaaggaatgacgcagccacagcttacagatcaggtacattagatctacaacaacatttcgaaaccttaaatcatctgttctctcaagccgatttagaactaaacctcaaccttactacagacgtcgcattgctcgactcaataaaacagactttagttagaacagacatatcgagaagtgatagacaaaaactaatcatgccactattagcagtcctaactggtgcaacaaccgctgaaaagaagcgccaaaaagcagtagtaaccgagttcgctaaagccctagtcggaaacaaaacaaaaatagacgttctaaccctaacagatatagatgcaacagaagccaaagactgggctttctccctagaagaaaatcaagataagttaccaggaatcgaggaccggttctcagaagtaggccaacaaattatagacgaagtgataagattatacgcctcggtcaatctagctcaattaattcctgagggaaaacgattctcacaatctatggtagaaaaatataaaagacacggagaagaccttaaattactaaaagcctacataagatcccaaagcgatgctaaacgaggacgcgcgatacgcgcaacatatgaccaatatatagacggcgtaaaatccaagcaagtaacacaagaagcatttcaaaaagcccttggcaaatttgttgacgcagatgttgatctaaactcatgggcagcacaaatcaaacaagctatagattcagaacaatttatgccaaaattacgaacaaaacagaacggcgcgataccctatcaagtccaacaaaatgagttagatcaaattattagtaaccaaaaagaatattatccatggttaggtgaagaaaacccagtaattaaacgaagaggaaaattcccatataaactcgatgaactgttcggattcagggtcccctattacgtaggaccattaataaccaaggagatgcaagcagcaactgctaacgcgggttttgcttggatggtacgaaaggcagacggtccgataactccttggaacttcgacgacaaagtagatagagtagcttcggcaaccgcatttatacaaagaatgcaaacgacagacacgtacctaataggcgaagaagtgttaccagcaagaagtcttatatatcaaagatttatggttttaaatgaattaaataatatcagagtagatgatggccaattaacacccagacaaaaacaacgactatacaatcaagtatttaagaaacacaaaagagttacagctaaaaatatacaagataatttagttgcggcaagagagttcccaacagctccaagaattactgggttagccgatcccaaagtcttcaacagttcactatcaacttatcacgacttaaaacaagttctccccgaagcaatgtcagacgtaaggaaacaagcagatatagagaaaatcatactctggtcaacaattttcgaagattccacaatatttaaacaaaaattaactgaaatatcatggctaacagctgctcaacttaaacaattaggccaactaagatatagaggatggggtcaactattaagaaaactactaactggtctcaaggatgataataatagaagtatcatggacggactatgggaaacaaatgcaaatttcatgcaactaagaagtcaacctgcgatcgagaaccagattaaatctgcaaatcaagcgaatctaactacggcagacctccaagatactataaacgaattatacacctcaccacaaaataagaaagcaataagagaggtcatggtcgtcctggctgatattaaagatgccatgcatgggcaaactccaaactggattttcgtagaagctgcccgcggtggcggcgttgcaggaagacgaacacagagccgatcaaaacaaatcgtcgcagcatatcaagggacagcacaggcaattgttcgtgatcaagtacaacgggaactaaaagaaaagatcaaaaataaagccaattttaacactcgattagtactatactttttacaaaacggaagagatttatatacaggtgacgctatcaacatagatagactctccgaatacgatatagaccatattttaccacagagcttagttaaagatgacagcctagataacagagtcttaactaatgcaagaataaaccgtgagaaaaacgatacatttgcttccgaaaaatttggtaagaaaatgggtgcgaaatggaaagaaatgcataggatgggcttaatgacaaaaagaaaacttgaccatttacttatgagaccagacgaaatttcgaaatacgcaacaggattcataaacagacagctagtggaaaccagacaagttataaaattggtagaagaactaataaacgcagaatatccaagtacagctattgtaagcgtcaaagccaacttaacacaccaattccgacaaacttttgacttccccaaaatacgtgaagttaacgattaccatcatgcattcgacgcagcactaaccgcattcatcggtacatatctattaaaaagatacccaaaactagagagatttttcgtatatggaaaattcgcaaaacaaccggtaaatcttactcgcttcaacgtaatacgaaaactagcaaaaaccgacaccccaatcacagacatagatacaggagaagtgttatgggacaaattaacagatataaagtactttgaaacactttatgattacaaacgattgctagtcactcgcgaagtatcagaaaactatggtgcaatgttcgatcaaactctattgaaagctagcgacaatggtaaaagattaattcgcaaaaagcaatcattcgacaccgcaatatatggaggatacacaggaaaaaccttagcatacatggccatcgtcaaagtgtcaactaagaaagacgtacagtaccaagtagtcggcgtacccactacaatggtgacccaaatagaacaactggagcagcaaggtatgacaaacaaacaagctgttactaaagtaatcgaaccgcttatcgccgccaataacaagaaaatgcttacatatgaggtactattaccaaaagtaagatttgaacaagtcgttagagatagaattaaaggccaaactcatcgattcgcacttggcacagacacgtactatcacaatatccaagaactatacctacctctcactctgcaacgagcatttctaggcaaacaaaatgaatcagaagttcaattaaaccaaaacctacttaccgtattcgatgcgaccctagcgcaagttaaccgatacttcccactctacgaaatgaataagtttaagaaaatactcaatagtgcgagagaccaaatagaactcctagaagctaaaaatcaattcgtcaaaaataaattagtattaggaaaacagggaatattaaccaatatgtttattggactacatgcaaatgcttcttacggagacttgaaagtactcggggtgaaaatagatttcggaaaactccaagtacctggcggaataaaacttacaggggatgcagaaataatatatcaatctccaacaggactattcgaacgaaaaattgcactaaaagacctctga

SEQ ID NO: 5374 - RNA, 4077 nt, synthetic construct
  misc_feature 1..4077: note = Cas9 variant
  source 1..4077: mol_type = other RNA
atgaacgaaccatacggagtaggcctagacataggaaccaattctgtaggatggacagtcgtggatatgaacggcagggttaggaaagttaaaggaaaaacagctctcggagccagattgttcaaagaaggagcaacagctgaggacagaagaggattccgaactaccagaagaagattaaaacgagttaaatggcgattacgactattaagagaatttttcgaccaaccaatatcaaaaatagacccgaacttctttgcaagacgaaaatactcagatatatctccaagagacccaaactacaacggtctagcaaaaacattatttaatgacaggaccgatcaggaattttatcacgattacccaacaatttaccatctacgagacaaactaatgacttcagacagaaaatttgacataagagaaatttacctagcaatacaccatatagtcaaatatcgaggaaactttctccgaacaggaccagcctctcaatatggatctgcgtccctacaccttgcgacatcctttcaaaaattaaatgacctgttcgcacaaagtgaagaatctctaaacttcaagctagttacagatgaagcccaacttcaacaaatacaacaaatactggtaaggacagacttatcgcgatcagaacaacaacgacaaatctggccactgatggttgtactaatgggagcaacagcagcagaaaagaaaagacaaaaagatttcgctaaagaattagctaatgcacttgtcggtctaaaagcaaaattaaatgtcgtaactttaacaaacgtcgacacaacagtagtcaaagattggacttttactctagaagaatctcaagacaaactcccagaaattgaagaacaattgtctgaagtcggccaacaaataatggacgaagtaattcaactatatgctagcgtaaatttagcgcagctaataccagccggaaaaagattttctcaacatatggttgaaaaatataatcaccatgagaaaaacctagaacttcttaaagcatatatccactcacaaagcgatagcaagcgaggtagagaaatccgagcaacatacgacagatacatagatggagtaaaatcaaaacctgtaacccaagaaatgttttataaagatctgatgaaatacgtagaagcagatgccacttcaaatcatctcgcagcggaaataaaagacgaaatagactccgagcaatttatgccaaagctacggaccaaacaaaacggatcaataccctatcaggttcagcaatatgaattagaccaaataataagccatcaaaagaaatattatccttggttaggtgaagaaaacccggttgctgaacgaagaggtaaattcccatataaactagacgagttggtaggatttagggttccatactacgtaggccccctaataaccaaagaagaccaacaagcgacaagtggtgctggcttcgcatggatggtaagaaaagcagacggaccaataacaccatggaatttcgaccaaaaagttgaccgcatcgcatccgcaacggcctttatacaaagaatgcaaaccactgacacatatttaattggtgaagacgtcctgccagcccgtagtctaatatatcaaagatttatggtattaaatgaattaaataacatgagagtagaagaccaaaaactagcaccacggcaaaaacagcgcctctacaaccaagtcttcaaacaacaccaacatgttagtgtgaaaaacattcaacaaaatctgatggatgcaggagaatacagagaaacacccaaaatcacaggactcgccgaccctaaagggtttaactcaagtttaagtacatatcatgatttcaagaaaatactcccagaagcaatagctgacgaacataaacgcgcggatattgagaaaataatactatggagcacaacatttgaagactcggctatatttaaacaaaaactagaagaagtggcgtggctaacagacgcacaaagaaaacaactatcgggacttcgttaccgcggatggggtcaattatcgcataaacttctaaccgcttttaaagacgataacggcagatctgtaatggatggactttgggaaacatctgacaatttcatgcaactacgaaaacagcccgcaatagaaacacaaataaaagaagcaaatcaagctaatctaacagatgcggatatacaagatacaataaatgaattgtatacaagtccacaaaataagaaagcaataagagaggtaatgttagttctagacgatattaaaaacgccatgcatggacaaaccccatcatggatatttatagaagccgctcgcggtggaggtgtcgccggcaggagaactcaatcaaggagtaaacaaattgttgaagcatacaaaagcacagctaaagaaattgtctctgaaaaagtccaacacgaacttaacgagaaaattaaagcaaaagcggattttaatacgagattagtactatacttcctccaaaacggtcgagacctttacacaaatgaagctataaatatcgaccgactatcagaatacgacatcgaccatatcctacctcagagcctagtaaaagacgactcactagataaccgcgtgttaacctcagcacgaataaatagagagaaaaacgataccttcgcatcggaaaaatttggcagaaaaatgggtgctcaatggcgggaattacacagaaatggattaatgacacaaaggaaactaaaacatttattaatgagaccggatgaaatttccaaacatgccacagatttcattaatagacaattagtagaaacacgacaagtcataaaactcgtagaagaactaatatcatcagagtatccctcagcatcaatagtagcagtcaaggcaaatttaacacatcaatttcgacaaacattcaattttccaaaattaagagaagttaacgattaccaccatgcatttgatgcctcattaacggcttttattggtatgtatctattaaaacaataccctaaattagaaagattcttcgtatacggaaaattcgcaaaacaaccgataaaccttacaaggtttaatgttattcgaaaattagctgtggcagaggaaccaatagcaaatattgaaacaggagaaatactatgggataagaccgccgatatcaagtgtttcgaaaaactctataattacaaaagattactcgtcacgcacgaagtacgtgaaaattatggtgcaatgtttgatcagacaatttttaaggcgactgactcaagaaagaggcttatacagaaaaagaaaggattcgcaactgaaacttatggcggttatacaggccgaaccttagcatatttagccattgttaaagtagtaactaataaagatacccaataccaagtagtaggcatccccactacaatggtaacacaaatacaacaactcgaagcatcaggacttacctcaaaacaagctgttactaaagcaataggtgcaatgatcaacgaaaacaacaagaaattacaatcttacgaagtacttctaccaaaagtaagatttgaacaggttgtaagggatgaagttaaaggacatatccatcgatttgcacttggcacagatacatattaccacaatatccaagaactatacctacctttaaccatacaaagagcatttctaggaaaaagaaatgacacagatgcacaaacagagcaaaacctcctcacagtgttcgagactacactagcgcaagtcaatagatacttcccattatatgaaatgaacaaattcaaacagatattaaactcagcccaagaaaaattcgcagctttaccaactaaaaacaaaacagttaaaaacaagctagtaaccggaaaagacggagtactaaataatttgtttataggcctacacgcaaatgccagcttaggtgaccttaaaatcttaggaatgaaaaccggcttcggcaaattacaggtaccaggaggtctcaaattaacagatcaagcagaaataatttatcagtctccaaccggattattcgaacgaaaagtcgccctcaaagatttgtga

SEQ ID NO: 5375 - RNA, 4077 nt, synthetic construct
  misc_feature 1..4077: note = Cas9 variant
  source 1..4077: mol_type = other RNA
atgaacgagccctatggagtaggactagacattggaacaaacagtgtaggatggacggtcgtcgacatgaatggtcgagtccgcaaagtcaaaggtaaaacagcactaggcgcacgactctttaaagaaggagccacagccgaagaccgcagaggcttcaggacaactagaagaagattgaaacgagtaaaatggcgcctccgcttactaagagagttctttgaccaaccaatatcgaagatagacccaaacttctttgcaaggagaaaatatagtgacatctcgccccgggatccaaactacaatggcttagcaaaaacactgtttaatgatcgaactgatcaagaattttaccatgattacccaactatatatcaccttagggacaaactaatgacctcagacagaaaatttgatatcagagaaatatacctggcaatccaccatatagtaaaatacagagggaattttctaagaacagggccagcctctcagtacggaagtgcgtcattacatttagcaactagctttcaaaaacttaatgaccttttcgcacagagtgaagaatcactgaactttaaattagtgaccgacgaagcacaattacaacaaatccagcagattctagtacgaacggatctctcaagaagcgagcaacagagacaaatctggccattaatggtagttcttatgggtgcaacagcagccgagaagaaacgtcaaaaagacttcgccaaagaactagcgaacgccctagtgggtctcaaagcaaaattaaacgtggtaacactaactaatgtggatacaacagtagtaaaagactggacattcacactagaagaatcacaagacaaacttccagaaatagaggaacaactatcagaagttggacaacaaataatggatgaagtaatacaactatacgcatccgtaaatttggcacaactcattccagcgggcaaacgattctcccaacacatggtagaaaaatataaccatcatgagaaaaatttggaactattaaaggcttatatacatagtcaatccgactccaaaaggggtagagaaataagagctacatatgacagatacattgacggagtcaaatcaaaaccagttacacaagaaatgttctataaagatctaatgaaatacgtagaagccgacgctacatcaaatcacttagctgctgaaataaaagacgagatagattcagaacaattcatgccaaaactgagaacaaaacaaaatggatcaataccgtaccaggttcaacaatatgaactcgaccaaataatcagtcatcaaaagaaatattacccttggctaggcgaagaaaatcccgttgcagaaagacgcggaaaatttccttacaaactagatgaactggtaggttttagggtaccatactacgtaggacctctcataacaaaagaagaccaacaggcaacttctggagccggatttgcatggatggtaagaaaagcagatggaccaattacgccttggaatttcgatcagaaagtagatcgaatagcatcagcaacagcgttcatccaacgcatgcaaacgacagatacgtatctaataggggaagatgtactgccggccagatcattaatataccagcgtttcatggtcctaaatgaactaaataatatgagagtagaagatcaaaaattagcaccacgacaaaaacaaagattgtacaaccaagtattcaaacaacatcaacatgtttccgtgaaaaacattcaacaaaatttaatggatgcaggagaataccgggaaacaccaaaaataactggacttgctgatcccaaaggattcaatagctcactatcaacatatcacgattttaagaaaatcttacctgaagcaatagcggacgaacacaaaagagcagacatagagaaaatcatactatggtctaccacgtttgaagattccgcgatattcaaacaaaaattagaagaagtagcctggttaacggacgctcaacgaaaacaattgagcggacttagatatagaggttggggccaactatcacataaacttttgaccgcttttaaagacgataatggacgatcagtaatggatggattatgggaaacaagcgataacttcatgcaactccgaaaacaaccagcaattgagactcaaataaaagaagctaatcaagcgaatctaactgatgcagatatacaagacactattaacgaattatacacctcaccacaaaacaagaaagccatacgtgaagttatgttagtgctagacgacattaaaaacgcaatgcatggacaaactccatcctggatcttcatagaagcagcacggggtggaggagttgcaggaagacgaacacaaagccggtcaaaacaaatagtcgaagcatataaatcaacggcaaaagaaatagtatcagaaaaagtccaacatgaattaaacgagaaaattaaagcaaaagcggactttaatacgagattagttttgtatttcctgcaaaacggcagagatctctatacaaatgaagcaataaacattgacagactatctgaatacgatatcgaccatatactcccccaatctttagtaaaagacgattcactagataatagagtattgacaagtgctaggataaaccgagagaaaaatgataccttcgctagcgaaaaattcggtagaaaaatgggtgcccagtggagggaattgcacagaaacggcctcatgacacaacgtaaactcaaacacctattaatgagacctgatgaaatatcgaaacacgctacagattttatcaatagacaactcgtggaaactcgacaagtaatcaaattagtagaagaacttatatctagtgaatatccatcagcttcaatagttgcagtaaaagcaaatcttacgcatcagtttcgacaaacattcaacttcccaaagttacgggaagtaaacgattatcaccatgcatttgacgcaagcctaacggcatttataggtatgtatcttttaaaacaatatccaaagctcgaaagatttttcgtatacggaaaattcgcaaaacaaccaatcaatttaacaagattcaatgtgattagaaaactcgccgttgctgaagaaccaatagcaaatatcgaaacaggggaaatcctatgggacaaaacagccgacattaaatgcttcgaaaaattatataactataagagactattagtcacacatgaagtcagagaaaattacggcgcaatgttcgaccaaacaatatttaaagcaaccgattctagaaaaagactaattcagaaaaagaaaggctttgccacagaaacgtatggaggatatacaggaagaacactagcatacctggctatagttaaagtcgtaacaaataaagatacccaatatcaagttgtaggtataccaactacaatggtcactcaaatacaacaactagaagcatcaggcttaacatcaaaacaagcagtaacaaaagctatcggagcaatgataaatgaaaacaacaagaaattacaatcgtacgaggtactattaccaaaagttcggttcgaacaagtagttagagacgaagtaaaaggacacatacacagattcgccttgggtacagatacttactaccataacatacaagaactatacctaccattgacaatacaaagggcttttctaggcaagcgaaacgatacagatgcacaaacagaacaaaacttattaaccgtattcgaaacaactctagcccaagtcaatagatattttccactatacgaaatgaacaaatttaaacaaatactaaatagtgcccaagagaaattcgctgcattacccaccaaaaacaaaacagttaagaacaagctagtaacaggaaaagacggtgtgctaaacaatctattcattggactacacgctaacgcatcattaggtgacttaaaaatattagggatgaaaattggattcggaaaactacaagttcctggaggcttaaaattaacagatcaagcagaaataatatatcaaagtccaacaggcttattcgaacgaaaagtagcgctgaaagacctatga

SEQ ID NO: 5376 - RNA, 4077 nt, synthetic construct
  misc_feature 1..4077: note = Cas9 variant
  source 1..4077: mol_type = other RNA
atgaaagaaccatatggggtaggtttggatataggcaccaattccgtaggctggacagtagtagatgctagtggccacgtgaggaaaataaaagggcaaacaggaattggagtaagactatttaaagaaggcgccgcagcggcggataggagaggtttcagaacaacccgaagacgcctaaaaagagtaaaatggaggctgagattattacgagaatttttcgaccaacccatatcaaaagtagatatcaactttttcgcaagacgaaaatatagtgatatatcacctagagacccaaactataatggattggagaaaacattattcaatgatagatcagaccaagacttctatcacgattacccgacaatatatcatttaagagaagcgctaatgacgcaacatagaaaattcgatgtgcgcgaaatatatcttgcaatccaccatattgtaaaatatcgtggaaacttcctaagaaatgatgcggccacggcttaccgaagcggaacattagatctacaacaacatttcgaaacgttaaaccacctattttcgcaagctgaccttgaactaaacctaaatttaacaacagacgtagccttacttgattccataaaacaaacgttagtacgtacagatataagtagatccgataggcaaaaattaataatgccactactagccgtattaaccggtgcgactaccgccgaaaagaaaagacagaaagctgttgtaacagaatttgctaaagcgttagtaggcaacaaaactaagatagatgttctaacacttacagatattgacgcgaccgaagcaaaagactgggctttctcactcgaagaaaatcaagacaaactaccagggatagaagacagattttccgaagtaggacaacaaatcattgacgaagttattaggctatacgctagcgtcaacctagcacaactcatacccgaaggcaaaagatttagtcaatccatggttgaaaaatacaaaaggcatggagaagacctcaagctgcttaaagcatatataaggtctcaatcagatgccaaacgagggagagctataagagcaacttacgaccaatatatcgatggtgtaaaatccaaacaggtgacacaagaagcatttcaaaaagccttaggcaaattcgtcgatgcagatgtagatctaaattcttgggcagctcagatcaaacaagcaatcgatagtgaacaattcatgcctaaattacgaaccaaacaaaacggagcaataccgtaccaagtgcaacagaacgaattagatcaaattataaataatcaaaaagaatactatccatggttaggagaagaaaatcctgtcataaaaagacgaggcaaatttccttataagttagatgagctagtcggattccgagtaccatactatgttgggcctttaataacaaaagaaatgcaagctgcaactgccaatgccggttttgcctggatggtcagaaaagctgacgggcctattacaccatggaattttgatgacaaagtagacagagtcgcatctgctacagcatttatacagcgaatgcaaacaactgacacatatctaataggagaagaagttctcccagcaagatccctaatataccaaagatttatggttctaaacgaattgaataacataagagtagacgacggtcaactaacacctagacaaaagcaaagactatacaatcaagtatttaagaaacacaaacgggtaacagcgaaaaatatacaagacaatctagtagctgcgggggagttcccaacagccccgaggattacgggactagcagaccctaaagtttttaatagttcactatcaacatatcatgatttaaaacaagtcttaccagaagctatgagcgacgtaagaaagcaagccgatattgagaaaataatactctggtctacaattttcgaagacagcacaatattcaaacaaaaacttactgaaataagttggctaacagctgcacaattaaaacaattaggtcaattacgttatagaggatggggtcaactatctagaaagttattgacaggtcttaaagacgataacaacagatcaataatggatgggctttgggaaacaaatgcaaactttatgcagctaagatcgcaaccagcaatagaaaatcaaataaaatcagcgaatcaagccaatctaacaacagcagatcttcaagacactataaatgaactatacacatcaccacaaaataagaaagcgattagagaagtgatggtagtccttgcagatataaaagatgctatgcatgggcaaacccccaattggattttcgttgaagcagccagaggcggtggagtcgcaggaagacgtacacaatcaagatcaaagcaaatcgttgcagcctaccaaggaacagcccaggtaatcgtaagcgaccaagttcaaagagaactcaaagagaaaattaaaaacaaagcaaatttcaacacaagattggtcttatactttttacagaatggtagagatttatacaccggagacgccataaacatagaccgattaagcgaatatgacatagaccatatattgccacaatctttagtgaaagatgattcactagacaatagagtattaactaacgctcgaataaacagggagaaaaacgacacattcgccagcgaaaaattcggtaagaaaatgggtgcgaaatggaaagaaatgcacagaatgggtctcatgacgaaaagaaaattggatcatctactaatgaggcctgatgaaataagcaaatacgcgacaggttttattaatagacaattagtagaaaccaggcaagtcattaaattagtcgaagaactaataaatgcagaatatccttcaacagcgatagtttccgttaaagcaaatctaacacaccaatttagacaaacttttgatttccctaaaataagagaagttaatgattatcaccacgcattcgatgcggctttaacagcgtttataggtacatatctgttgaaaagatatccaaaactcgaaagattctttgtgtatggaaaatttgccaaacaaccagtaaacttaacccgtttcaacgtaataagaaaactggcaaaaacagacacacctatcacggacatagacacaggagaagtattatgggacaaattaacagatataaaatacttcgaaaccttatatgattataaaagactactggttactcgagaagtcagtgaaaattacggcgcaatgttcgaccagaccctactaaaagcatcagataatggtaagcggctaattagaaagaaacagagctttgacacagcaatatacgggggctatacaggcaaaactctggcatacatggcaatagtaaaagtgtcaactaagaaagacgtacaatatcaagtagtcggagtacctacaacaatggtcactcaaatagaacaactcgaacaacaaggaatgactaacaaacaagccgtaacaaaagtaattgaaccactaatcgcagcgaataataagaaaatgctcacatatgaagttctcctccccaaagttcgatttgaacaagtcgtaagagatagaataaaaggacaaacccatagattcgctctaggaacagatacatactatcataacatccaagaactttatctaccactaacattacaaagagcatttctgggaaaacaaaatgaaagcgaagtacaactaaatcagaacttgcttaccgtatttgatgctacactcgcacaagtaaacagatactttcccttgtatgagatgaacaaatttaagaaaatattaaattcagcacgcgatcaaattgaacttctagaggcgaaaaaccagtttgtgaaaaataaattagtactaggaaaacagggtatccttaccaatatgttcataggactgcatgcaaacgcgagcttcggcgaccttaaaagtctcggagtaaaaacatcatttggccaactacaagtaccaggcggaataaaactaacgggagacgcagagattatttatcaatcacctacaggactatttgaaagaaaaatagcactcaaagatctctga

SEQ ID NO: 5377 - RNA, 4077 nt, synthetic construct
  misc_feature 1..4077: note = Cas9 variant
  source 1..4077: mol_type = other RNA
atgaaacaaggaaaaaggggatactacttaggtttagatataggaacagactcaatcggctacgcggtcacagacgaacaataccacttgcttagattccacggaaatgatgcatggggtagccatgtattcgactcagcatcactttgcgacgaaaggcgaggattccgtagcgctaggagaagactagaccgtagacaacaaagagtaaaactcctacaagaaattttcgcaaaagaaatagccaatatcgatccaagattctttattagactctcagaatcctaccgatggcgcgacgataccgacgatcgctacatatatttcaacgaagaggaatacacagatatacaatacatgcgagattaccccacaatccatcatcttatatgtgaactcatggagaatgaggaagaacacgatataagactcgtatatctagcctgcgcatggctagttgcacatcgcggtcactttttgtcacaattaagtgtagataatatagattcattaatagatatagaatccgtctaccaaaaatttctacactttttcatagataacggatgcgaaaatccctggatccaggatgcagaattggttgggggtatcctaaaagaacatataggagttacagaaaaacataatcgactaggagaaataatgttgggtaatagaaaaccaagtaaagatgtaagagatacctttttatattcagaatactgtatcattagactattagctggagggacttgcaaattaagggatttatatggtaaagaagaatacgaagactttggctcagtatcactagaaatggatgacgataaactagcagaaataatgatcaacattggagaagattacgaacttatagcagtactaagatcactgcacgactggtcagtacttgccgatatactcgacggacaaaatggtcttactaatatatccacagcgaaagtagcaatatatgaacaacataagaaagatctagcaacacttaaatatttcataagaaaatactgtccagaaaaatacaacgctatcttcaaagacgcgcgagaggacaattacgttgcatattcctaccactataacaacaaacttgacgggcagattaaaaagaaagcagacacggaaacctttagtaaatttctaataaaaataatccactcaataaaaccagataaagaagacgaaattatctaccaagacatggacaatcggctcggcttaagacagtttttacccaaacaacgtaacacagataacagggtaataccccatcaattatatgaatatgaattgaagaaaattctagagaacgcagcaaaatacctatcgtttttaaaccaaaaagaagacggcataagtaatacagagaaaataatatcaatttttaaatttaaaataccctattacgttggaccactaaataaacactctgaatttgcatggatagaccgaaaaagtggaaaaatattgccttggaattacgaaaatatgatagatgatgacgcatcagaagaggcttttataaagaaaatgactaatcaatgcacttacctcccaggtgaaagcgttcttcctaaagactcattatgttaccaaaagttcatggttttaaatgaaatcaacaatattaaagtagacggaaggaaaatttctgtaggtgcaaaacaaggcatctacagtgacctattcttaaaatacaagaaagtaaaaagatcacagatagaagaataccttatttccaacggacaattagagaaaaacagaagagaaacactatccggaatagacattcaaattaagtcatctttatcttcacatatcgcatttagaagacttctagaacagaaaatcttaaatgaagcggatgtagagcgcataatagagcgagcaagttatgcagaggataaaggtcgagtcgccaaatggttaagagcaaaataccctcacctgacggaagccgacataaaatacatatgtaaggtaaaaattaaagacttcggacgactaagtagaacatttctaacaggaatcgaaggagcatgtaaagaaacaggagaggtcgccactattattagtatgatgtgggaaagtaacgataatctgatggaactattaagcgaacgttatacgtttgctgatacaatacttgagttcaaatcggactactatacagaaagaaaacaaacccttagcgaaagactggatgaaatgtacgtatctaatgccgtacgacgaccgatatacagaacattagacatagtgaaagatctcgaaaaagcatttggaaaacctgagaagatattcatagaaatgacacggggagccatgcccgaactaaaaggaaagcgtacaaaatcacgacaacaacaattacttgaatactatgataaatgtaaagaagaagacgtacgagacttaaaacaacaattagaagcattaggagaatatgtagataacaaacttcagtcagaccgactgtttctatattttatgcaatttggtaaatgcgcctactctggcatgccaatctcactagaacgactaatggcaggatcaaaagaatacgatatagaccatatctacccgcaagcatacgtaaaggatgatagtataattaataacaaagtattagtactaagcgtagctaatggagaaaagaaagacgtatatccaattaaaagcgaaatacgcaacaaaatgcagaaaacatggagtttctggcaccatgtaggtactatatccgatgaaaaatataaaagactcataagaagtacaccattcactgaagacgaaaaatatggtttcattaacaggcaactaacagaaacatctcaatcaaccaaagtagtagccgaattattaaaagagagatatccagaagccgaaattgtctactcaaaagctggtttaatatctgactttagacatgagttcgacctatacaaatcaagaagttacaatgatttacatcatgctgttgatgcatacctaaatattgtagtcggaaacgtataccacatgagattctcaagacaatggttcaacgtcaactcatcatacagtataaaaacaaaaactctttttacccacacagtaaactgtaacggaaaggaagtatggaacaaagatatgctaccaggagttctaaaaaccgctaagaaaaacaccgcgcatttcacaaaacatgcaacatttaaaacaggcggtttatttgaccaaaatccggttaagaaagcacctggattaacacctttaaaagcaggactacccacagaaaaatacggaggttataataaagctggcgtaatgttcttcataccagtgagatataaatccgggaagaaaacagtattgatggtactatcagtagaattactttatggaaatagatttttagaagacgagatattcgccaaagaatatgcaaaagacagattacaaaggatgataggaaaaagcgtagatgaaatagatttcccaattggaatgcgtccatggaaagtaaacacaatcttaagtttagacggattcagaatatgtataactggaaacgcatccgggggaaaatgtctaattgcacaaccaataatgcaattttcatcagacgaatattggaaatactacctaaagaaagttgaaaaatttgtagaaaaagtcaaaaataatagttcgtatgtatatgatgttgactacgatgccgtccaacatgaagacaatttaaaactgtatgatttatatttagataaactgcaaaacagcatttatcgtaaaagaataaatgctccaatacaaacactaatagaaggaagagaaaaatttattgactgttcagtaatagaacaatgccaggtactcttaaacatacaccaagtatttggtcgtatgacatcaggctgtgatctaacattaattggtggtaaaacaagatcagcaagtacagtaaactttagtagtatcatcttaaattggaagaaaaattacacagacgtaagaattatagaccaaagtgctagcggcttatgggaggttgtatcagaaaacatactagagtacctttga

SEQ ID NO: 5378 - RNA, 4077 nt, synthetic construct
  misc_feature 1..4077: note = Cas9 variant
  source 1..4077: mol_type = other RNA
atgggaaaaatgtattatcttggtttagatatcggtactaacagtgtaggatacgcagttactgatccaagctaccatttattaaaattcaaaggagaaccaatgtggggtgcccatgtgtttgcagccggtaaccaatcagcagaaagaagaagtttcagaacaagtagacgtagactagataggagacagcaaagggttaaattagtacaagaaatatttgctccagtaattagccctatagatccaaggtttttcataagattacacgaatcagcactatggagagacgatgtagccgaaacggacaaacacattttctttaatgacccaacttacacagataaagaatattactcagactatcctaccattcaccacctcatagttgatcttatggaatcttcagaaaaacacgatccaaggctagtatatttagcagtcgcatggctagtagcccatagaggacacttcttaaatgaagtggacaaagacaatataggtgacgttctatctttcgacgcattctaccccgaatttctagcattcttaagcgacaatggagtatcaccgtgggtttgtgaatcaaaagcactacaagcaaccctattgtctcgtaattcagtgaacgataaatacaaagcactaaaaagcctaatttttggaagccaaaaaccagaagataactttgacgcaaacatatcagaagacggcctaatacaactcctagctgggaagaaagttaaagtcaataaattattccctcaagagtcaaatgatgcatcatttacactgaatgataaagaagatgctatcgaagagatcttaggtacactcactcctgatgagtgcgaatggatagcacatataaggcgactctttgactgggcaatcatgaaacatgcactaaaagatggccgaactatctcagaaagtaaagttaaactatatgaacaacatcaccacgacttaacccaactaaaatacttcgtaaaaacttaccttgccaaagaatacgacgatatattccggaatgtagactcagaaaccactaagaattacgtagcatatagttaccacgtaaaggaagtaaaaggtacacttcctaaaaacaaggcaactcaagaagaattttgtaaatacgtactgggaaaagtcaaaaacattgaatgttcggaagccgataaagtcgattttgacgaaatgatacaacgccttacagacaacagcttcatgccaaaacaagtctcaggtgaaaatagggtgattccataccaattatactattatgaactaaaaaccatattaaataaagctgcatcctatctcccatttctgacacaatgtgggaaagatgcaattagcaatcaagacaaactgctaagtatcatgacctttaggattccctattttgtgggaccacttagaaaagacaactcagaacatgcctggcttgagagaaaagcaggaaaaatatatccatggaatttcaacgataaagtcgaccttgacaaaagcgaggaagcattcatacgtagaatgaccaatacatgcacatattacccaggcgaggatgttttaccccttgactctctaatttacgaaaagttcatgatattaaatgaaataaataacatcaggattgacggctacccaatctccgtagacgttaaacaacaagtattcggactatttgaaaagaaacgcagggtaacggtaaaagatattcaaaatttactactctcattaggagcattagataaacatggaaaattaacaggcatagatacaactatacattcaaactacaatacatatcaccacttcaaatctctgatggaacgaggggtactaacaagagatgacgtagaacgaatagtagaaagaatgacatattcagatgacacaaaacgcgtgagactatggttgaataataattatggcacactgacagcggacgatgtcaaacatataagtagacttagaaaacacgattttggtagattaagtaaaatgtttcttacaggactgaagggcgttcacaaagaaaccggagaaagagcttcaattttagactttatgtggaatacaaatgataatctaatgcaactactgtcagaatgttatacattctcggatgaaataacaaaattacaagaagcatattatgctaaagcacaactcagtctaaacgactttctagactccatgtatatatccaacgcagtgaagcgaccaatctacagaactttagcggttgtcaacgacatacgtaaagcctgtggaaccgcaccaaagcgaatatttatagaaatggcaagagacggagaatccaaaaagaaaagatccgtgacaagacgagaacaaattaaaaacctatatcgctcaatacgaaaagattttcaacaagaagtagatttcctggagaagatcttagaaaataaatcggacggacaactacagtcggatgctctttacctctacttcgcccaacttggaagagacatgtacaccggggacccaattaaactcgaacacatcaaagatcagagcttctataacatagatcatatatatccacaatcaatggtgaaagacgactcattagacaacaaagtcctagtacagtcagaaataaacggtgaaaaatctagtaggtatccactcgatgccgcgatacgaaacaaaatgaagccattgtgggatgcctactacaaccatggattaatatctctcaagaaataccagaggcttaccagatcaacaccattcacggacgacgaaaaatgggattttataaatagacaattagtagagacacgacaaagcacaaaagcattagcaattctattaaaaagaaaatttccagacactgaaatagtctactctaaagcaggactatcaagcgacttccgacacgaatttggattagtaaaaagtagaaatatcaacgacctacatcatgctaaagacgcattcctagcaatagtgactggcaacgtttaccacgaacgattcaacagaagatggtttatggtaaatcaaccatatagtgtaaaaaccaaaacgctatttacacactcaattaaaaacggcaattttgtggcatggaacggagaagaagatttagggagaatagtgaaaatgttaaaacaaaacaaaaacacaatacacttcacacggttctcttttgaccgaaaagaaggcctcttcgatatacaaccactcaaagcgtccacaggtttagtaccccgaaaagctggactagatgtagtcaaatacggcggctacgataaatcaacagcagcatactatcttctagtacgattcacgctcgaagacaagaaaactcaacacaaactgatgatgatacccgtagaggggttatataaagcaaggatagaccacgacaaagaatttcttaccgactatgcgcaaacaactatttctgagatcctacagaaagataaacaaaaagtcattaacataatgtttcctatgggtacaagacacattaaattaaatagtatgatttcaattgatggcttctatttaagtataggcggaaaatcatcaaaaggtaaatcggttctatgtcatgcgatggtacccctaatagttccgcacaaaatagaatgctacataaaagcaatggaatcctttgcaagaaaatttaaagaaaacaacaaactaagaatagttgaaaaattcgacaaaataacagtagaagacaacttaaacctttacgaattatttttgcaaaaactccaacataatccatacaacaaatttttctcaactcaattcgatgtcttgaccaacggccgatctacattcacaaaactttcaccagaagaacaagtacaaacattactaaacattttatccatttttaaaacatgcagaagttcaggatgcgatctaaaatcaataaacgggtcggctcaagcagctaggattatgataagtgcagacttaacaggactttcgaagaaatactcagacatacgacttgtggaacaaagtgcatcaggactattcgtgtctaaatcacaaaatcttttagaatacctctga

SEQ ID NO: 5379 - RNA, 4083 nt, synthetic construct
  misc_feature 1..4083: note = Cas9 variant
  source 1..4083: mol_type = other RNA
atgacaaaactaggtaaaccatacggcattggggtagacattggtagcaactctattggtttcgctgctgttgacgaaaactcacatctaataagactaaaaggtaaaacggtaataggcgctcgactattcgaagaaggaaaggcagcagcagaccgacgagcttcacgcactactcgacgacgcttatcaagaaaccgatggaggctctctttccttcgagatttcttcgaatcacacataacccctactgacccaaatttcttcatgagacaaaaatattccgaaatctcaccaaaagataaagctagatacaaatacgaaaagcgattattcaacgacaggactgacgcagaattttatcaacaatatcctactatgtaccatttacgaacccgactgttgaccgacccatctaaagcagatgtccgagaaatatattttgctatacatcacatcttaaagagtcgaggacatttcctcacctcagggtatgcaaaggacttcaatacaaacaaagttgccctcaatgagatatttccagccctacaagacgcatacgcacaagtttatccagacctagacataaccttcgatgaaaacaaggttaatgaatttaaaacagtcttattagacgaaaaagcaaccccatccgacacccaacgagctttagtaaatctactattagccgaagacggtgacaaagacattttaaaacaacaaaaacaagtactcacagaatttgcaaaagctgtagtaggactaaagacaaagttaaatgttgctttggggactgaagtagattcatctgaagccacagcatggaatttttcgttggggcaattggacgacaaatgggctggaatagaaagtgcaatgactgatgaaggtacagaaattttagatcaaataagagatctatacagagccagactattaaatggcatagtgccagcaggcaaaactctatcacaagcaaaagtcgatgattacgaacaacaccatgaagacctagaacttttcaaagactatctaaagcaacttgaagatgacggaatggcaaaagcgataagacaattatacgacagatacatagatggagacgatgccaaaccatttgtcagagaagattttgttaaagcattaacaaaagaagtgaccgcccacccaaacgctaaatcaccagaactattagaacgacttgttcaaccagacttcatgctaaaacaaaggaataaggcaaatggggcaatacctgtccaaatgcaacaacgagaattagaccaaataattaaaaaccagtctgtttattacgattggctagcagctccaaaccctgtcgaaaaacatcgtcaatcaatgccataccaatttgatgaactattaaattttagaataccttactacgtaggaccactggtaacagcaaaagagcaaaaagccgcacaagggggagtattcgcgtggatggtaagaaaggacccagatgggaatataacaccttataacttcgacgaaaaagtagatcgtgaagcatcagcaaacacctttatacaaagaatgaaaaccacagacacctacctaattggagaagatgtattaccgaaacaaagcctcctctatcagtcctacgaagtattaaatgaattaaacaacgtgcgagttaacgataacaaattatcattcgaccagaaacaacaagtcttaggagaactattcgaaaggcataatacagtaacaattaaacaattcgtcgacaacttactagctcatggagattacgaccgaatccctgaagtaagaggacttgctgatgagaaaagatttctaagtagcttatccacatataaccagttgaaaggcattctacatgaagcaatagacgactcagataagcaaacggacatagagaaaataattgcatggagcaccatattcgaagacaaagccatcttcaaaactaaactgaatgaaataagttggcttaatgctggtatgataaattcactcgcaaacattaggtacagaggatggggccaattctcacacaaattattaaacgaactaaccctatccacaggtaggaccgtattcgaagaactactaattagttcacataatttaatgcaaatactaacagacgaagtactaaaacagaaaatagcagaattaaatgcccacgaactaaaagcaagcggaatatatgcagcaatagatgacgcttatacctcaccctcaaataagaaagcactacggcaagtcctatcagtaatagatgacataaccaatgctgctggacaagcaccaaactggctatatatagaaacagcagatggtgacggagtaccaggcaaaagaacaaactctcgccagagaaagattcaggaaatatatgtgaatgctgcacaagaactcataactggaagcgtacggggtgaacttgaagacaagatagcaagcagagcagatttcacagaccgattagtcttatatttcatgcaagggggaagagatatatacacaggcgaaccacttaatatagacaatctatcctcttatgacatagaccatattctaccacaatccttaattaaagataactcacttgacaatagggtattagtacatcccttagtaaatcgagaaaaagacacaatcttcgcatccactcgctttgcaaaacaaatgaatggaatgtggcgacagtggcacgcagcaggtttaattagcagtcgaaaactacgaaacttacaaatgagacccgacgaaattgacaaatatgcctctggtttcgtagccagacagctagtagaaactagacaaattataaaattaacagaacaaatcgttgctgaccaatacccagacgcaaaaattatagctgttaaagcaggactatcatctcaactacggaaagagctggacttccccaaaaacagggaagtcaaccactaccatcatgcatttgatgctttcctagcagccagaatcggaacatatctgctaaaacgctacccaaacctcgaaccattctttacatacggaaaatttaagaaaacagaagtaaagaaattaaaaagtttcaatttcataagagacatgacacatgcaaaagataaaattgtcgccaaagaaaccggagaaatcgtatgggataacgcatcagatataaatgaactcgatagaatatataatttcaaacgtatgctgattacgcatgaagtaagatttgaaacagcgtcattattcaaacaaacattgtatgcagccaaaaacagtaaaaatagaggaggctcaagacaattaataccgaaaaagaaaggatatttagtagatatctatggaggttatactcaagaaacaggatcatacttatctgtagtcaggctaactaagaaagcaatgtacgccgtagtgaaagttagcacccgagatgccgcgaaattagcagtagccaaatctatatcggaacaaaaagaaaatgaaacactaaagaaaataattgacggtaaattatctaaaacatccaaaaagggtaaaaccactcatcaattatttgaaattgtattaccacgcgtcggacagaaaactttatttaaaaattctaaatacaatcaattcctagtaaacagtgatacctacatgcacaattatcaagaattatggatgccaagagaatatcaaaggatgtggaaagacatacttctaagtaaccacggagatgctcaattagaaggccaattagatcaaatattcaaattcatagtcagtcaagtaaatagttactttaatttatatgacatcaatcaattccgaaagaaaattgcagatgctactgacaaatttgccaaattgcctacccacgatacagataatgcccgaggtaaaatagccacaatcggacaacttttaataggactccaagccaatgcaatgaggtcagatctaagaaacttggatataaaaactcctttcggcctcttgcaaatcggtacaggaataacccttgatttagatacatccataatatatcaatctccaacaggactatttgaacgagaagtacccttaactgacttgtga

SEQ ID NO: 5380 - RNA, 4083 nt, synthetic construct
  misc_feature 1..4083: note = Cas9 variant
  source 1..4083: mol_type = other RNA
atgacaaaacttaatcaaccgtatggaatagggctagacataggatcaagcagcataggctttgctgtagttgatgctaacagccatctattaagactaaaaggagaaacagcaataggagccagattattcagggaaggagaatcagccgcaggtagacgcgccagtagaacgaccagacggagactctcacacaatagatggagattaagattccttcaagactttttcgatccacatatctctagtatagacccagacttctttctccgacaaaaatacagcgaaatatcaccaaaagataaagaacgatttaaatatgagaaaaggttatttaacgacagaaccgatgcacaattttataaacaatatcctacaatgtatcatttgagactacaccttatgaatgatgcaagtaaagctgacccacgagaaatcttctttgccatacatcatatactaaaatcacgtggacattttctaaccccaggtgacgctaaaaattttaatacagacgacgtagacttgaagcatatattcccagcactaacagaagcctacgcacaagcatatccagacctaacattgagttttgaaccaagtaaagccgagaaattcaaaagtattttactcgatgaagatgccaccagcaacgatactcagaaagccctagtgaaacttctactatcggacgatggagacaaagaagtcttaaaacaacaaaagaaggttctaacagagttcgcaaaagccgtagctggacttaaagtaaaatttaatgtagcactaggtatagaagttactgatgctgatgttgaaaaatggcactttgggatggcacaactagaagataaatggagcgacatcgaacccagccttactgatcaaggtatggaaatttttgaacaaatacaggacttatacagagctagactactaaatggcatagtcccagccggtaaaacattatcacaagcaaaagtagacgattacgatcaacactgcaaggacctaaaacttttcaaagaatacctaaaacaattaaatgatcatgatctagcaaaacgcatacgattactttacgatcgatatatagatggcgatgatgctaagccgtttttacgcgatgactttgttaaagcattaaagaaagaagtgacagcgcatcccaccgaactcgccgaatcactattagagagaatggaacaagacaactttatgcttaaacaaagaactaaggcaaatgggtcaatacctgtacaaatgcaacagcgagaactagataaaataattgcaaatcaagcagaatactactcttggctagcagcagaaaaccctgtcaaagaacatagagactcgaaaccgtatcaattagacgaactattaaactttagaataccatattatgtaggtccaatgataaccaagaaacaacaagaaaaatcaggccaaaacgtgttcgcatggatggtacgaaaagatcctagtggaaatataacaccttataacttcgacgaaaaagttgacagggaagccagcgccaatgcctttatacagagaatgaaaacaacagacacatatttaattggagaagacgtactcccaaaacagagtctactatatcagaaatacgaagtacttaatgaattaaataacgtacgagtaaacggcgaatccttaagcacagaccaaaagaaaagattaataagagaactgttcgaacgacactcatccgttacattaaaacaatttgtagaaaacttagtggcacatggagatgtggcaaaacgacctgacgtaagaggactcgccgacgagaaacgatttttgagctcgctttcaacatatcatcaactacgaggaatcctacacgacgcaatagatgataggggaaaacaatccgacatagaaaatataataacatggagcacagtatttgaagatgcaagcatatttaaatctaaactaggagaaatttcatggctggattcaaaaacacgaacaacgttatctaatatacgatatcgtggatggggacaattctctagaaaattacttgacggcctaaaactagggaacggacacacaattatacaggagttaatgctctcatcaagaaatttaatgcaaatattaaccgatgaaacactcaagaaagagatggctacactaaatcaagaacgattaaaacccgacagcataaatgaagccattgatgctgcatacacatctccctcaaataagaaagcgatacgtcaagttttaaaagtagtcgatgatattaagcatgcagcgaacgaccaggcacccagttggttatacatagaaacggccgatggagggggacatccaggaaagcgaacactatctcgccaaaaacaaatacaagcaatatatgagaacacagctaaagaattaattgattccgctgtaagaggggaattaaaagacaaaatagcagacaaaacaaatttcagtgacaggttggtactatactttatgcaaggtggacatgacatttacactggaacagctttaaacatcgaccaattatctagttacgatattgaccatatattacctcaatcactaataaaagacgactctctagataaccgagtattagttcatgcaaaaataaaccgagaaaagaacgccgagttcgcatcaaccctattcgcagcaaaaatggcatcaacgtggcataggtggcgtgacgccgggctaatttcagggagaaaacttaaaaatttattaatgaggccagatgaagtcgacaaatatgcgaaaggatttgttgctcgacagttagtcgaaacaagacaaattataaaattaaccgaacaaattgtagccgcacaataccccgacacaaaaataatagctgtaaaagctggattgagccaccaactacgacaagaacttgactttcccaaaaatagagatgtcaaccactatcatcacgcctttgatgcatttttggcagcaagaataggaacatacctcttaaaacgctatccaaacttggcgccattctttacgtatggagaatttacgaagactaatttaaagaaactacaatcgtttaattttataggcgcgttaacacacacagacggtaaaatcacttctaaagacacaggggaagtcctatgggacaaccaaagagatatagaggaactagaccaaatttacaattttaaacgtatgctaattacacacgaagtttacttcgaaacagcagggctatttaaacagacagtatacgcagcaaaagactctaaagagcgtggcggttcgcgtcaactaataccaaagaagaaaggatacagcacaggaatttatggcgggtatacacaggaaacagggtcctataatgctctagtaaggctaacaaaagcaggtaaagttgtttacagagtcttcaaaattagcacacaaaacgcagctgaaattgcagccgcaagaagtttatccgccgaagaaggaaatgaaagattatgccaaatacttgaacaatctttactaaaaacgaataaagacaagaaaaacaccgttgaccttttcgatgtagttattccacgattaggtaaagaagcactatttcataatagtaaatatggcttgtttctcgtgaatagcgacacgtattatcataattaccaagaactatggctatcacgcgagaaccagaaaatcctaaagaaactattttcaacaaaatacgatcaaagtgaaatggacagagacgcattacatttattcgaaacaatagctaaacaagtagaacaattctttaaactatacgatataaatcaattcagaacaaaaattagctctgcctttgatgcctttgaaaaattacccgttgaaggagaagaagggaaagtggagacactaaaacaactactcattggactacatgcaaatcctgtacgatcagatcttaaaaatctagggataaaaacaccctttgggtttttacaagcaggaaaaggcatacacctcgatgatgatactgaaatcatacaacaatcaccagcaggactattcaaacgacgagtaaggctcgcggatttatga

SEQ ID NO: 5381 - RNA, 4086 nt, synthetic construct
  misc_feature 1..4086: note = Cas9 variant
  source 1..4086: mol_type = other RNA
atgacaaaattaggaaaaccatatggaataggagtagatataggatcaaactctatcggatttgcagctgtagatgaaaatagtcacctaataagactaaaagggaaaacagtaataggagccaggttatttgaggaaggtaaagcagcggccgaccgccgagctagtcgcaccactaggagacgactatctagaaacagatggcggctatcattccttcgggacttctttgaatcccatataacacctacaggacctaactttttcatgcgccaaaaatactcagaaatatcccctaaagataaagcaagatataaatatgagaaaagattatttaacgataggaccgacgctgaattttaccaacaatatcccactatgtaccacttaagaaatcgacttctaaccgatccatctaaagcagatgtacgggaaatatatttcgccatccaccacatacttaaatcaagaggacactttttaacgagcggctatgcaaaagatttcaataccaataaagttgcacttaatgaaatttttccagcgcttcaggacgcatatgcacaagtatatccagatttggatataacattcgatgaaaataaagtcaacgagttcaaaacagtactattgaatgaaaaagctacaccatctgacacacaaagagcactcgtgaatttactcctagccgaagatggtgataaagatatcttaaaacaacaaaaacaagtacttactgaatttgcaaaggctgtagtaggtctcaagacaaaattaaacgttgctcttggaaccgaagtagatagctccgaagcaacagtttggaatttttcacttggacaactagatgataaatgggccggcattgaatcagccatgacagatgaaggcaccgaaatactagaccaaataagagacctataccgagctagactactaaacgggatagtccctgcaggaaaaaccctatcacaagcgaaagttgatgattacgcacaacatcacgaagaccttgaactgtttaaagactatctaaaacaattagaagacgacggtactgccaaagcaataaggcagttatacgacagatatatagacggagacgacgcaaaaccttttgtccgagaagacttcgtaaaggcattaactaaagaagttacagctcaccccaatgcaaaaagcccagaactcttagagaggctagcacaaccagactttatgctgaaacaacgcaataaagcaaatggggcaattcccgtacaaatgcaacaaagagaattagaccaaattattaaaaatcaaagtgtatactacgattggctagctgccccaaatccagtagagaaacatcgaaaaagtatgccatatcaattagacgaactattaaacttcagaataccatactacgtaggccccctagtaacagcaaaagaacaaaaggccgcacagggtggcgtgttcgcgtggatggttagaaaagatccagacggaaacataacaccatataacttcgatgaaaaagtagatcgagaagcaagtgcaaatacgttcattcaaagaatgaaaactacagacacatacctaatcggcgaagatgtactaccaaaacaaagtttattgtaccaaagatacgaagtactaaacgaattaaacaatgtacgtgttaataatgaaaagctatcaattgaacaaaagcaacaagtgataagagaactttttgaaagacataatagtgttactattaaacaattcgccgaaaacctacgcgcacatggagactatgcccatattccagaaataagaggcctagcggacgaaaaacggttcctctctagcttatcaacataccgccaattaaaatcattgttacccgatgccatagatgatccagctaaacaagcagatatcgaaaatataatagcatggagcacagtttttgaagatgcagcaatttttaaaacaaaacttaaagaaataaattggttagatagccaaacaataactaaacttagtaatataaggtaccgaggttggggtcagttttctcataaatttctcaatggacttacactaggtaatgggcacactatcattcaagagttgtttcttagtaataataatttaatgcaaatattaaccgatgaaactctccaaaagaaaatgacagaactgaacgcagataaacttaaagctgccaacattaatgacgcgatagatgatgcatatacgagcccctcaaataaaaaggccttaagacaagtcttaagggtaatagaagatattaaaagagcagccgacggccaagatccaagttggttatacgttgaaacagcagatggtggagggaccccaggtaaaagaacacgagcacgtcaacaccaattacaagaaatctacgcaaatgcagctcacgaactcatagacagcgcagttagaggtgagctcgaagataaaatagctgataaagcagacttcaacgataggcttgtactctacttcatgcaaggtggccgtgatatatacacaggtacaccactaaatatagaccaactatcctcatacgatatagaccatattctaccacaaagtctaataaaagataattcattagataatagagtgctcgtacacgctataataaatagagagaaaaatgccacttttgcatcaacgatatacgcacaaaagatgaatgcaacttggcggcaatggcatgaagctggtctcattagtggacgaaaattaagaaacctgcagatgaggccggatcaaatagacaaatacgcctctggatttgtcgctagacaattagtcgaaacccgacaaataataaagctgacagagcaaattgtagccgcacaatatcctgaaacaaaaataattgccgtaaaagccggattaagccaccaactcagggaagaattagaatttcctaaaaatcgcgatgtaaatcattaccaccatgcgttcgatgcgttcttagcagccagaataggcacctacctcctcaagagattcccaaacttacaggcattctttacatatggcaaatttaagaaagctgatgttaagaaacttcgcggctttaattttatccgtgatataacacatgcagaagataaaatcgtcgtgaaagataccggcgaggttatctgggataagaaaagagacgttgatgaattagatcgaatttacaacttcaaacggatgttaataacacatgaggtccactttgaaaaagccgacctgtttaaacaaactgtttatggagcaaaagactcaaaagaggctgggggaaagaaacaattaataagcaagaagaaaggatatccagtagacatatatggaggatatacacaagaaactggcagctatctatcagtagtcaggctaacaaagaaagccatgtacgccgttgtaaaagtaagcacaagagacgcagctaaactagccgtagccaaatcaattagtgaacaaaaagaaaacgaaactcttaatgatataatcgatgaaaaactatcaaaaataagtaaaaacggaaaaataactcatgagctattcgaagtagtactaccacgggtgggtcagaaaacattatttaaaaattcaaaatacaatctcttcctcgtaaattcagacacgtacatgcacaattaccaagaactatggatgccacgagaataccagaaaatgtggaaagatatatcactatcgaaatatggagacgcacaaacagaagatcaacttgatcaaatattcggctttatagtcagtcaagtcaactcttattttaatctatatgacataaatcaatttagaaagaaattaaatgacgcagcagataaattcgcaaccctaccaatgcgagatactgatgacatgcaagggaaaatagcaaccatagggcaactactaatcggacttcaagccaatgcagctcgaagcgacctccgaaatttagatataaaaacaccattaggattattacaaataccaaacggaatatcattggacagtgacacttccgtagtttatcaaagcccaacaggactcttagaacgggaagtccatttaagtgacttatga

SEQ ID NO: 5382 - RNA, 4086 nt, synthetic construct
  misc_feature 1..4086: note = Cas9 variant
  source 1..4086: mol_type = other RNA
atgaagaaaccctacagcattggtctggatataggaacaaactcagtcggatggtccgtagtgaccgacgactacaaagtaccagcgaagaaaatgaaagtcttgggtaatacagataaagaatacatcaagaaaaacttaataggagcactattatttgatagtggggagacggctgaggcaactcgaatgaaaagaacagcacgcagacgatacaccagaaggagaaacaggatattatatttgcaagacatattttcccctgaactaaaccaagttgacgaatccttcttgcacaggttggatgattcgtttctcgttgcagaagataaaagaggtgaaagacatgttattttcggtaacattgcggatgaggtaaaataccataaagaatttccaactatataccatttaagaaaacatttagccgattcaagcgaaaaagcggacttaagacttgtttacctagcactagcacatatcataaaatatcgaggacacttcttaatagacgaaccaatcgatataagaaacatgaactcacagaaccttttcaaagagtttttgttagcttttgatggtatacaagtagattgttacttagcgtcaaaacacactgacatatccggaataatcacagcaaaaatatcgaaatctcgaaaagtagaagcagtcctagaacaatttccagaccaaaagaaaaactccttcttcggtaacatggttagtctagtattcggtctcatgccaaatttcaaatcaaactttgaattagatgaagatgccaaactacaattctcaagagattcatatgacgaagacctggaaaacctcctaggaatcataggagatgaatatgccgacgtatttgtggccgctaagaaagtatacgactcaattctattatctggaatattaaccaccaacaatcactctacaaaagctccacttagcgcctcaatgatagaccgctacgacgaacacaactcagataagaaactactcagagactttattagaacaaacataggtaaagaagtctttaaagaagtcttttacgatacgagcaaaaacggatatgcaggatatatagatggcaaaacaaaccaagaagacttttacaaatatttgaaaaacctactacaaaaagttgatggaggagattactttatcgagaaaatagaaagagaagatttcctacgtaaacagagaacatttgacaatggatcaataccacaccaagtacatcttgacgaaatgaaagcaatattaagacgacaaggagagttctatccctttctcaaagaaaatgccgagaaaatacaacaaatactaacgttcaaaataccatactatgtaggaccgctggctagaggtaattcacgtttcgcatgggccagctacaacagcaacgagaaaatgaccccctggaacttcgataacgtcattgataaaacctcaagtgcacaagcgttcattgaaagaatgacaaacaatgatttatatttacctgatcagaaagtactcccaaaacattcactattataccaaaaattcgcggtatataacgaactaacaaaaatcaaatatgtaacagaaacaggagaagcaagattattcgacgtgttcttaaagaaagaaatatttgacggactatttaagaaagaacgaaaagtgacgaaaaagaaaattttaaacttcctcgataaaaacttcgacgaatttcgcataacagacatccagggcttagacaatgaaacaggaaattttaacgcttcatatggaacatatcacgaccttttgaaaataatcggcgacaaagaatttatggactcctccgacaacgtcgacgtattagaagatatagtgcttagcctaactttattcgaagatcgtgaaatgataaaacaacgacttctaaaatatgaagatatatttagcaagaaagttatcgcaaatcttactcgaagacattatacgggctggggacgtctcagtgcaaaactgatcaatggaataaaagataaacatagtagaaaaacgatcttagactatttaatagatgacggtcactcaaatagaaacttcatgcaactaatcaatgacgataatttatcttttaaagacgagatagcaaatagtcaagtcataggagatggagatgatttacaccaagttgtacaggaactagccggctcaccagcgataaagaaaggtatattacaatctcttaaaattgtagacgaactcgtaaaagtaatgggatacaacccagaacaaatagttgtcgaaatggcacgtgaaaaccaaacaaccgctcgaggaagaaacaactcacaacaaagactaggaagcctcacaaaagctatacaggattttggttcagatatacttaaaagatacccagtagagaacaatcaactacaaaacgaccaactatatctatactatctccaaaatggtaaagatatgtatacaggtgacacgctagacatacataacctaagccaatacgacatagaccatataataccacaatcattcatcaaagataatagtctcgataacagagtattgaccaattcaaaatcaaaccgcgggaaaagcgacaatgtaccatcaaacgaagtagtcaaaagaatgaaaggcttctggctcaaacaattagatgcgaaattaataagtcaaagaaaattcgacaatctaacaaaagcagaacgaggaggactaagtgcagaagacaaagcgggcttcataaaacgacaattagtagaaacccgccaaataactaaacacgtcgctcgcatactagacgaaaggtttaacagagattttgataaaaacgacaaaagaatcagaaacgtaaagattgtaacactaaaatcaaacttagtatcaaacttccgtaaagaatttggattctataaagttcgcgaaataaacaactttcaccacgcacacgatgcatacctaaatgccgtcgtagcaaaagctctgttaataaggtaccccaaattagagccagagttcgtgtatggagaatatcctaagtacaatagctacagagaacgaaaatcagctacagagaaaatgttcttctacagtaacatcatgaacatgttcaaaactacaataaaactagcagacggtagagtcgttgaaaaacccgtaatagaagcaaacgaagaaaccggagagatagcttgggacaaaacaaaacattttgcaaatgtaaagaaagttctatcatacccccaagtaagtatagtgaagaaagtagaagaacaaactggtggattctccaaagagtcgatattgcctaaaggaggatcagacaaactcatcgctagaaagaccaaaaacaactatctatcaacacaaaagtacggaggattcgattcacctacagtagcatatagtataatgttcgtagcggacatcgaaaaaggtaaaagtaaaagactaaaaacagtaaaagaaatgattggaatcacaataatggaacggtcaagattcgaatctaatagcgtaacattcctagaagaaaaaggatacagaaacataagagagaacactataataaaattccccaaatattcattgtttgaactagaaaatggtcgtagaagactattagcaagcgcaatagaactacaaaaagggaacgaaatgtttttaccccagcaatttgtaaacttactatatcatgcacaacatgctaacaaagaagactcagtaatatatttagagaaacatagacacgaactatctgaacttttccaccacataataggcgttagcgagaaaaccattttaaaacctaaagtagaaatgacgttaaatgaagcattcgaaaaacacttcgaatttgacgaagtaagcgaactcgcccaatcattcatctccttactcaaattcacagcattcggtgcccctggaggattcaaatttttggacgccgacataaaacaaagtaatttgagatatcaaacagtaacagaagttctttcatcaaccctaatacatcaaagcgtaacgggattatacgaaaccagaatagacctctcaaagctcggaggcgaatga

SEQ ID NO: 5383 - RNA, 4086 nt, synthetic construct
  misc_feature 1..4086: note = Cas9 variant
  source 1..4086: mol_type = other RNA
atgggaaactattatctaggactagacatcggcactaactctgttggatgggctgtcactgatgagaattacaacatagaacggttcaaaaagaaaaatatgtggggaatccgactcttcgacgaagctaaaaccgccgaatcaagacgcatacataggcaagctcgcagaatgagacaaaggaaaatccaacgactcaacttactaatggaactatttgacgtagaaatatccaaggtcgacgaaagcttcttcatacgaaaaaaagaaagcgacctccattatgaagacaaaagtcaagactcccgatacgcattattcaacgataaagaattcaatgacaaggattatcacaacaaatatccaactatattccacctaataatggaccttatagaaaacgacgaaaaaaaagatatcagacttctctatttagcatgccattatctaataaaaaatcggggacatttcatattcgaaggtcaaaaattcgacgtgaactcatctttaaacaataacataaacaaattaaaatcacacttagaccaattctataatatatgtctagatttcgacaacgacaaactaatagaaatactagttaaccaaaatctcaacatatcagaaaaaagcaaaaaaatcaaagagctactacgaaaaaccaaccttgaagtaggaattgcgaacctaatagcaggaggatcaatcaaattatccaatatgttcgacgacgacgaactaaaaaaccttgattataactcattaagtttcaaaaattctaacttcgatgaaggaagagagttatttgaggaagtactagaagatcgcttcgaacttgtagaaatcttaaaagacattcatgacgctagcgtattagaaacaatgctatccagtgcatcaataagcccagacggtggaaaatacatatcttcaagcatgatcaacagctacaacaaacataaaagggacctcaaattactaaaaaaaataataaaaaaatataaaaaatcagaatatgataatatatttcgggacgagaatataaaaaacaattacttatcatataccaggacaggaataaacaaaaataaaaaagtccaagccgaagacaatacagatagcgacggtttttacaaatatatagtgaagatcctcaaagatatcaaagaaaatgattcagacgaagacatcaaatacatcctctcagaaatagacaaaaaaaattttgttcccaaacaaaggacaaaagaaaactccgtcataccatatcagctacgagaaatagaactaagaaaaataattgacaaccaatcaaaatatcacaaatttctcaacgaagtagatgaaaaaggaataagcgtcaaagaaaaaataatatctctcttgaccttccgaataccttactatattggacctctaaacccaagctacaatgaagaaaagaacttcaccacctcttgggtaaaaaggctagcaaaaggtaaagtcacaccgtggaactttgaagatatggtagacatcgacgctagcagagaggcattcatagaaaacaaacttaacaaatgctcatttcttttagacgaaacagttctcccaaaggactcattattatatcaagaatacatggtcctcaacgaactcaacaacctaaaaataaacggacagtcaataaacaccgacttaaaaaaatccatatacgaagaactattcaaaaaatacaaaaaagtgacacgcaaacgattaataagttacataaaagaaaaagaaaatatgagcggcgatatagtaataacaggaatagatggggactttaaacagggactgaaaagctatattgccttcaaagacatcattggtgaaaaaatagacgacgacatttatcgcaaagaagtagagaaaattattagggatatatcattatatggagatgacaaatcttttattcaaaagaaaattaaaaatgaaaacaagctagacttatccgatgatcaaatctccaaaatagccaaattaaaatttaaagattggggacgcttttctaaaaaacttctagtagggataaaggcatcagacaaaaacactggcgaaatagacaatattataggatttatgcgtaattataactacaacattatgcaactaatggcaaacgtcttcacctttaaagatgaaatcgaaaaattaaacagtaaatattacacagacgaaaaaatcaacatcgactatctagacgacttatatctctcatcaccagcaaaaagaatgttatggcaaagctttcaaattgtagatgaaattaaaaacatcaaaaactcggacccaaaaaagatctttatagaaatggccagaagcaaagaagataagccaacaagaaaaatgtctcgtaaaagccgcttagagaaactctataccgacagtaagaaacaatttattaagctattcggaccagatgaatatgacaaactaaacaatgaaattaaaaataaaagcgaaagtgactttagatgggacaatctttacctctactatacacaatttggcagatgcatgtatagcctagatccaattgatttagaagaactgtccaacaaaaatttatacgaccaagaccacatatatccaaaatcaaagatatacgacgattccatagaaaatagagttttagtaaaaaaacaactcaatctagataaaagcaatgaatacccaataccagatcgagtattgaacaaagataagaataaactattagcattttggaaaatgttaaacgaaaaggaattaataggagacaaaaaatatgcaagactaataagaaaaagccccttcacagacgaagaactgggggatttcatcgccagacaactggtagaaacacgacaagcaacaaaagagaccgcaaatatgttaaaacgcttatgccccgacagtaaaatagtatatgttaaagcaaagaatgtaagtgacttcagaagaaaatttgacatcttaaaatgcagatcaatcaatgacctacatcatgcacatgacgcgtacttaaacatagtggtagggaacgtattcgacacaaaattcacaagcaaccctctaaactttataaagaacaattcgaaaaacaggagttataatctagaaaaaatttacgattatgatgtaatacgaaatgaaaaaatcgcatggttagctgaaagaaaagaagaaaaccaagacggctcaatcgcaaccgtgctcaaaaacttatccaagaacgatataagagtaacacgacgaacgtacatcaaatgtgaggatctattcgatgaaaatatcgtgcgaaaaggcaatggaaaattcccaataaaagaaaataataataaatcagataccaataaatacggtggatactcaggaatcaaaaatgcatactttgtcttactagaagacgaaaaacataacagaattctagaagctatcccatcattcatatacaaaaaagagaaaaacggcgaaaaaggctcagtcattaactacttgcaaaacatattaggaataaaatccgcaaaaatcctaagagacaaaataaaaatcggaagcttgctcaagatcgacaaatttccctacaacctagcaggaaaatccggaaacggcatccttatatcaggcggagtacaacttatactcgacaagaacactagcaaatacataaaaaaaatcgaaaattacaaatacaaactcgatgaaaacaaggattaccagatcaatatatttgataagctaagcaaagaggaaaacattaaattatttgacctattcgtagataaatttgaaaacagcatatacaaaaatcgcgtaaacattaagttaaaggagataaaactcgcacgccccaaatttgaacacttatctatagaagaacaaataaaaacattaacacaaatgttaatattattcggaagagaaaataatgctgtaaatcttgaatacattggattgccaaaaaacacaggaaaaacaaagataaacaaaaaaataaataacaaggacatcaaaataatcaatcaatcaataaccggactatacgaaaccgaagaagacctagctaacatctga

SEQ ID NO: 5384 - RNA, 4086 nt, synthetic construct
  misc_feature 1..4086: note = Cas9 variant
  source 1..4086: mol_type = other RNA
atgactaaattaaatcaaccttatggcattggtttagacatagggagcaacagcattggatttgcagttgttgatgcaaacagtcatctattacgactaaaaggagagactgcaatcggagccagactcttccgagagggacaatccgcagcagaacgaagagaatcacgcacgacaagacgaagattaagcagaacacgatggcgtctctctttcttgcgcgactttttcgcaccacacataacaaaaatagatccagatttctttcttagacaaaaatacagtgaaatcagtccaaaagataaagacagatttaagtacgaaaagagattgtttaatgataggacagatgctgagttctatgaagactacccaagcatgtaccatttaaggctacatctaatgacacatactcataaagcagatccacgagaaatattcttagccatccaccacatactaaaaagtagaggccacttcctaacacccggagcagcaaaagacttcaacaccgacaaggtagatctagaagatatattcccagcattaacagaagcctatgcacaagtttatcccgatctcgaattaacgtttgacctagcaaaggctgatgatttcaaagcgaaattactagatgaacaagcaacaccgagtgatacgcaaaaagcgctagtaaacctcttactatcaagtgatggagaaaaagaaatagtaaagaaaagaaaacaagtacttacagagttcgcaaaagctattactggattaaaaactaaattcaatctcgcattagggactgaagtagacgaagctgatgcttctaactggcaatttagcatgggacaactggacgataaatggagtaacattgaaaccagcatgacagaccaaggtacggaaatatttgaacaaatccaagagttatatagagcccgactgctcaatggaatagtacctgcagggatgtctttaagccaggcgaaagtagctgactacggacaacacaaagaggatttagaattgttcaaaacttatttaaagaaattaaatgatcacgaattggcaaaaacaataagaggactatatgatagatatattaacggagatgacgcaaaaccatttctgagagaagactttgttaaagctctaacaaaagaagtaactgcacacccaaacgaagtttcagagcaactattgaaccgaatgggacaagcaaactttatgcttaaacaacgtacaaaagcaaacggtgctatccctgtgcaactccaacaaagagaactagaccaaattattgcgaaccaatccaaatattacgactggctcgcaaaaccaaaccccgtcgaaaaacatagagcatcgaaaccataccaattagacgaacttctaaccttccgaatcccatactacgttggcccactcataactccgaaagaacaagcagaaagccgcgaaaacgtgtttgcgtggatgataagaaaagacccatcaggtaatattacaccgtataattttgacgaaaaggtcgattgtcctgctagcgctaacatgttcatacaaagaatgaaaaatacagatacatatttgattggcgaagacgtactgccaaaaagatccttactctaccaaaaatatgaagttctaaatgaactgaacaacgtctcaatagacggtaggagattaggagcagatcaaaaacaaagattaataagagaagtattcgaacgccactccagtgtcacaataaagcaggtagcggaaaatctagtagcgcatggagacttcgcaaaaagaccagagatacgaggattagccgacgagaaaagatttctatcatcccttagtacttaccatcaactaaagaaaatactacatgaagcaatcgacgatcctacaaaagaacacgacatcgaaaacatcataacatggtcgacagtgtttgaagacgcagccatatttaaaaccgaattagcaaaaatatcctggctcgactctgacactatcaaagcattaagcaacatccgatacagaggctggggacaattctcaagaaaattgctagacggcctaaaactaggcaatggacataccgtaatccaagaactaatgcttagtaatcataacctaatgcaaatattgaccgacgaaacactcaagaccacaatggcagaattgaatcaggacaaattaaaagcagatgacatagaagacgtcattaatgatgcatatacctcaccctcgaataagaaagcattacgacaggtattaagagttgtagaagacataaaacacgcggcaaacggccaagatccaagctggttatatatagaaactgctgacggaccaggaacggccggaaaaagaacccaatcgagacaaaaacaaattcaaaccgtatatgcaaacgcagcacaagaattaattgactccgcagttagaggtgaactggaagataagatcgcagacaaagcatctttcacagatcgtctagtactatacttcatgcaaggaggaagagacatatataccggtgcaccactaaacatagatcagctaagtcattacgacatcgatcacattcttccacaatcattaattaaagacgattcactcgacaatagagttctagtaaatgcaacgataaacagagaaaagaacaacgtgttcgcctccacactatttgcaagcaaaatggcggcaacctggcgaaaatggcacgaagcagggcttataagcggacgaaaactaaggaaccttatgttaagaccagacgaaatagataaatttgcacatggatttgttgcaagacaattagttgaaacacgacagatcataaaactaactgaacaaatagcagcagcccaatatccaaatacaaaaataatagcagtgaaagcaggtctaagtcatcagttacgagaggaactagactttcctaaaaatagagatgttaatcactatcatcatgcctttgacgcatttcttgccgctcgcatcggtacctatttattaaaaagatacccaaaacttgcacctttctttacatatggtgagtttgcgaaggtagacgtgaagaaattccgagagttcaatttcataggagcactaacccacgccaagaaaaatattgttgcgaaagatacaggtgaaatagtctgggataaagaacgggatatacaggaattagatcgaatctataactttaaaagaatgttgattactcatgaagtatattttgaaacagcagaccttttcaaacaaacaatatatgcagccaaagatagcaaagaacggggtggaagtaaacaactaatacctaagaaacaaggatatcccacgcaagtatatgggggatacacaagagaaaacacagcatatctagcagttgtaaaaaccgtcgaaaagaaagccgacgtgtatcgagtcgttcgaatcgccacatcacaggtcgctgcattaaaagaagccagagcccaatcaacagtaaaagaacgagaattgctaaagaaattcttaacgacaaaatttacaaaaatcggcaaaaatggaaagaaagccataaccccattcgatatcgtaattccgcgtgtgcctagagaacaattatttcataataaaaggtatgggttctttatggtaaatagcgacaccttaatgcataactaccaggaattatggatgagccgatcggaccaacaaatcttgtcgaaactcgtaaaatctgcaaaaactgttgaaaatggtcaagtaggcagactatttgaaaacatagttgaacaaattaacaaatactttccattatatgatataaatcaatttagaaagaaattagaccaaagcaaagacatattttccaaattacccctagaaggcaatggaacaacctctggtaaaagggaaactattcaaaacatattaaccggagcaggaacaggagccaaaaatggtgacctcaaaaacctcggtataaaaacaccatttggatttctacaagtccccagtggtattgtgttagatgacgacacaacactaatataccaaagcccaactggcatgttaaaccgaatagtgagactctcagaattatga

SEQ ID NO: 5385 - RNA, 4086 nt, synthetic construct
  misc_feature 1..4086: note = Cas9 variant
  source 1..4086: mol_type = other RNA
atgaaaaatgaagaaaacatatatcttggactagacataggaacagattcagtaggatacgcagtaacagatgacaaatataaaataatgaaataccatggaaacgcagcatggggatccacgatatttgacgcgggagcattgggtgcagatagaagagtatttcgcagtgcaagacgaagacttgacagaagacaagaacgtattcaattgctacaagaaatatttgcaaacgagatcgcaaaagtagacgaaagattctttattagacttctagaatctgggctatggagagcagacgccgaagataggtacgtattcttcaacgacaaagaatacaccgacgtgcaatacatgagagactacccaaccatacaccacctaatttgtgaactaatatacaacccaaataaacatgatgttaggttagtctacttagcatgcgcatggctagtaactcacagagggcacttcttaagtaacataaatactgaaaatatagccgatttagtagatatacataacgtatataacggatttatgagattctttgaagaaaacgaaataatatgcgactggagggaagttaatgtcgaagaactaggtagagttcttgcagcgaacataggaataaatgaaaaatacagaaacttaagtacagtactctttgctactagaaaaccggacaagaaagcaaaagaaggattcccctactccgaagacgctatagttagattgctagcgggaggaacatgcaaattaaaagatgtatacataaaagaagaatatgatgaatttggatcaataacattaggaatggacgacgagaaaatgaccgaaatcatggccgacataggagacgacttcgatctaataaaagcactacgatccctatatgactggggaatactagcaaacattttagtaaatgaaaataacagcccattaataagtcaatcaaaagttaaagtatacgaacaacaccgagaagacctggccaaccttaaatatttagtacacaaatatattccccacaaatacaacgaaatctttcgcgaaatccgaggtgataactatgtagcatactcctatcattacgagcttaaaaatgacgagaaaatgggtaagaaagcagacgttgaaaaattttcaaaatttctactaaaaatactggaaggaatatcagttgatgaacaagacaaagtcgtatatgataatatgatcgagagacttaccttaagactatttttgccaaaacagaaaaacactgacaatagagtaataccacatcaattgtatgaatacgaattaaaatctattctcaaaaataccaaaaattacttaccctttttgaaagaaaaagacagtgacggaataagtaatgaagacaaaatcataagcatattcaaatttaaaatcccatattttgtagggcctctaaattgtaattcacaattcgcctggatacaacgaaaagcagacggtaaaatatttccatggaattttgaagataaagtagactttgatgcatctgaacaagcctttatccaaagaatgaccaatcaatgtacctatttacccgaagaaagcgtactaccaaaacaatcattatactatcaaaaattcatggtacttaacgaaataaataacataaaaatcgacggaagaaaaatatccgtcgccatgaaacaagaactgtacaatgaaatattcgagaaaaagaaacgcgtcaggaagaaagatgtaatagacttctttgttagcaacggatacctagaaggaggaaaagaagcattgatatcgggactagacgaacaaatacacacaaacctaagcagcttccacgctttccgaagattactacaaaaccacatattatcagtagaagacgtcgagagcataatcgagcgagcatcatattccgatgacaaacgaagggttttattattcctcaaaaataaatactctttcctcacagacgaagatattaaatatatctgtaaaatcaaaataaaagacttcggacgattatcgaagaaatttttagttgactttgagggtacatgtaaagaaacaggagaaatcagtacagttttgcggcttatgtgggaaacgaataacaatcttatggaattactgtcagacaaatacacgtttgccaatggaataaaagaaaatagaaagaaatattatacagaacaacagaaaacgctcgatgatcgtttagatgaaatgtacatatcaaatagtgtgaaaagaacaatatacaggactctcagcgtcgtaaaagacgtaacaaaagccttcggagtccccaagaaaatattcgtagaaatggccagaactaataacccagacctgaaaggaaaaagaactcgaaccagacaacaacaagtaatagaactatacgcaaaatgtgacgaagaagacgtaagagaattaaaacaccaaatggaaagtctaggagaatatgtagataacaaactacaatctgataaattgtttctatattttatccaattcggcaaatcagcatattctggtaaaatgatagacctcgaaaaactgatgagcggatctaaagtttacgacatagaacacatatatccacaagcatacgtaaaagacgacagcatcataaataataaagtcttagtattttcagaagagaacggagcaaaacaagacatctatcctataaaaaccgaaatacgaaaacaaatgagcgggatatggaccacttggcaccatgttggtgcaatttccgatgagaaatacaaacgactgacccgctcaaccccgtttaatgaagatgaaaaatacggctttataaatcgacaactaactgaaacaagccaatcaacaaaagcaatagcacaaatccttaatgaaaaatacccagaaactgagatagtatacgtcaaagctggcctagtaagtgacttccgacatgaatttggcctttgtaaatgtaggagctacaatgatttacaccacgccatcgacgcatacctaaatgtcgtagtaggaaacgtttacaacatgaaatttaatcgaaaatggttttcagttgatagtaaatattcaatcaaaacaaaaacaatctttagccacagcctagtatgcaacggaaaaataatatgggataaggagaaaatgctacccatggttctcaaaaatgctaagaaaaataatgcccacttcacaaagtaccaatttatgaaaaccggtggatttttcgaccaaatgccctgcaaaaaggcatccggcctagtcccgcgaaagaaaggattagatacagaaagatatggaggatataataaatcagggataatgttcctaacaccaatgcgttataaaatagggaagaaatcagacataataatactaagcatagagttactctatggtaaattattcctaaaagacgaagtatttgccaagaaatatgcggaagagagactacagaaaataataggcaagaaagcagatgaagtatcatttccaatgggaatgaaaccttggaaaataaacacagtcttatcattagatggcttcaatgtttgcataactggcataggtggcggaggcaaatgcctcagtgcacaacctatcatgcaactttccctgccatacgaactagcaaaatatttgaagaaaatagaaaaattcgtagagaaaaacaaaaataacgcaaattatatatatgatgaacaatatgattcagtctcagttgatgaaaacataaaactttatgatgtctacctcgataaattagaaaactcaatatacaacaagagaataaacagtccagaagcaattctcaaaaatggaagagaaaaattttgtaaactaaacgtattagagcaagcagtaaccttaataaatatccaatcgatctttggccgaatgacaggtggatgcgatctagaaaatataggaggcaagaaacattcagcagccacagtaaatttttcatcaaatgtttccaactggaagaaatactataacgatgtaagagtcgtatatcaaagtcctagtgggatatgggaaagaagatctcaaaacatactagaacttctttga

SEQ ID NO: 5386 - RNA, 4086 nt, synthetic construct
  misc_feature 1..4086: note = Cas9 variant
  source 1..4086: mol_type = other RNA
atgaacgaaccctatggtgtaggtttagacataggtactaatagtgtaggatggactgtagttgatatgaacggaagagttagaaaagtaaaaggtaaaacagcgctaggagcacgcctctttaaagaaggtgcaactgccgaggaccgcagaggcttccgaacgaccagacgaagactaaaacgcgtcaagtggagattacggcttttgcgagaattttttgaccaaccaatatcaaagatagatccaaattttttcgctagacgaaaatactcagatatatcaccaagagatcccaattacaatggtctagcaaaaactctcttcaatgatcgaactgacaaggaattttacgatgattatgctacaatctatcacttaagagacaaattaatgacatccaacagaaaatttgacataagggaaatatatctggctatacatcatatagttaaatatagaggaaacttcttacgcacaggaccagcaagccaatatggctccgcctcactacacctagcaacaagttttcaaaaactaaacgatctgttcgctcaaagcgaagaaactcttaatctaaaattggtgacagatgaagcattattacaacaaatacaacaaatactcgtaagaactgatttaagtagaagcgaacaacaacgacaaatctggcccctgatggctgtcctaaccggagcctcagcagcggagaaaaaaagacaaaaaaacgttgtagtagagcttagtaaagccttagtaggactaaaagctaagatgaatgtggtaactttaactgaagttgacgctgcagtagtcaaagattggacgttcaccatggaagaaagccaagacaaattaccggagattgaagaacaactaagtgaagtcgggcaacaaataatggatgaggtcatccaattgtatgcatcagtaaatctagctcagctaataccagctggtaaacgatttagtcaacatatggtagaaaaatacaaacatcatgaaaaaaacctcgaactacttaaagcatacatacattcacaatccgacagcaagaggggccgggaaatcagagccacctatgatcgatatattgatggcgtagattctaaaccagtaactcaagaaatgttttataaggatttgatgaaatatgtagaagccgatgcgacctctaaccacctcgcagctgagataaaagacgaaattgatagtgaacaattcatgcccaaattgcgaaccaaacaaaatggttcgatcccctatcaggttcagcaatatgaactcgaccaaataatctcacaccaaaaaaaatattatccctggctaggagaagaaaatccagtggcagaaagaagaggcaaatttccgtataaacttgatgaactagttggatttagagtaccctactacgttggaccactaatcacaaaggaagatcaacaggcaacatcaggagctggatttgcatggatggttagaaaagcagatggaccaataacaccctggaacttcgatcaaaaagtagatagaattgcaagtgcaacagcctttatacaaagaatgcaaacaacagatacatatctgattggcgaagacgtactaccagcacgatcacttatttatcaacgatttatggtactcaatgagttaaataacatgagagttgaagacagaaaacttgccccccaacaaaaacagaggttatataaccaagtatttaagcaacaccaacacgtatcagtaaagaacatacaacaaaacctaatggatgccggggaatatagaaaaactccccaaataacaggccttgcagatccaaagggatttaactcttctctcagtacataccacgacttcaagaaaatacttcttgaggcaattgctgacgaacataaaagagctgatatagaaaaaataatactatggagcaccacatttgaagattctgcaatattcaaacaaaaactagaagaagttgcatggctaacagacgcacaaagaaaacagttatcgggcttaagataccgcggatggggtcaactaagtcataaacttctaacagcatttaaagatgataaaggcagatcaattatggatggactgtgggaaacttctgataattttatgcaactcagaaaacagccagcaatagaaacacaaataaaagaagcaaatcaggcaaacttaactgacgccgatatccaagatactataaatgaattatatactagtccgcaaaataaaaaagccatcagagaagtcatgctagtattagacgacataaaaaacgcaatgcacggccaaacacccagttggatctttgttgaggctgctagaggaggaggagtagcaggccgaagaacacaatcccgaagctctcaaatagtcgaagcatataaaggaaccgcaaaagaaattgtgtcagaaaaggtacaacacgaattaaacgaaaaaattaaagccaaagctgatttcaacaccaggctcgtattatattttttgcaaaacggtcgagatctatacacaaacgaagcaataaatatagataggctttcagaatatgatatagatcacattttaccacaatctttagtgaaagatgactcactagacaatagagtcctcaccagtgcacgaatcaatagagaaaaaaatgacacatttgcatcagaaaaatttgggagaaaaatgggtgcacaatggagagaattacatcgaaatggcctaatgacacaaagaaaattaaaacatctattgatgagacctgacgaaataagcaaacatgccacagatttcataaatcgccaacttgttgaaacacgacaagtaattaaacttgtcgaagaactcatatcaagcgaataccctgctgccagtattgtagcagttaaagctaacctaacgcaccaatttcgtcaaacctttaattttcctaaacttagagaagtcaacgattaccatcatgccttcgacgcttcactgacggctttcataggaatgtacctattaaaacaatatccgaaactcgaaagattcttcgtatatggaaaatttgctaaacaaccaatcaacctaactagatttaatatcatacggaaacttgccgtcgcagagaaaccaatcgccaacatagagacaggcgagatattatgggataagacagcagacattaaatacttcgaaaaactttacaattataagagactactagtcacccacgaggtaagagaaaactacggagctatgtttaagcagacattattcaaagcatcatataacaaatccaaaactttagtaccaaaaaaaaatcacatggaaacctccgtctacggcgggtactcaaaccaagaaacggcatacttagccatcgtacggataccctttaaaagtggattcaagtttatcgtagtcggaataccaacaagaatggtagctaaaatcaaacattatcagtcactaggggcaactctcaatcaagcaacccacaaagtaatagaaccaaaattcacaaaaatttctagaaaaacaaaacaaacagtgataagtgattatgaggttgtcctaccaaaagtttatcttgaccaagtagttcgcgaccaagtaaaaggtcaaatgtatcgattctctttgggttcggataaagaataccataacgtacaagaactatatttacctctaagcatacaacaagctttcgttggacattacgatgaatcggacgatcaacgatcaaacgacctagtcaaagtttacgacgcagcattaaaacaactccaacgatatttccctttacacttatccaggaactttgatcaagtagcctcgcaggcgcaccaatcgttcgagggactaaaaaataacgtacaaacaagtgataaacaattaggtaaaaaggaagtactaaattcactatttgtaggtctacacgctaacgcaacaaggtctaatctatcagtcctaggtatgagtaaagacttcggccgcattaaaagtaatggcattacactaactgaccaagcagaaattatttatcaatcccctacaggattgttcgaacgcaaagtcgcattaaaagatttatga

SEQ ID NO: 5387 - RNA, 4086 nt, synthetic construct
  misc_feature 1..4086: note = Cas9 variant
  source 1..4086: mol_type = other RNA
atgggaaattattaccttggccttgatatcggaacaaatagtgtgggctgggccgtaactgatgaaaactacaacatagagagattcaagaaaaaaaatatgtggggaatcagactatttgatgaagcaaaaactgctgaatcaaggcggatacaccgacaagcaagaagaatgagacaacgaaaaattcaaaggttaaatctcctcatggaattatttgatgtcgaaatctcaaaagttgacgaatccttctttatccgcaaaaaagaatcagatctccactatgaggataaatctcaagactcccgctacgccttattcaacgataaagaattcaacgacaaagattaccacaataaatatccaacaatcttccaccttataatggaccttatagaaaatgatgaaaaaaaagacatcagattactctacttagcctgtcattacctaataaaaaatagaggtcatttcatattcgagggacaaaaattcgatgtaaacagtagcctcaataacaatatcaacaaacttaaaagccacctcgatcaattctacaatatatgccttgacttcgacaacgataaactcatcgaaatactcgtcaaccagaacctaaacataagtgaaaaatcaaaaaaaattaaagaattactaagaaaaacaaacctggaagtaggcattgcgaatctgattgccggcggctccataaaactgagcaatatgttcgacgacgacgaactcaaaaacttcgattataattccctatcatttaaaaattccaacttcgacgaaggtagagaactattcgaagaagttttagaagatagattcgaattagtggaaatactaaaagatattcatgatgcatctgtactagaaacaatgttgtcatctgccagcatctctcctgatggaggaaaatatatatcttcatcaatgattaattcatacaacaaacacaaacgagacctaaaactacttaaaaagattataaagaaatataaaaagtccgaatacgataatatatttcgcgacgaaaacataaaaaacaactacttatcatatacacgtacaggaataaataagaataaaaaagtccaagcaaaagacaatactgatagcgacggcttttataaatacattgttaaaattttaaaagatatcaaagaaaatgactcagatgaagacatcaaatacatattgtcagaaatagacaagaaaaacttcgttcctaaacaaagaactaaagaaaactctgtaataccatatcaactaagggaaatagaattacggaaaataatagataaccaaagcaaataccacaaatttctaaacgaagttgatgaaaaaggaataagcgtaaaagaaaaaataatagcattactaacctttcgtataccatactatattggtccactaaatccaagctataatgaagaaaaaaattttactactagctgggtaaaaagactcgcaaaagggaaggtgacaccctggaacttcgaagacatggtcgatattgatgcgagccgcgaggctttcatagaaaataaactcaacaaatgtagcttcctcctcgacgaaacagtattaccaaaagactccttactatatcaagaatacatggtattaaacgaactaaataatttaaaaattaacggtcaaagcatcaacaccgatcttaaaaaatcaatatatgaagaactttttaaaaaatacaagaaagtaacaagaaaacgacttatttcttacataaaagaaaaagaaaatactagtggagacatagttataacaggtatcgatggagatttcaaacagggactaaaaagctacatcgcatttaaagaaataataggcgaaaaaatcgataatgatatctatagaaaagaagtcgaaaaaattataagagacatatcactgtacggggacgacaaaagcttcatacagaagaagataaaaaacgaaaacaaacttgacctatctgacaaccaaattagcaaaatagcaaagctaaagttcaaagactggggtagattcagcaaaaaactactagtaggaatcaaagcaagcgacaaaaacacaggtgaaattgacaatattattggcttcatgaggaattataattataatataatgcaacttatggcgaatgttttcacattcaaggatgaaattgaaaaactaaattcaaaatattacacttatgaaaaaatcaacgtagattatctcgatgacctatatctctcagctcccgcaaaaagaatgctatggcaaagttttcaaatcgtagatgaaataaagaatataaaaaactctgcacccaaaaaaatatttattgaaatggcaagatctaaagaagacaaacctacaagaaaaatgtctcgaaaaagcagattagaaaaactttatacagacagcaaaaaacaattcatcaaactattcggtcccgacgaatacgacaaactaaataacgaaattaaaaacaaatcagaatccgatttcagatgggacaatctatatctatattacacacagttcggcagatgcatgtattcattagacccaattgatctagaagaattatcgaacaaaaatctatacgatcaagaccacatataccccaaatccaaaatatacgacgacagtatagaaaatcgtgtattagttaaaaaacaactaaatctagataaatcaaacgagtacccaatcccagacagagtgctaaacaaagataaaaacaaacttctcgcattctggaaaatgctgaacgagaaagaactaataggcgacaaaaaatacgcccgacttatccggaaatcgccatttacagacgaagaactcggagatttcatagcaagacaattagtagaaactagacaagcaaccaaagaaacagcaaacatgcttagacgcctctgcccggactccaaaatagtctacgtaaaagctaagaatgtttcagactttagacgaaaattcgatatattaaaatgcaggagcatcaacgatttacatcacgctcacgacgcctacttaaacatagttgtaggtaacgttttcgacacaaaatttacatcaaacccattaaatttcatcaaaaacaactcaaagaacagaagctataacttagaaaaaatttacgactacgatgtaatacgtaacgaaaaaatcgcttggctagcggaaagaaaagaagaaaatcaagatggctcaatagctactgtactaaaaaacctgagcaagaatgatataagagtcacgcggagaacatacataaaatgcgaagatctattcgacgagaacatagtccgtaaaggcaacggaaaattcccactcaaagaaaacaacaacaaatcagataccaataaatacggaggctactcaggaataaaaaacgcgtacttcgtactcctcgaagacgagaaacacaaccgcataatcgaagcaataccatcatttatatacaaaaaagaaaaaaacggagaaaaaggttctgtcataaattacctacaaaacatattaggaataaaatcagccaaaatattaagagacaagataaaaataggatcactattaaagatagataaattcccatacaatctagctggaaaatcaggaaacggcattctaattagcggaggagtacaactaatactagataaaaacacctcaaaatacattaagaaaatcgaaaattacaaatacaagttagacgaaaataaagattatcaaataaacatatttgacaaattaagtaaagaagaaaacattaagctcttcgacctatttgtagacaaatttgagaattcaatttataaaaatcgcgtaaacataaagctaaaagaaattaaacttgcccgaagtaaattcgaacacctatcaatagaggaacaaatcaaaactctaacacaaatgctaatactcttcggtcgagagaacaacgcggtaaatctcgaatatataggactcccgaaaaatacggggaaaacaaaaatcaacaaaaaaataaataataaagatatcaaaattataaaccaatcgataaccggattatacgaaacggaagaagacctagcaaatatatga

SEQ ID NO: 5388 - RNA, 4089 nt, synthetic construct
  misc_feature 1..4089: note = Cas9 variant
  source 1..4089: mol_type = other RNA
atgaaaaaaccatatagcataggtctagatataggaacaaactcagtcggatgggcagtaatcacagaagactacaaagtaccagccaagaaaatgaaggtattaggtaacacttcccgagattttattaaaaaaaacttattaggtgcactattattcgacagcggcgaaaccgcagaggccagaaggcttaaacgaaccgctcgccgaagatacactagaagaagaaaccgattaaggtacctacaagagatcttcttagatgagatgaacaaattagacagcggtttctttcacagattagacgatagtttccttgtacccgaagaaaaaagaggctccagataccctatatttggaacattacaagaagaagtaaattaccacgaaaatttcccaactatatatcatctgagaaaaaaactagcagactccaaagaaaaagcagatctgcgattaatctacttagccctcgcccacatgattaaatacagaggtcattttctatatgaagagtcatttgactccaacaacaatagcatacaagaaattttcaatgaatttacagctgaataccataataccatagaaggctcttgcttgtcgggccagatcgaacaagtagaagcaatcttaacagataagattagtaaatcagctaaaagagaaagaatcttaaaacttttcccagcagagaaaagtacaggcctattcagtgaatttcttaagttgattgtaggaaaccaagcagactttaaaaaacatttcgacctagaagaaaaaacaccgttacaattctcgaaagatacctatgaagaagacctggaaaatttattagaacaaataggtgatgaattcgccgatcttttcctattggctaagaaactttacgacgcaacacttctagctggaatcttaacagccactgacgtatccacaaaagcaccactttccgcctccatgattaacagatatgaaacacaccaacaagacctcgcagcacttaagcagtttataaaaaataaactccctgaaaaatactccgaggtctttagtgatctgtcaaaagatggatacgcgggatatatcaacgggaagacgacgcaagaagcgttctacaaatacataaaaaacttactaattaaattcgagggggctgtagactttctggaaaaaatagaaagagaagattttttacgaaaacaacgaactttcgacaatggaagtataccacatcaactacacctacaagaaatgaacgcaatactaagacgacagggtgatcattacccattcctaaaggaaaaccgagaaaaaatagaaaaaattctaaccttcagaataccatactacgttggcccactcgctagaggcaatcgcgatttcgcatggctaacacgaaacagtgaccaggcaatccgaccgtggaattttgaagaagtcgtagacaaaacctcatcagcagaagactttataaacaaaatgacaaattacgatctatatcttccagaagaaaaagtgctaccaaaacattcaatactatatgaaacattcgctgtatacaatgagttaactaaagtcaaattcatagccgaaggcctaagagactatcaatttctagacagtggacaaaaaaaacaaataattaatttactctttaaagataaaagaaaagtcacagaaaaagatataatacactacctacatacagtggacggatatgacggaatcgaattaaaaggtatagacaaacaatttaacgcatccctctcaacataccacgatcttctaaaaataataaaagataaggattttatggatgatgcagacaacgaagcaatactagaaaacatagtacacacattaacgatcttcgaagatcaggagatgataaaacaatcactagcccaatacgatgctatatttgatagaaaagtaatgaaagccctcacacgcaggcattacacaggatggggagaattaagcgcaaaattaataaacggcattagagacaaacaaactggaaaaatgatattggaataccttaaagatgatggtgaaataaacagaaactttatgcagttaatcaacgacgattcgctatcatttaaagaaacaattcaaaaggctcaagtaatcggcgaaacagagaatatcaaacaaatagtacaagaactccctggatcacctgccataaaaaaaggaatacttcaatcgatcaaaatagtagatgaactagttgaaataatgggttataatccagaatccatagtagtagaaatggcaagagaaaaccaatttacaaaccaaggaagaagaaattcgcaacaacgacttaaaaaactcacagactcgataaataaactaggctcaagtatattagaagaacaccctgtagataacagtcagttgcagaacgataggctctttttatactatctgcaaaacggaaaagacatgtacaccggagaagcgcttgaactctcaaaattatcgtcgtatgatgtagatcacataatacctcaagctttcataaaagacgactcattagataatagagtattagtcagttacgcaaaaaatagagggaaatcagatgatgtcccatcattagaaatcgtccaaaaacgaaaagcattttggaggcaactattggacagccaactaatttccgagcgcaaattcaataacctcaccaaagccgagagaggcggactaacagaagacgacaaagcaggctttatcaaaagacaactagtagaaacaaggcaaataacaaagcatgtggcccaaatcttagacgcacgattcaacactgaagtgacagaaaaaggcaaaaaaaaaagagccgtaaaaataataacacttaaaagcaacttagtaagtaatttccgcaaggactttgaactctacaaagtacgcgaaataaatgattaccaccatgcgcatgacgcatacttaaatgccgtagtaggaacagcactcctaaagaaataccccaaactcgagccagagtttgtttacggagactacccgaaatacaactcctacagagagagaaaaacagctaccgaaaaagtatatttctacagtaatataatgaacttcttcaaaactacagtaaaactcgcagatggctcagaaaaaaaaagacatcaaatagaaactaacgaagaaacaggagaaatcgtatgggataaaacaaaacatttcgaaatagtcagaaaagttttatcgtatccacaagtaaacatcgtaaaaaagacggaagagcagactgttggccaaaacggtggacttttcgacaacaacattgtatcaaaaaataaggtagtagacgcaagtaaactaataccaataaaatcgggattatcaccagaaaaatatggcggctacgcacggcctacaatagcatacagtgtccttgtaattgcagacatagaaaaaggcaaagcaaaaaagctaaaacgaataaaagaaatggttggcatcacgatacaagacaaaaaaaaattcgaggcaaaccctattgcttacttagaagaatgtggattcaaaaacataaattccaaccacataatcaaattacccaaatacagcttatttgaatttgacgacggtcaaagaaggttattagcatcctcgatagaacttcaaaaaggcaatgaattaatactaccttaccatctcacagcactattataccatgcccaacgtataaataaaatttcagaaccaatacataaacaatacgtagaagcacaccaaaacgaatttgaagagcttctaactacaataatctcactaagtaaaaaatatatacaaaaacctaacgtcgaaagcctactccaacaagcctttgaccaaactgacgaagacatctaccagttaagcgaatcatttatatcacttctaaaattaatctcattcggggcgccaggtgcctttaagttcttaggggtagacattagtcaatcaaacgtgagataccaatccgtgagttcttgttttaacgcaactctaatccatcaatcaatcacaggattatacgagacaagaatcgatctttctaaattaggagaagactga

SEQ ID NO: 5389 - RNA, 4089 nt, synthetic construct
  misc_feature 1..4089: note = Cas9 variant
  source 1..4089: mol_type = other RNA
atgaacgaaccgtatggagtaggcctagacatcggcacaaatagtgtgggttggaccgtcgttgatatgaatggcagggttagaaaagtcaaaggaaaaacagctttgggtgctagattatttaaagaaggagcaacagcggaggacaggagaggattccgaacaactagaagacgactaaaaagggttaagtggagactcagactccttagagaatttttcgaccaacccatatcaaaaattgacccaaactttttcgcaaggcgtaagtatagcgatataagcccgcgtgatccaaattataatggattagccaaaaccctgtttaatgatcgaacagacaaagagttctatgatgactatgcaacaatctaccacctaagagataaattgatgacaagtaacagaaagtttgatataagagaaatatatcttgcaatacatcatatagtgaaatacagaggtaactttttaagaacaggcccagctagccaatatggatcagcatccctccatctcgctacatcctttcaaaaacttaatgatcttttcgcccagtcagaagaaactttaaatctaaaattggtaaccgatgaagctctattacaacaaatacagcaaatattggttaggacagatctttccaggtcagaacagcaacggcaaatatggccgttaatggcagtactaaccggagccagtgcagctgaaaagaaacgccagaaaaatgtagtggtagaactatccaaagcgctagtgggactcaaagcaaaaatgaatgtagtcacactcaccgaagttgacgcagcagtagtaaaagattggacattcacgatggaagaatcacaagacaaattaccagaaatcgaggagcaactctcagaagtaggacaacaaataatggatgaagttatacaactttacgcatccgttaatttagcacaattgattccagcaggaaagcgattttcacaacatatggtagaaaagtataaacaccatgaaaagaacctcgaattactcaaaacatacattcattcgcaaagcgatagtaaaagagggagagaaataagagccacatatgacaggtatatagacggggtagactccaaaccagttacacaggaaatgttttacaaagatctaatgaaatacgtcgaggcagatgccacatcaaatcatttagcagccgaaataaaagacgagatagatagtgaacaatttatgccgaaactacgcacaaaacaaaacggttcaataccatatcaagttcaacaatatgaactcgatcagataatcagtcatcagaagaaatactatccatggttaggagaagaaaatccagtcgccgaaagacgcggaaaatttccctataaattagacgaattagtgggctttagagttccatattatgtaggaccattaatcacaaaagaagaccaacaggccacgtctggagccggattcgcatggatggttagaaaagcagatggaccaataacaccatggaactttgatcagaaagtagacagaatcgcatcagcaactgcatttattcagcgaatgcaaacaacggacacatacctaataggcgaagacgttttaccggcaagatcacttatataccagagatttatggtattaaatgaacttaataacatgcgcgtggaagatagaaaactagctccccaacaaaaacaaaggttatataaccaagtattcaaacaacaccaacacgtatcagttaaaaacattcaacaaaacctcatggatgcgggtgaatatagagaggcaccgaaaatcacaggcctggcggacccaaaaggatttaattcaagtctcagcacctaccacgacttcaaaaagatactgccagaagccatcgcagatgaacataaacgagcagatatagagaaaattattttatggagcacaaccttcgaagattcagctatttttaaacaaaaactagaagaagttgcatggctaacagatgcgcaaagaaaacaactatcgggcttaagataccgtggatggggacaattatcacataagttactaatagcgtttaaagatgataatggaaggtccattatggatgggctatgggaaacatcagataacttcatgcaacttaggaaacaaccagcaatagaaacgcaaataaaagaagcaaaccaggcaaacttaacagatgcggatattcaggatactattaatgaattatatacatcaccgcaaaacaagaaagcgataagagaagtaatgcttgtcctagacgatattaaaaatgcaatgcacgggcaaactccttcatggatttttgtagaagctgcaagaggcggcggagtcgccggacgaagaacacaaagtaggtccagccaaatcgtagaagcctataaaggaacagcaaaagagattgtgtctgaaaaagttcaacatgaactaaatgagaaaattaaagccaaagcagacttcaatacgcggttagttctatattttctacaaaacgggcgagacctttacaccaacgaagcaataaacatcgatcggctatccgaatacgacatagatcacatattacctcaaagtctagtaaaagatgattcactagataacagagtcttaaccagtgcaagaataaatagagaaaagaacgatacttttgccagtgaaaaatttggaaggaaaatgggagctcaatggcgagaactacaccgaaacggcctaatgacacagagaaaacttaaacacttactaatgagaccagacgaaataagtaaacatgcgaccgacttcatcaaccgacaattagttgaaacaagacaagtaattaaattagtagaggaacttataagttctgaatatccggcagcgtctatcgtcgcagtaaaagcgaacctaacacaccaatttcgtcaaacttttaactttccaaaactccgagaagtaaatgattaccatcatgcatttgatgcttcattaactgcatttataggcatgtatcttctaaaacaatatccaaaattagaaagattctttgtatacgggaaatttgccaaacagcctattaacttaactagatttaatataattagaaaacttgcagtagcagaaaaaccgattgctaatatagaaactggagaaatattatgggataaaacagccgatattaaatatttcgaaaagctatacaactataagagactacttgtgacacatgaagtaagagaaaattacggagcaatgttcaaacaaactttatttaaggcttccgacaacaaaagcaaaacgctagtaccaaagaaaaatcatatggagacatccgtttacggaggctatagcaaccaagagacggcttacctagcgatagtaagaataccatttaaatcgggcttcaaattcatagtagtaggtataccaaccagaatggtagcaaaaattaaacattaccaaagtttaggagccactttaaaacaagccacacacaaagtcatcgaaccaaaatttactaaaataagtcgaaaaacaaaacaaacagtgatatcggattacgaagtagtattgccaaaagtatacctagatcaagtagtcagagatcaagtaaaggggcaaatgtataggttctcattaggatccgacaaggaatatcataacgttcaagaactatacttaccattatcaatacaacaagcgtttgtggggcactacgacgaaagtgacgaccaacgatctaacgacttagtaaaagtctatgacgccgcattgaaacaactacaacgatattttcccctgcatctaagtcgtaattttgatcaagtagcaaatcaagctcatcagtcatttgaaggtctcaaaaataacgtgcaaaaatcggacaaacagttaggcaagaaagaagtattaaacagcctattcgtaggactacacgctactgcaacacgaagtaacctatcagtcctaggaatgtctaaagatttcggacgcttgcaaagcagatcaggaataacactcaccgatcaagcagagataatataccaatctcccactggtctttttgaacgaaaagtagcgctgaaagacttatga

SEQ ID NO: 5390 - RNA, 4089 nt, synthetic construct
  misc_feature 1..4089: note = Cas9 variant
  source 1..4089: mol_type = other RNA
atgacaaaactcggtaagccatacgggataggagtcgatatagggtctaattcgattggttttgcagcagtagacgaaaattcccatctaataagactaaaagggaaaaccgtaattggcgcaagactatttgaagaaggcaaggcggccgctaaaagaagggctggaagaactacacgacgaagattatcacgtaatagatggagactatcatttttacgcgatttcttcgaatcacacataaccccaacagatccaaatttcttcatgcgacaaaaatattcagaaatatcaccgaaagacaaagctcgatataaatacgaaaagcgattatttaatgaccgaactgatgcagaattttatcagcaatactcaacaatgtatcatttaaggaaccgtttaatgacagatccctcaagagcagatgtaagagaaatatacttcgctattcatcatattctcaaaagccggggacacttcctaacaccaggcgacgcaaaagattttaatacaaacgatgtagcgttggacgaaatattcccagcattgcaagatgcgtatgcccaagtatatcccgacttaggcataacatttgacgaagacaaagcaaacgagttcaaaactatactactaaatgaaatagcgacatccatagatacgcaaagagcattagtcaaactactactagcggaggaagatgacaaagacatacttaaacagcaaaaacaagtattaacggagttcgcaaaagctgtagtagggctaaaaacaaaactaaatttagcacttggtacagaagttgactcatcagaagcaacagcctggaacttctcattagggcaactagacgataagtgggcgggtatagaatcagctatgacagacgaaggtacagaaattctcgatcagattcgagatctctatagagcaagactcttaaacggaatcgtacctacaggaaagacgttaagccaagcaaaagtggacgactacacacaacaccacgaggacctacaattattcaaagcatacctaaaacaattagaagacgacggaacagcaaaagccattagacaactatacgatcgatacatagatggagacgatgcagcaccctttctcagggaaaattttgtaaaagccctaacaaaagacgtgacagcccaccctaacactaaaagtcccgagttactcgaaagattagcacaaccagacttcatgcttaaacagcgcaataaagcaaacggagcaataccagtacaaatgcaacaaagagaattagaccaaattattaagaatcaagcggtatattacgactggctagccgcaccaaaccctgtagagaagcaccgtaaaagcatgccttaccaattagatgaacttctcaatttcaggataccttattacgtaggaccactcgtaacagctaaagaacaaaaggctgcccaaggcggcgtctttgcctggatggtccgaaaggatcccgaaggtaacattacaccatacaactttgacgaaaaagttgacagagaagcatcagctaatacatttatccaaagaatgaaaactacagacacgtacttaataggagaagacgtgctaccgaagcaatcattactatatcaaaggtacgaagtccttaatgaacttaataatgtacgagtcaacaacgaaaaactttcaattgaacaaaaacaacaggtaatacgtgaactatttgaacgacacaacagtgtaacaatcaagcaatttgcagaaaatctcagagcacacggcgattatgcacacatcccagagataaggggtttggctgacgaaaaacgattcctaagctccttaagtacgtatagacagttaaaatcgcttctcccagaagcaatagatgacccagccaaacaagcagacattgaaaatataatagcatggtcaactgtatttgaagacgcagcaattttcaaaacaaaactaaaagaaatatcgtggcttggtagcgaagctataaccaaactcagcaacatccgatacagaggatggggtcaattctcacgcaaattcttaaacggactaactctagggaatgggcacacaatcattcaagaattacttctaagcacaaataatttaatgcaaattctaacagacgaaacacttcaaaagaaaatgacagagttaaacgctgataaattaaaaacagcgaatataaatgacgcgatagataatgcctacaccagcccatctaacaagaaagccctgcgacaagtcttaagagttgttgacgacataaaaagggcagctgacggacaagatccaagctggctctatgtggaaaccgctgacggaggaggaacgccaggcaaaagaacgagagctagacaacaccaactacaggaaatttacgcaaacgcagcccacgaactaatagacacagcagtaagaggtgaattagaggacaaaatatcagacaaagcagactttaatgatcgccttgtactatattttatgcaaggaggaagagacatttatacaggcgcaccacttaatatagatcagctgagctcatacgatatagaccacatactcccccaatcattaataaaagataattcattagataacagagtattagtacacgccataataaatcgagagaaaaacgcaactttcgcatctacaatttatgcccagaaaatgaatgccacctggagacaatggcatgaagcaggcctaatatccggtcgtaaactaagaaatcttcaaatgagaccagaccaaatagacaaatatgcatcgggattcgtagcaagacaacttgttgaaactaggcaaataataaaattaacagaacaaatagtcgcagcacaatatccagacacaaaaataattgccgtgaaagcaggtttaagtcatcaattaagagaagaattagaatttcccaaaaaccgagatgtaaatcattatcatcatgcattcgacgctttcctcgcagcacgcataggtacgtacctactaaaacgatttcccaatctacaagcattctttacatatggaaaatttaccaaggcagacgtaaagaaattacgaggctttaatttcatacgagacattacgcatgccgaagacaaaatagttgccaaagatacaggcgaagttgtctgggataaacaacgggatgtcgatgaactagaccgaatatacaatttcaaacgaatgctcataactcatgaagtccgatttgaaacagctgatctattcaaacaaactgtatacggggccagagacagcaaggaagcaggaggaagtaaacaattaataccaaagaagaaaggctaccccgtagacatttatggaggatatttcagagaaaatactgcatatctagccgtcgtaaaagtcacgaagaaaacagaaacaatattcaaagtagttaaaattgccacatcccaggtagctgcattaaacaaagcgagaagtagatctacagcagaagaattatcagtcttaacagaattgctaaaaccaaaattttcaaaagtcggcaaaaatggaaaaataacagacacaccgtttgaagttgtgttacccagagttccaagagagcaattattctataacgctaaatacggattcttcatggtaaacagcgatactatgtttcataatttccaggaaatttgggtatcaagatcagaccagaaaatattgcaacaaatacgaaaagcaaaaatagactacccaaacgtagatcaagatttggataatcttttccataacctagcagaccaaatagttaaatacttcgatttatacagcattgcaggattcaaagagaaaatcagtcaaagtcaaaacacctttaatgatctagcagtagatgacaccgaccaaagtgtaggcaaaataacggtaattaatgaactattaaaaggagctcaagcaaacggaatgactggatctttaaaagtattaaaaatatcaacgcctttcggttttacccaagataaatcaggtgttctaacaaaagacagtagtataatatatcaaagtccaacgggactatttgaacgtagcgtaagactaacagacttatga

SEQ ID NO: 5391 - RNA, 4089 nt, synthetic construct
  misc_feature 1..4089: note = Cas9 variant
  source 1..4089: mol_type = other RNA
atgacaaaactcggaaaaccttatggaataggagtagacatcggcagcaactctataggatttgctgctgtagatgaaaactctcacctgataaggctaaaaggtaaaacagtgattggtgcacgactattcgaagaaggcaaagctgcagcgaaaagacgcgcaggtcgaacaactagaagaaggttaagccgtaacagatggagactgtcctttctgagagatttctttgaaagtcatataacaccaaccgatcctaacttctttatgagacaaaaatactcagaaatttcaccaaaggacaaggctaggtataaatatgagaaaagactgtttaacgatcgaacagatgccgagttctaccagcagtattctaccatgtatcatcttagaaatagactaatgactgacccgtcacgtgccgacgtaagagaaatttattttgcaatacatcacatattaaaatcaaggggccattttctaacaccaggtgacgcaaaagattttaatacgaacgacgtagcactagacgaaatttttcctgcattacaggatgcctacgcgcaagtgtacccagatctagggataacatttgacgaagataaagaaaacgaatttaaaacaatattactcaatgaaatagcaacatcaattgatacacaacgagctctagtaaaactcctcttagcagaagaagatgacaaggatatactaaaacaacaaaaacaggtgttaaccgaatttgctaaagcagtcgtaggcttaaaaaccaaactgaacctcgcacttggaactgaagtcgactctagcgaagcaacagcatggaatttctcattaggccaactagatgataaatgggctggaatagaaagcgccatgacagatgagggaacagaaattttagaccaaattagagatttataccgagcaagacttctaaatggcatagttcccacaggcaaaaccctatctcaggcaaaagtagacgactatacacaacatcatgaggatctacaactattcaaagcatacttaaaacaactggaagatgatggtactgcaaaagcaattcgacagttatatgacaggtacatagacggcgatgatgcagcaccgttcttaagagaaaactttgtcaaggctttaacaaaagatgtcacagcacatccaaacaccaaaagtccggaacttttagaacgcttagcacagcctgacttcatgttaaaacaaagaaacaaagccaatggggctataccagtccaaatgcaacaaagagaattggaccaaataatcaaaaaccaagctgtatattatgactggctagcagcacccaatccagtagaaaaacatagaaaatcaatgccttatcaacttgatgaactactaaacttccgaataccatactatgtagggccattagtaaccgcaaaagaacaaaaagcggcacaaggaggtgtattcgcatggatggtgagaaaagatccagaaggtaatatcacaccttacaactttgatgaaaaagtagatagagaagcgtccgcaaacacgtttatacaaaggatgaagacaacggatacctatctaataggcgaagatgttttgccaaaacagagcttgctgtatcaaagatacgaggtacttaacgaactaaataatgtaagagttaataacgaaaaactatctatagaacaaaaacaacaagttattagagaattattcgaaagacacaacagcgtaaccatcaagcaatttgcagaaaatttacgagcacacggagattatgcacacataccagaaataagaggtttagcggatgagaaaagatttctaagctcactatcgacttatagacagctaaaatccttactacccgaagcaatagatgatccggcaaaacaagcagacatagaaaatattatcgcatggagcacagtattcgaagacgccgcaatattcaaaaccaaactaaaagaaataagctggctaggaagcgaagccataacgaaactatcaaatataagatatagagggtgggggcaattctccaggaaatttttaaacggattaacacttggtaacggccatacaataatacaagaattgttattatcaacgaataatctaatgcaaatactaacagatgaaacattacaaaagaaaatgaccgaattaaacgcagataaacttaaaacagccaatattaatgatgcaattgataatgcatatacgtcgccatcaaataagaaagcattaagacaagtgctacgagtggttgatgacataaaaagagcagccgacggccaagaccccagttggctatatgtagaaacggcagacggaggaggaactccgggaaaaagaacgagggccagacaacatcaattacaagaaatatacgcgaacgcggcacatgaactaattgacacagctgttcggggagaactagaggataaaatttccgataaagctgattttaatgacaggttggtactatatttcatgcaagggggtagagatatatacacaggagcaccactaaatatagaccaattgagctcttatgacattgatcacatactgcctcagagtttaataaaagataattcactagataaccgagtattagtacacgctataataaatcgagagaaaaacgcaacatttgcatcaacaatttatgcacagaaaatgaatgctacttggagacaatggcacgaagctggattgatcagcgggcgaaagttaagaaatttacaaatgcgaccagatcaaattgacaaatatgcaagcggatttgtagccagacaactggtagaaaccagacaaataatcaaactgaccgaacaaatcgtagcagctcaatatcccgacactaaaatcattgcagttaaagccggtttatcacaccaactaagagaagaactagaatttcctaagaatagagatgttaatcactatcatcacgctttcgatgcattccttgccgcacgtattggaacttacctattaaagagattcccaaacctacaagccttctttacttatggcaaatttaccaaggctgatgtaaagaaactaagaggattcaactttataagggacataacacatgcagaagacaaaatagtagcaaaagatactggtgaagtggtatgggacaaacaaagagacgtagacgaattagaccgcatatataatttcaaacgaatgttaatcacacacgaagtacgatttgaaacggcagatctatttaaacagaccgtctacggcgcaagagatagcaaggaagctgggggtagtaagcagctcattcctaaaaagaaaggataccctgtagacatttacggaggatatttcagagaaaatacagcctacctggccgtagtgaaagtcacaaagaaaaccgaaaccatatttaaagtagtaaaaattgctacaagtcaagtcgcagcattgaataaagcacgcagccgttcgactgctgaagaactatcagtattaactgagctcttaaaaccaaaatttagtaaagtaggcaaaaatggaaaaattaccgacactcctttcgaagtagtattgcccagagtaccaagggaacaactattttataacgcaaaatacggtttcttcatggttaattcagatacaatgttccacaatttccaagaaatatgggtatcacgttcagaccagaaaatcctacaacaaatacgaaaagcaaaaatagactaccctaatgtagatcaggacttagacaatctattccacaatcttgcagatcagatagtaaaatacttcgacctatacagcattgcggggtttaaagagaaaatttcacaatctcagaacacatttaatgatctggcagtagacgatacagaccaaagtgtaggaaaaataacagtcataaacgaattactaaaaggagctcaggcaaatggaatgaccggatctctaaaagttctcaaaataagcacaccattcggctttacacaagacaagtccggcgtattaacaaaagattcctccataatctaccaatcgccaacaggtctatttgaaagatcagttagactcacggatctttga

SEQ ID NO: 5392 - RNA, 4089 nt, synthetic construct
  misc_feature 1..4089: note = Cas9 variant
  source 1..4089: mol_type = other RNA
atgacaaaattaggaaaaccctacgggataggagtcgatataggatctaattctatcggattcgcagctgtagatgaaaactcacacttaataagacttaaaggaaaaaccgtaataggcgcaagactattcgaagaaggtaaagcggcagctgacagacgagcatctagaaccacgagaagaagactgtcaagaaatcgttggcgacttagcttcctaagagacttctttgaatcgcacattacgccaacagatccaaactttttcatgagacaaaaatatagtgaaatttccccaaaagataaatcaagatacaaatacgaaaaacgtctattcaatgacaggacagatgctgagttctacaaatacgaaaactgcccaacaatgtatcacttaagaaacagattaatgacggatccttcaaaagccgatgtaagagaaatatacttcgctatacatcacatcttgaaaagtcgagggcattttctaaccccaggagacgccaaagatttcaacacaaataaagtagcggtcaacaaaatattcccagcattacaagacgcatatgcacaagtttatcccgatttggatataacatttgatgaaaacaaagtaaatgaatttaaaacagtacttctgaacgaaaaagctacacctagtgacacacagcgagcgctcgttaatttactattagcaaaagaaggagacagagatattctcaaacaacaaaaacaagcactaacagaatttgcaaaagcggtggtaggcttgaaaacaaaattaaacgtagccctaggaaccgaagtcgactcctcagaagccacagcgtggaattttagtctaggacaactggacgacaaatggacgggcattgagagcgctatgacagatgaaggaacggaaatactcgaccaaatcagagatctttacagagctagactattaaacggaatagtaccagcaggtaaaacactcagtcaagctaaagtagacgactacgcacaacaccacgaagatttagaattatttaaagattatttaaaacaactagaagacgatggcactgcaaaagctatacgacagctctatgatagatatatagacggagatgacgctaaaccattcgtgcgtgaagacttcgtcaaagcattaaccaaagaagttacagctcatccaaatgcgaaaagtcctgaattactcgaaaggctcgctcaaccagattttatgcttaaacaaagaaacaaagcaaatggcgcaattcctgtccaaatgcaacagagagaactagaccaaataatcaaaaaccaatcagtatactatgattggttggcagcaccgaatccagtagaaaaacatcgaaaatctatgccataccaactcgacgaactactaaattttagaataccatactatgtcggacccctagtaacagccaaagaacaaaaagccgcccaaggaggcgtgtttgcatggatggtaagaaaagaccctgacggtaacataaccccgtataacttcgatgaaaaagtagaccgagaggcatcggcaaacacctttatacaacgaatgaaaacaacagatacttacttaataggtgaagatgtcttacctaaacaaagtttgctgtaccagtcctatgaagtactaaacgaacttaataatgttcgagtcaacgataataaactatccttcgatcaaaaacaacaagttttaggagaattgtttgaacgtcacaatacggtaacaataaaacaatttgtagacaatttactcgcacacggagattacgatcgcataccagaagtacgaggactggcagatgaaaaacgattcctgagttcactatccacctacaatcaactcaaaggcatcttgcatgaagctattgatgatagcgataaacaaacggacatcgaaaacattatagcctggtctacaatatttgaagacaaagctatttttaaaaccaaactaaatgaaataagctggctaaacgcaggaatgatcaactctcttgctaacattagatatagggggtggggacaatttagtcataaattattaaacgaactaacactatcaacaggcagaacggtattcgaagaactcttaatctcttcacataacttaatgcaaattctaacggatgaagtactaaaacagaaaatcgcagagttaaacgcacatgaactcaaggcgtcgggcatctacgcggcaattgatgacgcctacacatcgccatcgaacaaaaaggctttaagacaagttttatcagtcatagacgacataacaaacgcagcaggccaagcgccaaattggctatatatagaaaccgcagacggtgacggtgttccaggaaaacgtactaacagtaggcaaagaaaaatacaagaaatatatgctaacgcagcccaagaactaataaccggatcggtgagaggcgagctagaagacaaaatagcctctcgagcagattttacagaccgattagttttatacttcatgcaaggcggaagagatatatacacaggaaaaccacttaatatagataacttatcaagttatgatattgatcatatattaccccaatccctaataaaggataacagtctagataacagagtattagttcaccctctagtcaatagagagaaagatacgattttcgcttcaactcgatttgccaaacaaatgaacggaatgtggaggcaatggcatgctgcaggtctaataagttccagaaaactcagaaacctgcaaatgagaccagatgaaatagataaatatgcaagtggatttgtagcacgacaacttgtcgagaccagacaaataatcaaactgacagaacaaatcgtcgctgatcaatatccagatacaaaaatcatcgcagtcaaagcaggactcagttctcagttgaggaaggaactagactttccaaagaatagggaagtaaaccactaccaccatgcattcgatgcattcctagccgcaagaatcggaacatacctgcttaaacgatatcccaatttggaaccattctttacatatgggaaatttaagaaaacagaggtaaagaaattaaaatcatttaattttatacgagacatgactcatgccaaagataaaattgtagcaaaagaaactggagaaattgtatgggataatgcatcggacataaacgaattagaccgaatatataacttcaaaagaatgcttatcactcacgaagtacgattcgaaacagcatcactatttaaacaaaccctatacgccgctaaaaatagtaaaaaccggggtggctctagacaactaataccaaagaagaaaggatatcttgtcgatatatatggagggtatacacaagaaacagggagttacttaagcgtggtacgattaactaagaaagcaatgtacgcagttgtaaaagtatccacccgggacgctgcaaaattagcagtagcaaaatcaatatcagaacaaaaagaaaatgaaactctcaagaaaatcatagacgggaaactttcaaaaacatctaagaaaggaaaaacgacacatcaattatttgaaattgtcctgccccgtgtaggccagaaaactttgtttaaaaactctaaatataaccaatttctagttaacagtgatacatatatgcacaactaccaagaattatggatgccccgtgaatatcaacgtatgtggaaagatatattattatccaaccatggcgacgcacaattagaaggtcaacttgatcaaatatttaaatttatcgtcagtcaagtaaattcctactttaacctatatgatataaatcaattccggaagaaaatagcagacgcaacagataaatttgcaaaattaccaacacacgataccgacaatgccagaggcaaaatcgctacaataggacaattgttaatcggtctgcaagctaatgctatgagatcagacctaagaaatttagatattaaaacaccattcggactattacaaattggaactggaataacactagatctagacacaagcataatataccagtccccgacaggcttatttgaaagagaggtaccactaacggacctctga

SEQ ID NO: 5393 - RNA, 4089 nt, synthetic construct
  misc_feature 1..4089: note = Cas9 variant
  source 1..4089: mol_type = other RNA
atgaatcaagaaccatatgctataggactcgacataggaacatcatcgttaggatgggcaaacgccgatatggacggttacatagcacgcgtaaaaggtcaaacaggtttaggcgtaagactcttcgaagaaggccaacccgctgcagatagacgctccttcagaacaacaaggagaagactatctagacgaagatggagattaaggttactcagggaaatcttcgatgaaccgatttctagcattgacccaaatttcttcgctagacaaaaggcttcctcaataagtcctaaagacgacagattcgaaactacctatcagctattcaacgataaaacagaccaagagttctattcaaaatacccaacgatataccatctaaggtgggcgttaatgactgaacacagaaaatttgatctaagggaaatttatcttgcggtacatcacatcgtaaaatataggggaaattttctaagaagcggaaaccctaaaagttttaaaccaagcgaacttgactttagtcaaagatttaaagaagttaatggactatggcacctcatctttgacgaagtcgcaccccaactgcctacagacaacttggaagaaataacaaagctagtactagacacaactcggacccgcgcagacaggcaaagagagtcagtaaaattactgatggctgccactgacaatcacaaagactggaaaccatatttaactgagttcaccaaagcaatattaggactaaaaaccaaactatacttgctaacgggggtagatgtcgcaaaagctgaccagaaaacttggacattcagtctagaagacattgaagaccacagagcagacttggaaaccgcctttgatgatagaagcctagaattaatagaaaaattagtagatctccaagctgccatccaattaactgaaattatgcctagcggacaatacttctcgcaatcaatgatatatcgctatgatcaacataaagagcatctaagatggttaaaagattacgcagaacaacaaaccgatgcaaataaacgtaaagcggtaagactagcatacgaccattatattgaaggagatgccaaaggaaaaccagaaatagctgacgatttctataaagaactcaacagaatacttaaaggagacacatccgaattagcaaagaaaataaatcacgaaattgctttagagcactttatgccaaaacaaagaacaaaagaaaacggtgttatcccataccaaatacatcaacaagaattagactccataatagataatcaaaagaaatattatcaatttttaggggaggataatccagtagtctcacaccatggatcgcaaccttacaaaatagacgaattagttagtttcagagtaccttattatgtaggaccgatgataacagcagatcaacaaaagaaaactgcggctgggcaatttgcctggatggtacgaaaagacagcggggatataacaccatggaattttgatgacaaagtagaccgaacggcttcagcaacaaattttatacagcgcatgaaaactacagatacgtacttaataggagaagacgttctacccttacaatcattaacctatcaaaaattcatggtattaaatgaattaaataacatccgaatcaacggagaattactaacaagagaacagaaacaaagaacttacaatgatgtatttaaaggacatggcacagtcaatgttaaaagtttgatcaaaagcctcgaatgtcactctgaagttacaggagcaatcaaagtagaagggttagccgacccgaaaagatttaattcagcccttacaacatatagggattttaagaaaatactcccagttgcaatagatcagccacaaaggcaagcagatatagaaagaataataaattggagcactatattcgaagatgccgacatcttcaaagctaaattacaagaaatagattggctgactgatacgcaacgagatagactatcaactaaaagataccgaggatggggacgtctgtccgctaaactactgcttaacataaaagatacccaagggctatccatcatggaccaactgtggaacacccaacataatttcatgcaaatagttcacgaaccagattatgccgagaaaattgaaaagaccaatgcgaaaggcttaaaacaacaagacatattcgaaacaattaacgaaatgtatacaagtccacagaataagaaagcattacgtcaaattcttgcagtagtacgagacatccaaaaagcccaccatggacaagcgcctagtaggatatttatagaggccgcgcgaggagcagagcaaaatccacaaaggacccgacaaagacaaaaacagctagccgacttgttcgcagatcaggcaaaagaaatagttaacgaaaccgtcgcccaagaattaaacgacgaaacagacaataaagcaagattcactgatagattaatgttatatttcttacaaaatggtcaagatatgtatacaggtgaaaaactaaacatcgacaaactttcaacctatgacatagaccacatactacctcaatcacttgtaaaagatgatagtctagacaatagagttttagtttcaaaagtagaaaacttaaagaaaaacgatcatttcgcgagcgaactatatgcacgcaaaatgcaaggcacctgggaattatggagatctgcaggcctaattagtgctcgtaaacttaaacacctcctcatgcgcccggacgaaataaataaatatgcaactggctttataagaagacaattagtagaaacaagacaggtaataaaacttgttacagatgtcctatcaaatgaatacgatagtgacaaaacaaaaataataagtgtaaaagccggcctcagtcatcaactgcgcatggaattagatctcccaaaagtaagagagttaaatgactatcaccacgcctttgacgcgttcctagcagtaagaattggaacatatcttttaaaacgttatccaaaattggaaaggtttttcgtatacggacaataccaagttgcaccacaattagacttacgtcgattcaatttcatacatgatctcgttagcgggaaacaagagaaaatagtcgcagaagaaacgggagagattgtatggaatcgagaaaaggacgtatcatacatgaaacatttactatcactaaaacaccttttagtaactcatgaagtgaaagaagatcacggagccctgttcaaccaaacaatatacaaagcgaagaaagacaatggcaatgtaggaggtaaaatgaaactacttccaacaaaatctaatcgtccaacagaaatatacggtggacattcatcccaagcgatagcatatttggcaatagtacgagtaaatggaaaagaaccatcgtatagggttatgggtgtacctattagaatattagatcaactaaaacaagctaagaaacaaggggaatatgcagaaagactagcactgaaacaattctttactcccgattttacaaaaggaaaaggcaaaatcgtcagtgactttgacgtagtaattcctcatatacccttactacaacctgtaatagatgaaatttctgggcaatcacatagatttgccttagggacaaatacttactaccgaaacctgcaacaactaatactcactttagcagatcagaaagtattaatatctaaagaaactggtgttgacgaagaaaagaaactcgtagaagtatatagtcatatctgccaacaagtaatgaaatttttcccactatacgacaggaataaattcagagaactgctagttgattcacgatcacactttgaacagctaccgatagtaaacagatactctgacgctggaaaactagaaatagcaggtaaacgcggaatacttcaacaaatcatggtaggtctccatgctaatgcaacacctggagacttaaaagaactaggagtcaaaactcccttcggaaaactacaagtaccgggaggaataaaacttactgaaaatgccaaactaatctatgagagcccaacaggactttttaaacgagaagtaaaaataacaaccgaatga

SEQ ID NO: 5394 - RNA, 4089 nt, synthetic construct
  misc_feature 1..4089: note = Cas9 variant
  source 1..4089: mol_type = other RNA
atgaaaaagaaagcagaaaagatatatttggggctcaacgtaggaacaaactccataggatacgcggttaccgatgaacagtacagactgttaaaatttaatggaaatgatgcatggggctcaatagtatttgatgctgccagctcaaatgaagatcgacgcaatcaccgattggcgcgcagaaatctagaccgaagacaacaacgcatagtttggctacaagaaatcttcgcaaaagaaataagcaaagtcgatgacaggttctttattagactatcagaaagttttagatggagagaagatgtacaagatcgctatgtctttttcaatgataaagaatacacagacgttcaatatatgaaagaatatcctacgatacatcatctaatatgtgaactgatggataacaaaaccccacacgatgttcggctcgtatatcttgcatgtgcatggctcatcactcacagaggccatttcctgaataatttaaatgtcgaaaaacttgacgaaataatggacttctcaagtgtatatcaaaactttattaactattttactgaaaacggatataaaagaccttggggtgaaatagatgtgagtgcactttcagaagtactaaaacagaaaactggcatcaccgtcaaaaacaaagaactacaaaatatactactggaagggaaaaagccagaaaaatcaggaacagaagaatttccgttttctcaagattctatcatacgtctgttagctgggggacaatgcaaattaaaggatgtattttgcaaagaagaatacttagatttgggatcagtaagcctgggtatggacgaagaaaaatttgacgaaatatcaggaagtataggagaagattacgaccttctcattgccctaaggggtttatatgattggtcggtacttgcaaatctgctaaacggccactcagaaacaattagcatggcgaaagtacaaatgtatgaacaacacggaaaagatttgcaaatattaaagtacttcgtgcgaaaatacgtacccgacaagtataatgaagtttttcgaaaagcaaaagctgataactacgttgcatacacaggacatatggataaagacacagccagccaaattaaaaagaaagccaaagcagaagaattttctaaatatgtacttaaacttatgagccccattaaaccggagaaaacagacctgcaatcgtacgaagacatgtgcgaaaggttaaaattaaacagattccttccaaaacagaaaaatacagataacagagttattccacatcaattatatgaatatgagttaattcaaattctaaagaacgcatctgtttatttaccattcctcaacgataccaataatggtataagtgaagcggacaaagtactctcggtctttagatacaaaataccatactacgtaggaccattaaacgaagaatcttcctttgcatggatcagcagaaaacaaggaaaaataaccccatggaattttaaagagatggtagatgaagatgcaagcgaaaatgcattcataagaagaatgacaaacaaatgtacttacctcccaacggaagacgtactaccgaaagacagtctatgttaccagaaatttatggtactcaacgaaataaataacctccaaatcgacggactcaaaattccagtaaaagcaaaacaagggatataccacgaactatttgagaaaaacaagaaagtaaaacgtaaagatatagaagaatacttaattagaaacaactacttagacaaagatagtaccgaactaatatcaggaatagacgaacaaatacacagcggactatcctcatactgcgcattctttaatttattaaataagaaaatactctcagaagatgacgtggaacgaataattgaacgtgcctcatacgcagaagataaatcaagagtaatcaaatggttaagaaaagaataccccggactatcagaagacgatattcgctatattgccagaatcaaaattagagacttcggaagactaagcaaaactttcttaacaggattaaaaggatgcgatgtttccaaaggatttgatggacaagatgtagaaatgataagtatattacaaacaatgtgggaaaccaatgataatttaatggaaattctttcagacaaatatacatttctagaagccttggaagcattcacccaagaatattacacgggtaaaaagaaatctctaaaagaaagattagacgaaatgagagtgtcaaattcagtaaggagaccagtatatcgcacattagctgtagtcaaagatatagaaaaagcgtttggcaaaccaaacaaaatattcgtcgaaatgacaagagggggacaggcagaccaaaaaggcaaacgtataaaatcaagaaaacaacagattttagacctctacgataaatgtaaagatgatgtccatgacttaatgtggcaattagagagtttaggagaatatgcagactctagactacaatcggataggctctatttatactttatgcaattcggaaaatgtgcatattcaggagcgcatatcggttttgaacaacttatggccgggtccgtagaatacgacatagatcatatttatccacaaagctatgtaaaagatgattcacttaataataaagttcttgtattatcagatttaaacgggacgaaagacaatatctaccccgtgagcccagaaatcaggggaaaaatgcaaggattatggagctggtggaatcatgtaggagccataagtgatgaaaaatacaaaaggcttataaggtcagcaccattcaccgacgaagagaaaatgggatttatcaacagacaattaacagaaacctcacaatcaacaaaatttattgcagacttattaaaagaaagattcccagacgcagaagtagtatacgtaaaagccggcctagtaagtgatttcagacacgaatttgacttacctaaatcaagaagttacaacgatctccacaatgcagcagacgcatttctatcagttgttgccggaaacgtatatgatatgagattctccaaaaagtggtttcgcatagacgaaaaatattcagtaaaggtaaaaacaatatttactcatgaagtaaaatgtaggggagacattatttgggacggaatgccaatgttagaaaaagttgaagatactgctaggaagaacacagcacatttcgtaaaatatgcagccttcaagactggcggtttgtttgaccaaaatccggtcaagaaaggaacagggctgataccactaaaagctggcctgcctacagaaaaatatggtggctacaataaagcaggtataatgtttctaatcccagtaagatataatattggcaagaaatccgaaatacttattctaccggtagaattaatgcatggaaaacacttcttagaagacaaagtatttgccagaaactacacatttacacgtttagaaaacatattaggaaagaaagttggagaagtctcgttccctatgggtatgaggccatggaaaattaatacaatgttatcattcgatggattcagagtatgtttaacaggcacatcaggcaggggaaaatgtctagtagcccaaccggtaatgcaattcagtgcagacgagcattggagattctatgtaaaacgattagagagattcgtggagaaaatcggaataaatccagatttactatacgataaagaccatgacaaagtctccaaagatgaaaacttaaaactatatgaactctacgtagataaacttcaaaacacgatatataagaaacgagtaaacagcccagtccaaaccctactcaaaggaaaagaagaatttaagaaattatctattgaggaacaatgccaagtattactaaatatccaaagtgtttttggtcgcatgactggaggatgcgacctgacactaataggaggatctgctcactccgcagcaaccggtagtttatcaaccacaatatccaactggaaaaagaaatattccactgttagaattatcgaccaatccccctcagggatgtgggaaaaatctagtgaaaatctattagactttttatga

SEQ ID NO: 5395 - RNA, 4092 nt, synthetic construct
  misc_feature 1..4092: note = Cas9 variant
  source 1..4092: mol_type = other RNA
atgaccaaattaggaaaaccatatggtataggagtcgacattggctctaactctatcggcttcgcagcagttgacgaaaactcacaccttattcgactaaaaggaaaaacggtcataggagccagacttttcgaagaaggaaaagcagctgcagaccgacgcgcctcacgaacaacaaggagaaggctaagcagaaacagatggagactatctttccttcgcgactttttcgaaagccatattacacccacagatcccaactttttcatgagacaaaaatattcagaaatatcacctaaagataaggcacgatacaaatacgagaaaaggttatttaatgaccgaacagacgcggagttctaccaacaatacccaacaatgtaccatctcaggaatcgtctactcacagatccaagtaaagccgatgtacgagaaatatatttcgctattcatcatatactaaagtctcgcggacatttcttaacatcaggttacgcaaaagatttcaatacaaataaggttgcactaaatgaaatctttccggcattacaagacgcttacgcacaagtatacccagacttagatatcacattcgatgaaaacaaagttaatgaatttaaaaccgtactactagacgaaaaggctacaccgagcgatacacaacgcgcgctagtaaatttgctacttgcagaagacggtgataaagatatactcaaacaacaaaaacaagtactgacagaatttgctaaagccgttgtaggcctgaaaatgaaactaaacgtagctttaggtactgaagtcgactcttctgaagcaaccgcttggaacttctccttaggtcagctcgacgacaagtgggcaggaatagaatcagcaatgacagacgaagggaccgaaattctcgaccaaataagggacttatacagagcacgactgttaaacgggatagttccagcaggcaaaacattaagccaagccaaagtagacgactatgaacaacaccatgaagatcttgaactttttaaagactacttaaagcaactagaggatgatggaatggcaaaagtaataaggcaactctacgatcgttatatagatggagacgacgcaaaaccattcgttcgcgaagactttgtaaaagcacttactaaagaagtcactgcacatccgaatgccaaaagtccggaactacttgaacgattagttcaaccagatttcatgcttaaacaaagaaataaggcgaatggcgccataccggtacaaatgcaacagagagaacttgatcagataatcaaaaatcaatccgtgtattacgactggctcgcagcacccaatccagtagaaaaacacagacaaagcatgccataccaattagacgaacttctaaatttcaggataccttactatgtaggtccattagtaaccgcaaaagaacaaaaagcagctcaaggtggagtctttgcttggatggtaagaaaagacccagacggaaatataacaccatacaacttcgatgaaaaagtagatagagaggcttcagctaacacttttattcaaagaatgaaaacaacagatacatacctcataggagaagacgtcctaccaaaacagagtctcctttatcaatcatatgaagtattaaatgaactaaacaatgtccgtgttaacgataacaaactatcattcgatcaaaaacaacaagttctcggtgaactatttgaaagacacaatacagttactataaagcaattcgtcgacaacttattagcacacggtgactatgatagaatcccagaagtccgaggtttagccgatgaaaaacgattcctatcaagcctatctacctataaccaactaaaaggaatactccatgaagcaatagacgacagcgacaaacaaacggacatagagaaaataatcgcatggtcaacaatatttgaagataaagcgatattcaaaactaaactaaatgaaatttcatggctcacagccgggatgataaactccttagcaaacattagatatagaggttggggtcaattttctcataaacttctgaacgaattaacactttccacaggaagaactgtattcgaagaacttctcatatcttctcacaacttaatgcaaatcttaacagacgaagtactgaaacagaaaatagcagaactcaacgcccacgaactcaaagcatcgggcatatatgcagcaatagatgacgcatatacgtctccttccaataagaaagcattgcgacaagtactctcagtaatagacgatataaccaatgcagccggacaagctccaaactggctctatattgaaacagccgatggagatggagttccaggaaaaagaacaaactcaaggcaaagaaaaatacaagagatctacgccaatgccgcccaagagttaataacagggagtgttcgtggcgagctcgaagacaaaatagccagtagagcagatttcacagatagattagtgctatactttatgcaaggtggaagagacatatatacaggtgaaccactaaacatagataacttaagctcatatgacatagatcacatactaccgcaatctctaataaaagataatagcctggacaaccgagtcctagtgcatcccctagtcaaccgcgaaaaagacactatatttgcttcaacaagattcgcaaaacaaatgaacggaatgtggcgacagtggcatgcggcaggattaatctcatcccgaaaattacgaaatcttcaaatgagaccagatgaaatcgacaaatacgcatcgggattcgttgcacgacagctagtcgaaaccagacaaataataaagttaacagaacaaatagtcgccgaccaatacccagacgctaaaatcattgcagttaaagcaggattatcatcacaattacgaaaagaactagattttcccaaaaatcgagaagtcaaccactatcaccacgccttcgatgcattcctagcagcaagaataggcacatatctcctaaaacgatacccaaacctcgaaccattcttcacttatggaaaatttaagaaaaccgaagtaaagaaattaaaatcattaaaatcattcaattttatccgcgacatgactcacgcaaaagacaaaatagtagcaaaagagactggagaaatagtatgggacaacgcttcagatattaatgaactagatcggatctacaacttcaaaaggatgctaataacccatgaggtcagattcgaaaccgctagccttttcaaacaaacattatacgccgctaaaaattccaaaaacagaggtggcagcagacaactgataccgaaaaagaaaggatatctagtggacatctatggaggatatactcaagaaacagggtcatacctatcagtcgtacggttgaccaagaaagcaatgtatgcagtcgttaaagtatctacaagagatgctgcaaaactagccgtagcaaaaagtatctccgaacaaaaagagaacgaaacattaaagaaaataattgatggaaaactatctaaaacttccaagaaaggaaaaacaacacatcaattattcgaaatagttcttccacgagtaggtcagaaaacactatttaaaaattctaaatacaaccaatttctagtaaacagtgatacatatatgcataactaccaagaattatggatgcctcgagagtaccaaagaatgtggaaagatatactactatcaaaccatggggatgcacaactagaaggacaactagatcaaatattcaaattcatagtttcacaagtcaattcatactttaacctatacgacatcaaccaattccgaaagaaaatagccgatgccactgataaatttgctaaactacccacccatgacacagataacgcaagaggaaagatcgcaacaatcggacaattactcataggattacaagcgaatgcaatgcgttcagatctcagaaacttagacataaaaacaccattcggtctattacaaatagggacaggcataacattagatctagatacaagtattatctatcaatcacctactggcttattcgaaagggaagtacctttaactgatctatga

SEQ ID NO: 5396 - RNA, 4092 nt, synthetic construct
  misc_feature 1..4092: note = Cas9 variant
  source 1..4092: mol_type = other RNA
atgagggggaactaccatataggtctagacataggtacaagttcaattggatgggcagttattgacgacaatgcaaaagtgatgcgagcaaaaggaaaaacagcaataggcgctagactatacaacgaaggacaaacagcagcagataggaggctctttagaacaaccagaaggcgacttaacagacgaaaatggcgattaaaactactggacgaaatctttgacccttatataacccctgtcgatgccgcatttttcgcacgtcttaaacaatctaatttaagccctaaagaccaaaatagagattggacaggttcaatgttatttccagaccgtactgatagaaaatttcacaaagattacccaactatttaccacttaagacataagctaatgaccgaagatcaccagtttgacatacgagaaatatatctagcaattcatcatatagtaaaatacagaggcaacttcctaaacaccacaccggtttcatcattcagcgttagtgatgtaaagtttgatgaacaattcgacagactaaacgaattatatgcagctgtatctcctgacgaacccttcgcaatcaatggcgataactctaaagcgatagaaacactactattatccgacgaaactaaaaaatttgataaacaaaaacaatctgcaaaacttatcctatcagaaacaggggacaaagctttagataaagagaataccaaagtggcgactcagatctctaaagcaatcttaggatacaaaacacaacttgacgttttacttaaatacgacgcaattaacagttcagcatggaagatcgaattagacgacgaaaacatagatgataccctaccaggactactgtcccaactggatgaaaatcgacaagaaatggtaagcataatccaaaacttatatgcccaggtaacgcttaaccaaatagtcccaaacggcatgtcattaagtgagagtatgatagagaaatataatgcacacagagaccatctaaaactcttaaagcaactagaagataaaatagacgatccaaagaaaaaaaaaggtttagaagcagcatatgacgcatacgttggtaagaacatgaaagtagccaatcaagatgtattttacgcatcagttaagaaaaatctcgacgacagtgacctagcaaaacaaatagcagacctaatagaggcacaaaaattcatgccaaaacaacgcacaagccaaaatggagttataccacaccaacttcaccaattagaattagatcaaattatcgaaaaccaatcaaaatactatccatggctaacagcagcaaatccgaacccgaaacgaatacatcaagctaaatacaaactagatgaactagtagcatttagaataccctactacgtaggaccactagtaacgcctgaagaacaagaaaaatctgcaaaccaagtgttcgcatggatgaaaagaaaacaaccaggaaccatcacaccttggaactttgatcaaaaagttgaccgaatggcttcagcaaatcgcttcataagacgaatgactacaaaagatacgtatcttattggcgaagacgtattaccagacgcttcactaatttatgaacggttcaaggtactaaacgaattaaacctagtgaaagcaaactatcaccgtttagcaccagcgcaaaagcaggcagcatatcgagatctatttgaaaaccaaaaaagcatttcaacaaagaaattacaaaactatctagtagaccaaggatatttcacagcaaaacccaagataacagggttaagtgacccagaacgctttaatagctcattagggacatatattgacttcaaagaaatttttggtgatcaagtcgataaccctgaccgacaggatgattatgaaaaaataatagaatggagtacagtctttgaagatagacaaatttatgaagccaaactacgtaccctagattggctcactgaagaccaaatacaagccctaaagacaaaaagatataacggatggggacgcttatctaaaaaactactaacaggaatcgtagatgaaaatggagaacgcatcatcgatgtcttgtggaacactaaccaaaactttatgcaagtacagtcacaagaatcattcgccaaaagaatacatgaagccaacgctaaacaaatgaaggtaacgggagtagaagacatactagctgacgcatacacatctccacaaaacaagaaagcaattcgtcaagtaatacgggttgtagatgatatacaaaaagcaatgggcggagtggctccaacatcagtaagcattgagtttacacgcagcgaagaccaaaatcccaggcgaacacaatcaagagaatctcaactacagaatactttcaaagtagacgccaaagaaatcgtagactcagacctcgtgactgaactagaaaccgtttcaaaatcaaaaaaaggtctaacagatcgattatatctatatttcacacagttaggaaaagatatgtatactggcgacccattaaacatcgatgagctaagcacatatgatattgatcatatcctaccacaagcgtttatcaaagacgacagtctagataacagagtcttagttagcaaggccgtaaataacggaaaaagcaataatgtaccagttaaactgtttggaggaaaaatggggggattttggaaagaactagcagatcatagattaataagtaagagaaaattaaaacacctcttaacagatccagataccatagataaatacacaatgagaggatttatcagacgccaactagtagaaaccagccaagtaattaaattagtggctcagatattaggggacaaataccaaaacgatgatacaaagattatagaggtgacagccaagatgaatcaccaaatgagagaaaatttcaagctcatcaaaaatcgggaagtaaatgactatcaccacgcagtagacgcgtacctaacagcgttcgtaggacaatatttatataaaagatatcctaagctcagaccatacttcgtctatggcaacttcaaaaaattcaacgaggaccatgtcagctttcgctatttcaatttcctacacgaattaatggacgagaacaataaaagaattgtggaacctgaaaccggagaagtggttctcgaacgagaacctgcgatagcatatatgaaacgagtatatcacttcaagttcatgctaatctcacaagaggtatacaccagacgcgatgcaatgttcaaccagacaatctacccagccaaagaagcaaatagaagaaaattaatagcaatcaagcatggaaaaccagtagatgtatacggtggatacagtggctcggtagatgcatatatggccatcgtacgtatacacgataaaaaaggagacaaatacaaagttgtcggagttcctatgagagcattagaaatacttaacgcaacacacgataaaaaagattatgatgcaaaactaaaacagatactagtaccaaaattcaccaaagtaaaaaaatcaagaaaaactggtgagataaccaaaaaggtggaagactttgaaatagtactcgggaaagtaatgtatcgacagctagtcatagacggagataaaaaattcatggttggatcttccacttacctatataacgccagacaactcgtgctaagcgattcatccctagacacattggcatccaagggaacgttagatagtgacgccgactccaaaagattagtcgcggtatacgatgaaatcgtagaaaaggtagataaatatttcccattatacgataaaaatgcttttcgtagtggattacacaaaggccgagataagtacttgttattaccaaaccgatccacctttaatggagcaaaaaaagtacattctggcaaacgcgaaatcctgaatgagatactaaacggtttacatgcaaacgcaacacttggaggattaaaagatcttaaaatatctacaccattcggtaaaatgcaagggcaatcaggcattccattatctagtaacacaataatatgttaccaatcaccaacaggcctattcgaacatcgagtaagtttaaaagatctatga

SEQ ID NO: 5397 - RNA, 4092 nt, synthetic construct
  misc_feature 1..4092: note = Cas9 variant
  source 1..4092: mol_type = other RNA
atggaaaacaaccgatataacgtaggattagatattggaacgtcatccatcggttttgcagtaacagatgaacaagacgaactggttcaagtaaaaggcaaaaattacattggtgtaagactattcaaagaaggtcaaaccgcgtctgaaagaagatcatttagaacaaccagaagacggctaaaaagaagaaaatggagattaggtctacttgaagaaatatttgccccatacctagcacaaggggatccatatttccttgcaaggatgaaagagtcaaacatcagtccacgtgatgaacgcaagaaatactacggatccttattattcagcgatgacaccgtattttatgacaaatacccaacagtatatcacctaagacatgcactaatgactgaagacagaaaatttgacattagagaaatatatctagcggtacatcacataattaaataccgaggaaactttctaataaacaccctaattaacgagttctcatcaaaagcagtagatttcaagaaagatgcagacatactaaatgacctctttgaacaattctacattagtgatattaatgattcgtttcagctcaacacggcagatatgaacgaaatatccgaactactcctcgacaacagcaaaacacgactagacagacaacgagaaagcctcaagaaactagccaagaaagtagacgacattagtgtagcgaagaaacatcagaaaattgcaacagaatttagtaaagccatattaggaaacaaagccaaattcgacgtaattctgaatgtaacgacagactcatcaaatgattggtcgtttaaactagaagatgaagacgctgatgagaaaattgtagtcttattagaagaactaaatactccgcaacaagaagctctaaacataatacatcaatggtactcacaaatctcactaaacggaatagtaccagacggcaaaagtatttcagaagcaatgattagctcctacgaactacataaagaacacctagctctattaaaacaacaaataaacaacaccaaagacaaaaagaaagcccacggactacatgaagcctataacgaatatgtacacggcaacaacaataagaaactaaaccaagcagatttctactccaaagtaaaacaaaatttggaatcttcacttataacggacgaaatactcgaactaattaatgcggaaaacttcatgccaaaacaacgcacatctgctaatggagtcataccacaccaactccaccaacaagaattagacagaataatacaaaatcaagctaaatactatccattcctcgccgaaacaaatccaaacgagaaaagaagcaaagttgcaaaatacaaactcgacgaattggtagcattcagagtaccatactacgtcggacccctaataacggcaactgaccaaaagaaaacatctggaaaagaatttgcctggatggttcgaaaacaaccaggacgcatcacaccatggaattttgacgaaaaagtaaataaaatggaaagcgccaacactttcataaggaggatgacaacaaaagactcttacctaatagccgaagatgtactcccagatgaatccctcttatatcaaaaatttaaagtcctcaacgaactaaataatttacgagcagacggacgtaaattaaaagtcagtgttaaacaaaaagtttttaaagaattatttcagcaacagaaaaccattactatagtcaaactccaaaattatttaaaagcagaatgttctttcctaacgacaccagaaatctccggtcttagtaaacctgaacacttcgttagttcactcgcaacatacatagacttaaagaaaatatttggagaggacatcgataaccctgctaggcaaaacgattttgaacgcatgatagaatgggcaacaatattcgaagacaaaaatatatactcagaaaaactcaacgagataaaatggttaaacgaccgacagaagaaagaactgaaaaataaaaactatcacgggtggggaaaattaagcgctaaattactgaaaggactaagagactcagatgaatgttcgataatagaacatatgtggaatacgcaacaaaatttcatgcaagtacaagcagaagaagatttcgcccaaagaatacaagaagaaaataaccaacacctaaaaggaaacacactcgaagaagttttagcagatgcttatacatcacctcaaaataagaaagcaatcaggcaagttgtgaaagtaatcgaagacatacaaaaagccatgggcggaatagcaccccagaaaatatcgatcgagttcacacgagcaccagaagagaaacccagaagaagtgttgagcgacaacaacaaatagagaaaatatataaaagtgtagctaatgaagtcgaaaatgcaggcgttaaagatgaattacaacgcttttcggacagaaaacaaacgctaacagacaaatacttcttgtacttcacccaactaggaaaagatatgtacacgggaaaaagcataaatatagatcaaattggaaattaccaaattgaccacattctgccacaagcattcataaaagatgactcacttgacaatagagtcctagtatctgccgcagtaaacaacggtaaatcagataacgtccctaccaaaaacgaccgatataaagtaagagaacacggacaaagattatatgaccaaggccttataagcaaacgtaaattcaacaatttaattacagacccagactcaataaataaattcacagctagaggattcgtcaaacgacaactggtagaaacatcacaagtaattagactcgtagcagagttcctttataataaatatcagagtaaatccgaaataattgaagtaagagccaaaatgaactcacagctacggaaagatttcggactcatcaaaaatagaaatgtaaatgactaccatcacgcactagacgcatacttaactacatttataggcaactatctatacagaagatacccaaaactacgagcatatttcacctacggttgcttcaagaaagtagacgatagtcaactaaaatacttcaacttcctacacgacatcgaagacgacaaaaagaaaattataaaagataatgacacaggcgaaatactatggcatagagacgaaggcattgcaagatttaaacgaatttacaatttcaaatacatgctcgtaacacacgaagtactcacccgacagggagcaatgttcaaacaaactgtatactccgcagccgttgcgggatctaagaaactaatacctgtaaaagaagatcgcccaatagacatatacggaggatacacaaataataacgatgcttttctagctatcgtcaaagtaaccaaaaagaaacaatacatggtagtaggcattcctcaaagagcagtagtaaaactcaacgacgccgccaaacaaggtagcaaggcttaccaaaaagttctctacaatgtaatcaaaccacaattcatcaaaaagaagaaagatagaaaaacaggtaaaataacacaaaaactcgaaaattttgagatagtagtaagtaaaaccctttatcgacaattaattattgacggtgatcaaaaatacatgttaggatcatctgcctacaaatataatgcgaaacagctagtactttctgaatacgctctggaagtgttagacagatcaatattcgagaagaaagaatacactacagtagacttagacaatgtatatgacgaaatcctggcacaagtcgacaaatactttagtttatatgataaaaacaaattcagacaaaaactacatgaaagccgcaaaattttcacagaactgcccataaataatctcttctctggaacaaaactccttaaatcaggcaaaagggaaactttaaatgagattttggaaggacttcacgccaatgccactaagaaagacctaaaatccctaaagttctccacaccactaggaatgattcaatacccatcggggataatcctcagtgaaaacgcaatactctgttatcaatcaccaacagggattttcgaaaggagagtaacactaaaagatttatga

SEQ ID NO: 5398 - RNA, 4092 nt, synthetic construct
  misc_feature 1..4092: note = Cas9 variant
  source 1..4092: mol_type = other RNA
atgacaaaacttggaaaaccatatggtatcggagttgacataggaagcaacagcattggatttgcggcagtagatgaaaacagccatctaattaggcttaaaggaaaaacagtgatcggcgctagactattcgaagaggggaaagcagctgcggaccgacgcgctagtcgcacaacccgaagaagactctcaagaaacagatggagattaagttttctacgagacttcttcgaaagccacataacccccacagaccctaatttctttatgcgccaaaaatacagcgagattagtccaaaagacaaaagccggtataaatatgagaaaaggttatttaatgatcgaacagatgcggaattttacaaatatgaaaactgtccaacaatgtatcaccttcgaaaccgactaatgacagatccaagtaaagccgatgtacgtgaaatctacttcgccatccatcacatactaaaatcaagagggcactttttaacacccggcgatgccaaagacttcaacacaaataaagtagccgttaataaaatattccccgcattgcaagatgcatatgcacaagtatatccagacctagatataacattcgacgaaaataaagttaacgaatttaaaaccgtacttctcaacgaaaaagccacgccctctgatacacaaagagctttagtgaaccttttattagctaaagaaggagatcgagacattctaaaacaacaaaaacaagcactcacggagttcgcaaaagcagttgtaggattaaaaacaaaactcaacgttgcactaggaacagaagtcgattccagcgaagcaactgcatggaatttctccctaggacaactagatgataaatggaccggaattgaatctgcaatgacagatgaaggaacagaaattcttgatcaaatacgcgatctctatcgagctcgactactaaatggaatagtgccagctggtaaaacgttatcacaagcaaaagtcgatgactacgcgcaacatcacgaagacctcgagctatttaaagattaccttaaacagttagaggatgatggaaccgctaaagctatccggcagttatatgacagatacatcgacggcgatgacgcaaaacccttcgttagagaagactttgtcaaagcattaaccaaagaagtaactgcgcacccaaacgcaaaaagtccagaactattggaaagactcgcacaaccagattttatgctaaaacaaagaaataaggcaaacggtgcaataccagtacaaatgcaacaaagagaattagaccaaataatcaaaaaccaaagcgtttattacgactggttagccgcgccaaatccagtagaaaaacatcgaaaaagtatgccgtaccaacttgatgaattactgaatttccgaataccatactatgttggacctctagtaacagccaaagaacagaaagctgcccaaggaggggtatttgcttggatggtcagaaaagatccagacggtaacataacaccctacaatttcgacgagaaagtggacagagaagccagcgccaatacatttatacagagaatgaaaactacagacacttacctaattggcgaagatgtgctaccaaaacaatccctcctatatcaacgatatgaagtcctaaatgaactcaataacgtaagagtcaataacgaaaaacttagcatagaacaaaaacaacaagtaataagagaactcttcgaaagacacaacagcgtaacgataaaacaatttgctgaaaatctccgagctcatggtgactacgcacacatgcccgaaatacgaggcctcgcagacgagaaaagatttttaagctcactatcgacataccgacaattaaaaagtttactaccagaagcaatagacgatccagcaaagcaagcagacatagaaaatataatagcatggtcaaccgtctttgaagatgcggctattttcaaaacaaaactgaaagaaatcaactggttagactcccaaacaatcacaaaactctctaacatcagatacagaggatggggtcaattttcacacaaatttcttaatggactgacactcggaaacggacacacgataatacaagaactattcttaagcaataacaacctaatgcaaatacttacagacgaaacactacaaaagaaaatgacagaactaaatgcagataaactaaaagccgcaaatataaatgacgctatcgatgatgtttatacatcacctagcaataaaaaggcacttcgccaagttttaagagtaattgaggacattaaaagggcagctgacggacaagatccctcatggctatatgtagaaactgcagacggcggaggaacacccggaaaaagaacaagagcaagacagcaccaactccaagagatatatgcaaatgcagcccacgaattaatcgatagtgccgttcgaggtgaattagaagataaaatagcagataaagcagatttcaacgaccggctcgtattatatttcatgcaagggggccgcgacatatacacaggtacgcccttaaacatagatcaactatcaagttatgatatagatcatattcttcctcaatcactcataaaagacaattccctagataaccgagtgttagtacacgcgataataaaccgtgagaaaaatgcaacattcgcctcaaccatatatgcccagaaaatgaatgccacttggcgccaatggcacgaagctggtttaataagcggcagaaaactgagaaacctacaaatgcgacctgaccagattgacaaatatgcaagtggcttcgtagcacgccagttagtagaaacaagacaaatcattaaactaactgaacaaatagtagccgctcaataccctgaaacaaaaataatcgcagtcaaagccgggctaagccatcagttacgagaagaactagagttccccaaaaacagagacgttaatcactatcatcacgcctttgatgcatttcttgcagccagaataggaacttatctattaaaacgcttcccaaacttacaagcattcttcacatatggcaaatttaagaaagccgacgttaagaaactaagaggatttaacttcatccgtgacatcactcacgctgaagataaaatagtagtaaaagacaccggtgaagttatatgggacaagaaaagagatgtggatgaattagacagaatatataatttcaaacgaatgttgataactcacgaagtgcactttgaaaaagcagacctatttaaacaaacggtctatggcgctaaagattccaaagaagctgggggaaagaaacagctcatttcaaagaagaaaggttacccagtagatatctacgggggttatacacaagaaacaggaagctatctaagtgtcgttagactcactaagaaagccatgtatgcagttgtaaaagtgtcaaccagagatgctgcaaaactagcagtggcgaaatctataagcgaacaaaaagaaaacgaaactctaaacgacatcatagacgaaaaattatccaaaataagtaaaaatgggaaaattacacacgaattatttgaagtagttttaccacgagtaggacagaaaacactatttaaaaactctaaatacaatctttttctagtcaactcggacacatacatgcataattatcaagaactatggatgccaagagaatatcagaaaatgtggaaagatatcagcctaagtaaatacggtgacgcgcaaactgaagaccaattagatcaaattttcggcttcatcgttagccaagtcaactcctatttcaatctgtacgatatcaatcaattccggaagaaattaaatgatgccgcagacaaatttgcaacattacctatgcgagacacagacgacatgcaaggaaaaattgctactatcggccaactacttataggtctccaagctaatgcagcacgctccgatctgaggaacttagacataaaaacaccactgggcctcctccaaatccccaatggcatatctttagactcagacacaagtgtagtttaccaaagcccaactggacttttggaaagagaagtacatctgtccgatctttga

SEQ ID NO: 5399 - RNA, 4092 nt, synthetic construct
  misc_feature 1..4092: note = Cas9 variant
  source 1..4092: mol_type = other RNA
atgaccaaactaaaccaaccctatggtataggcctagacataggatccaattctatagggttcgctgtagtggacgcgaacagccacctactaaggctaaaaggagaaacggctattggagccagattatttagggaagggcaatccgcagcagatcgacgtgaatcaagaaccacaagacgaagattatcaagaacaagatggagattaagtttcctcagagatttctttgcccctcacatcacgaaaattgacccagacttctttctccgacaaaaatattcagaaatttccccgaaagacaaagataggtttaaatacgagaaaaggttattcaatgatagaacagatgcagagttctacgaagcctacccatcaatgtaccacctaagactccgactaatgacagacgcatctcaagcagatccccgggaaatcttcttagcaatacaccacatactaaaaagtagagggcactttcttactcctggtgcagcaaaagatttcaacaccgatgaagtggatttaaaacatatctttcctgcactagcagaagcctatgcgcaagtttatccagatttagaattgaactttgattcagcgctagcagatgattttaaagcaaaactattagatgaagatgcaaaaccttctgacatacaaaaagccctagttaacttactactatcttcggacggcgaaaaagaaatagtaaagaaaagaaagcaggtattaacagaatttgcaaaagcaatcactggcttaaaaacaaaattcaatttagcattggggacagaagtagacgaagctgacgcctcaaattggcaattctccatgggccaattggatgacaaatggagtaatatagaaacgtctatgacagaccaagggacggaaatctttgaacaaatacaagaactatatagagctagactgttaaatgggatagtacccgcaggaatgtcactttcgcaagctaaagtagccgattacggtcaacacaaagaagacctagaactattcaaaacatatataaagaaactcaacgaccacgaactagccaaaacaataagagggctgtatgataggtatattaatggcgatgatgcgaaaccattcttacgagaagacttcgtaaaagctctaaccaaagaagtgacggcgcatcccaatgaagtatctgaacagttactaaatagaatgggacaggcaaatttcatgttaaaacaaaggaccaaagcaaacggggctataccggtacaactacaacaaagagaactagatcaaataatagctaatcaatcgaaatactatgactggcttgctaaaccaaatccggtggagaaacacagagcaagcaaaccataccaattagacgaacttttgacatttcgtatcccctactatgtcggcccactcataacgcctaaacaacaggcagaatcaggagagaacgtattcgcatggatggttcggaaaaacccatcaggcaatataacgccctataactttgacgagaaagtagacagagaagcatcagcaaatacttttattcaaagaatgaaaacaacagatacttacctaatagatgaagatgtactaccaaaacaatctctactttatcaaaaatacgaagtattaaatgaactcaacaatgtacgtataaataatgaagccctaagcactgatcaaaaacaaagactaataagagaagtattcgagcggcatagcagtgttactataaagcaagtagcagataatttagtagcacacggagatttcgcacaaaggcctgaaattagaggattagctgacgagaaaagatttttgtcctcactatccacatatcatcaattaaaagaaattttacatggcgcaatcgacgaccccacaaaattacacgatatagaaaacataattacctggtcaaccgtatttgaagatgctgcgatctttaaaacaaaactagcagaaatagattggctagacccagctacgatcaagaagttatcaaatattaggtacagaggttggggacagttttcccgaaaattactagatggtctaaaactagggaatggacatacagtgatacaagaacttatgctaagcaaccataacttaatgcaaatacttgcggatgaaacattaaaagaaacaatgactgaattaaaccaggataaactaaaaacagacgacatcgaggatgtaataaacgacgcttatacctccccatcaaacaagaaagcactccgacaagtacttcgtgtagtagaagatatcaaacacgccgcgaatggacaagatcctagttggctgtatatcgaaacagccgacggacctggaacagccggcaaaagaacgcaatcaagacaaaaacaaatacagacagtctacgctaacgctgcacaagaattaatagattcagcagtcaggggcgaacttgaagataaaattgctgataaagcatcattcacggaccgattagttctatatttcatgcaaggtggtagagatatttatactggggcacctttaaatatagaccaactctcgcactatgatatcgatcatatactaccacaaagtttaattaaagacgattcactagataatagagtccttgtaaatgcgacaataaatagagagaaaaataacgttttcgcttcgaccttatttgccggaaaaatgaaagccacctggagaaaatggcacgaagcaggcctaatttccggaagaaagctacgaaacttaatgttgcgccctgatgaaatcgacaaatttgcaaaaggtttcgttgcaaggcagctagttgaaacgcgacaaataataaaactgacagaacaaatagctgccgcccaatacccaaacacaaaaataatcgcagttaaagcaggcctatctcaccaactaagagaagaactcgactttcctaaaaatagagacgtgaaccactatcaccacgcattcgatgctttcttggcggccagaattggaacttacctattaaaacgatacccaaaattgacacctttctttacatatggtgaatttgcgaaagtagacgtaaagaaatttagagagtttaatttcataggtgccctcacacacgcaaagaaaaatataatcgcaaaagataccggtgaaatagtatgggacaaagaacgagatatacaagaacttgatagaatatacaacttcaaacgcatgttaataacccatgaagttcatttcgacatggctgatttattcgatcaaacaatttacgcagcaaaagactcaaaagaacgcgggggaagtaaaaatcttatacaaaagaaacaaggctacttgacaggaatatacgggggatattccacagaacgaggatcgtacgtgagcattattagaacatttaagaaaggagctccaatatacaatatcgtaaacattagtaccgctgacgtctccttactttcagataaacagcgagttagcgaagcatcagcagacgtccttctaaaagaacttataaagaagaaactcgcaaaacgtaaaagcggcgaaaatacaaaatcaggggctttcgaaatagtattacccagagttggcaaaaacactttattcaaaaataagaaatatggactatttctagtcgaatctacaactgaatttcataactaccaagaattatggttgcccagaaatgatcaaatgttaataaaatcaatacaatcacataaaatagaagaatctaaagcagattatgaactaacacgaatgtatcgcaacatagcttcacaagttgaccattactttggactttatacaattcgtaaattctctgaaaaattgacagcatcaattaatgattatggcgctttaccggtatataaatcagaaaccacggatggtaaatacgaagtactatctaacttattcgagggactaggaagtggaacatcaacaggaaaccttacagcagttaaactgcaacctaattttggcagggtgtatttaacaagtggcattgtcctagaagacgatacatcgataatataccaaagtccaaccggtctattcgaaagaagtgttaaattagcagatttatga

SEQ ID NO: 5400 - RNA, 4092 nt, synthetic construct
  misc_feature 1..4092: note = Cas9 variant
  source 1..4092: mol_type = other RNA
atgacaaaacttaatcaaccgtacggtataggcttggatattggaagcaattcaatcggatttgcagttgtagatgccaactcacatctacttcgactaaaaggtgagactgccataggagcaagactattccgcgaaggtcaatcagccgccgatcgacgaggatcaagaaccaccagacgaagattgtcacggacaagatggagactcagctttctacgagacttctttgccccacacataacaaaaattgatcccgactttttcctaaggcaaaaatatagcgaaatatcccccaaagataaagatcgcttcaaatatgaaaagagactattcaatgaccgaacagatgcagagttctacgaagactatccctcaatgtatcatcttagactacacctcatgacccacacacataaagcagatcctagagaaatatttttagctatacaccacattttaaaaagtagaggccattttctaacgccaggagcggcaaaagactttaacacagacaaagtggatttagaagatatttttccagcattaactgaagcatatgcacaagtttatccagacctggaacttacatttgatctagctaaagcagacgattttaaagcaaaattattagatgaacaagcaaccccatctgatacacaaaaagctctagttaacctactactttcatccgacggcgaaaaagaaatagttaagaaacgtaaacaagttctaacagagttcgcaaaggcaattaccggcttgaaaacaaaatttaatctagcattaggaacagaagtagacgaagctgatgcatcaaattggcaatttagtatgggacaactggatgacaagtggtccaacatagaaacaagtatgaccgatcaaggcacagaaatattcgaacaaatacaggaactatacagagctcgcctactaaatggtatcgttccggccggcatgtcacttagccaagctaaagtagccgattatgggcaacacaaagaagacctagaattatttaaaacttacttaaagaaactcaacgaccatgaactagcaaaaacaataagggggctatacgataggtatataaacggggatgacgcaaagccatttctccgagaagattttgtaaaggccttaactaaagaagtcacagctcacccaaacgaagtatccgaacaattacttaataggatgggccaagcaaacttcatgctcaagcaacgcacgaaagcaaacggagccatacccatacaattacagcaaagagagttagatcaaataatagctaatcaatcaaaatattacgattggctcgcggcccctaatcccgttgaagcacatcgatggaagatgccataccaattagatgagttattgaacttccatataccctactacgtgggaccactaattacaccaaaacaacaagccgaaagcggtgaaaatgtttttgcatggatggttcgtaaagacccatccggtaacataaccccatataatttcgacgaaaaagtagacagagaagcatcagccaacacattcattcaaagaatgaaaaccacagacacctacttaattggtgaggatgtacttcctaaacaatcattactatatcaaaaatatgaagtgctcaacgaactcaacaatgttaggataaacaatgaatgtctagggacagaccaaaaacaacgcctaatacgtgaagtttttgaaagacacagttcagtaaccataaagcaagtagcagacaacttagtagcacacggcgattttgcacgcagaccagaaatacgtggattagctgatgaaaaacgtttcttaagttcactcagtacttaccaccaacttaaagagatacttcacgaagcgatagatgatcctacaaaattactcgacatagaaaatataatcacatggagtaccgtttttgaagatcatacaatatttgaaacaaaattggcagaaattgaatggttagaccccaagaaaattaacgagctgtctggcatacgttataggggttggggacaattcagtagaaaactgttagatggcttaaaattaggaaatggacacaccgttatacaagaattaatgctaagcaaccacaacttaatgcaaatccttgctgatgaaacgctaaaagaaacaatgacagaattgaaccaagacaagctaaagaccgacgacatcgaagacgtgataaatgatgcatatacaagcccctctaataagaaagctctaaggcaagtacttagagtagtagaagatattaaacacgctgcaaacggccaagatccatcttggctattcatcgaaactgccgatggaacaggaaccgccggtaaacgtacccaatccagacaaaaacaaattcaaacagtgtacgccaatgcagcgcaagaactaatcgatagcgcagtccgtggagagttagaagacaaaatagcagataaagccagtttcacagatagattagtcctatactttatgcaaggaggaagagatatctatacaggagcaccccttaacatagaccaactatcccattacgatatcgaccacatattaccacaatcattaataaaagatgactcgctagacaatcgagtcctcgtaaatgcaacaataaacagagagaaaaacaacgtatttgcgtcaactttatttgcagggaaaatgaaggccacttggaggaaatggcacgaagcgggcctaatttcagggaggaaattacgtaacttaatgctacgaccggacgaaattgacaagtttgcaaaaggttttgtagcaagacagctagtagaaacaagacaaatcattaaactcacagaacaaatagccgcagcacaatatccaaacacaaagattatagccgttaaagcaggtctatcacaccaactaagagaggaactagactttcccaagaacagagacgtaaatcactatcaccatgcattcgatgcatttttagcagcacgaataggaacatatcttctaaaacgatatccaaaattagcaccgttctttacatatggtgaatttgcaaaggtagatgtaaagaaattcagagaatttaacttcatcggagcactaacacatgcgaagaaaaacataatagccaaagacacaggagaaatagtctgggataaagaacgagatataagagagctcgaccgcatatataatttcaaaagaatgcttattacacacgaagtctattttgaaaccgcagacttattcaaacaaactatatacgccgctaaagatagtaaagaaagaggaggatccaaacaattaattccaaagaaacaaggatacccaacacaagtgtatggcggatatacccaagaaagtgggagttacaatgctctagtaagagtagcagaagcagacacaactgcataccaagtaatcaaaatttccgctcaaaatgcatccaaaatcgcttcagcaaatcttaaatctcgtgaaaaagggaaacaactattaaatgaaattgtagtaaaacagctcgccaaaaggaggaaaaactggaaacccagcgccaacagttttaaaatagtcataccacgattcggaatgggaacgctttttcaaaatgcaaaatatggcttattcatggtaaatagcgatacttactaccgaaattaccaagaattatggttatcaagggaaaatcaaaaactccttaagaagctattttcaataaaatacgagaaaacccaaatgaaccacgacgcattacaagtttataaagctataatagaccaagtagaaaaatttttcaaactatatgacataaaccaatttagagctaaactctctgacgcaatagaacgatttgagaaactacccataaatactgacggaaataaaattggaaagaccgaaacattacgacaaattttaataggattacaagccaacggtactagaagtaacgtaaagaatctaggtataaaaacagaccttggattattacaagtaggctcaggcataaaattggataaggacacacaaatcgtttatcaaagcccatcagggctgttcaaaagaagaatacctctggcagacctatga

SEQ ID NO: 5401 - RNA, 4095 nt, synthetic construct
  misc_feature 1..4095: note = Cas9 variant
  source 1..4095: mol_type = other RNA
atgggtgaccgaaaatacaacctaggcctggatatcgggacatcgtcgataggatttgcagcggttgacgagaataatcaaccgattagagtaaaaggcaaaacagccataggagttcgtctgttcgaagaaggcaaaactgcagccgatagaagagggttcagaacaacaaggagaagactttcacgccgtcgctggcgaatcaacttattaaatgaaatattcgacgcacacttagcagaagtagatccaacattcttagcaagactaaaagagagtaatcgaagtaacctagatccaaagaaatcattccaaggatcacttctatttcctgaacgaaaagattatcaattttacgaagaatacccaactatttatcacctaagaaaagctctaatggaaaaagaccgtaaatttgacttcagagagatatacttagcagtccatcatataataaaatacagaggtaacttcttaaacggaacaccaatgcgatcatttaaagtagaaaatatagaattagacaccctctttgaccaactaaatcagctatacgcagaaattgttcccgataacgaactcgcattcgatctggctcaagtagcagacgtaaaagacgttttgtcatctacaacgatttataaaatggacaaaaagaaacaactggtaaaaatgatgctccttccagcatcgaacaaagccttacaaagcgaaaacaagaaaatcgtaacacaatttgtcaatgcaatactgaattataaatttaaattagatgtcttattacaagtagaaacagatgccgactggagtcttaaacttaacgacgaaggagccgacgataaacttgaagagttcacgggagaccttgacgaaaatagacttgaaattatagacttactccaaagactccataattggttctcactcaacgaaataacgaaagatggaaatagcttatccgctgcaatggttgaaaaatacgagaatcaccatcaccacctcggactcttaaagaaagtcatagagaatcacccagacgccaagaaagcaaaagcactaaaagaaacatacacagcatatgtgggaaaaaccgacgacaaaacccaaaaccaagatgatttttacaaagcagttgaaaagaacttagacgactcacctgacgcaaaagaaattaaacgcttaatacaattagaccaatttatgcccaaacaacgtacgggccaaaatggagccatcccacatcaactacaccagcaagaattagatcaaattatagaaaaacagtctaaatactatccattcttagcggaacccaatccaaatgtaaaaagaagaaaagacgcaccttataaactagatgaattgattgctttcaaaataccctattacgttggtccgctagtgacgccagaagaacaagcacagaacggagaaaacgtctttgcctggatgaagagaaaagcggctggaccaatcactccatggaattttgacgaaaaagtcgacagaatggaatctgcaaatcgattcatacgtagaatgacaacaaaagacacttacctattcggagaagatgtactcccagcagaaagcatgatataccaaaaattcgtagtattaaatgaactcaataacctgaaaattaatgggcgccatctgtcactaaaagacaaacaagatgtctacaacgacctattcaaacaacaaaagacagtatcaataaaagcattacaaaactactacgtaaccaaaaagaaggccgcaacagccccaacagtaggcggtttggcagacccaaagaaattcctatcaagcctaagtacatatatagattttaaaaacatgttcggtgaaagagtaaatgatcctcagttccaagaagacttagaacaaatcgtcgaatggtccacaatctttgaagatcgtggcatatttaaagcaaaactacaagcactaggatggctatcggaaaaacaaatccaacaattagtggctaaaagatataaaggttggggacggttatcaaagaaattacttacaggactcaaaaacgcagaaggatactcaattttagacgaaatgtggcgatcaactggaaattttatgcaaatccaatcgcgtccagagttcgcagcactaatacaacaagcgaatgagaaacaattcgaagggaatgaccccgacaacgtctgggagaatattgaaaatatactaggagatgcatatacaagtccacaaaataagaaagcgataaggcaagtagtcaaagttgtacaagacatagaaaaagcggtaggtaatccacccgaaaagatcgcgatagaatttaccagagaagcagcagctaacccccaaagaacgcaatcaaggctaagaaccttagaaaaattatacgaatcagccgaagaagtggtagatgcagggttaacagcagaactcgcggagttcaaagaaaataaacacgtactttccgacaaatactacttatattttactcaattaggcagagatgtatacacaggagacacaatcagtcttgacaaattaaacgactatgatgtagatcatatactaccacaatcttttataaaagatgattcactcgataacagagtattgacgatcagagctgtcaacaacggcaaaagcgataacgttccagcaaaaatgtttggcaagaaaatgggcagcttctggagatatctcttagataacggaatgatatcaaaaagaaaatataataatctgataaccgaccccgacaacatttccaaatacgcacaaaaaggattcataaaccgccagttagtcgaaacctcacaagtaataaaactaacagcaaacatacttaatggaatatatgataaagacacagaaataattgaagttccagcaaaaatgaactctcaaatgagaaaaatgttcgacctagttaaagtaagagaagtcaatgattatcatcatgctttcgatgcttatttgacaattttcattggaaattatctatacaaatgctatccaaaacttcagccttatttcgtctacgacaattttaagaaattcggaaacaaagaagatattggccataaaagatttaatttcttaggaaaaattgaaagagaaaagaaagtagtagccccagaaacaggcgaaatcttgtggtcaaacgtagcaccaaacgaaacaataaaacaaatcaagaaagtgtatgactacaaattcatgatagtctcgagagagataacaacaagacgagcggaactattcaaccaaacagtttaccccaaaaattatcatggcaaacttataccaataaaagaggatcgacctactgatttatatggaggctattcaggaaacactgatgcatatctggctattgtagctttagaagataaaaagaaaggaaaatacttcaaagtcgtaggtataccgactcgagtagccgccaaactagaaaaattgaaacagcaagactcccaacaatacctacaagcacttcataaagtgattgctccacaattcacaaaatcaacaaagaaaggaataaagaaaacagagtttgaaatagtactcgataaagtacactacagacaattggtgcaagacggtccagttaaaatgatgctaggcagttctacatataaatacaatgcaaaacaactcgttttatccgaaaaagcactccaagttatagctgacgatcgaaaatttgacgaaacacagaaagacgacaatctcatagcagtttacgacgagatactcagtatcgtaaaccaatcattcgatctatatgacataaacggatttagaaagaaattaaacgacaatcgtgaccaatttatagatcttccggcagaaactaaatacgaagggagaaaagttgtagcacacggaaaaagagaaatgatactagaaattctaaaaggactacacgctaatgcagcattcggtaatttaaaaccaataggattcagtaccgcctttggacaactacaagtcccaaatggtataatcttatcgaaaaacgccatattaatacaccaatctccaagtggactattcgagagaaaaatcaaactttctgatttatga

SEQ ID NO: 5402 - RNA, 4095 nt, synthetic construct
  misc_feature 1..4095: note = Cas9 variant
  source 1..4095: mol_type = other RNA
atggaaaaacaggagtattacctaggactagacatgggaataagcagcgtaggatgggcggtcacaaatgacaaatatgaactactacgtaagaaaggaaaagacatgtggggtataagagagttcgaagaagcggactcaagcgcagaaagacgaacacacagagtaaacagaagacgaagacaaagacaagtcgcaagaatggggttactaaaagaatacttctcagatgcaatagaaaaagtagatagtaatttctttatacgaatagaaaactccaaatatttctttgaagacaaagatggcagactatcatcaaagaatggtatctttgatgatgcagactataaagacgtagattattatacagaatatcccacgatttttcatcttagaaaagcacttttagacatcgaggacaccggaaaagaatatgacgttcgactggtatacctagcgctagtaaacatgttcaaacatagaggtcatttcctattaaacacagaaggcgacgcactaagtagcgagcaagtaaatacaacctaccaagaattactagaaatattagaaaacaactatgatatatccttagaatctcgagacataaaggacgtaatagatattatttcaagctcagataacggaagaaagaagaaacatgaacaaatactagaattatttggagtgaagaaatcagacaaaagggcaaatgaattactaaaatgtctatgtgggcttagcgtaaatgcaaaattaatattcgacgaaaattatgaagaaaaagtagatttgtgtttccacgactttagctatacagacaaaattccagacttgatggagaaattaagcgaggaagaatattacgtcgttgaacaacttaaaagcatatatgattattcaatattagcaggtacactaaaaggttacgattacttatcatgcgcacgagtcgaactctatgaaaaacacagagaagacttaaaactactcaaagcactttacaggagatacaaaacgaatgaggagtataacgacatgtttaaaagcgacaaagaaggaacatacagtgcatacgtaaactcatttaatagttcagactctagtgtgaaaatcaaaaagtaccgatggaatatgaaaggaagaacaatagataacttatacggtacgataaagaaggcatttaaagataatacagatgacaaggatgtacaatcaatgatggagtccattgacaaagaacaatttttaccaaagcaactaacaggagcaaatggggtcattcccaaccaagtacacaaaaaggaaatggaaagaatacttaagaaagcgcaaaactatctaccattcttaaaagaaaaagacgaaagtgaattgaccgtaagcgaaagaatattgagactttttacttttcagataccatattatgtaggaccattaggcgaaaattcaaaaacaggatgggttgtacgacgggaaggcggtagggtactaccctggaacatagatgagaaaatagatatgagcgcaacgagtgaagcatttatagggaacctgatcagaaaatgtacctacctatctgatgaaaaagtaatgccaaaagcctcactaagttatgaacgttattgtgttttaaatgaaatcaataatatatgcatagatggagaacgcctagatacggaactaaaacagaaaatatatacagaatgtttcatgaaaggcaaaagagttacaagaaaacaaatatgcaactatcttgtagcacaaggatgtataaagagtgatgaacaagttacaggaatcgatatcaacgtgaactcttctctgagctcatacggcaaaatgttcgcaatctttggagaacacttaaaagaagacgcaatacggaaggtcgccgaagaaataatatattggggtacaatatttagtgactctaagaaaatgtttaggaaacacttaacaaaatatgtcgaacagggtattttgggagaatcacaggtaaaacggattctaggttacaaattcaaggattggggaagattctcaaaagcattacttactttacaaggaatagataaatccacgggggaactattatcacttgaaaacgcgatgtgggaatatagtttgaacttcatggaattaattaattctgatgatttcacattcaaagacgagcttgctaacagaagaacatctgcaattaagtcattatccgaatttacatacgaagaccttgaggatacatatttttcagtacccgttaagcgaatgatatggcaaactatcttagtagtaagagaaatagaacaaataatggggtacgcgccaaagaaagtatttgtagaaatggcgaggtcagaagaagaaaaaggtgacaaaggcagaaaagacagccgtggaactcaattactagaactatacaagaacatcaaaaataccgaaaaccatgattggaagaaagagataagcgaggcaaacgaatctggaaaactaagatctaagaaactatatctatactatactcagatgggcagagatatgtatacaggggaagaaataaacatagacatgttatacgatgacagtatgtacgacatagaccacatctatccacgacattatgtaaaagacgatagcatcgtcaacaatttggtattagttaataggagagccaatcaagacataaagaaagacttatatccgataccagataaaatcattagcaaccctaaagtacaagagttatggaaaatgctacataaacaaaacctcattacagacgagaaatataaaagactaatgagtagatctccatttaccgaaaaacaactaggagacttcattgcacgtcagctcgtagaaactagacagggaacaaaagggattgcagaacttcttggtcaattgttcaaggacacagagatagtatatgcaaaagcgaccaatgtatcagacttcaggagagataacggttttgtaaaaagcagattagtaaatgatttccatcacgctcaagatgcgtacctaaatatcgtagttggaaacgtatactataccaaattcaccaaaaatccatggaactttataaagaaagattttgacaaagaccgtaacaaaaacgggtataacctcgcaaaaatgttcgatagagatgtagtaagaggagacgacacggcctggatcgcatctaagaaagacacccaaggaactatcgaaacggtaagaaaaatgatgcgtaaaaataccccattaatgacaagaatgtcttttgagcaacatggaggaattgctaacgctacactgtactcagcaaagaaagcgaaagtagaaaattacatacccttaaaaagctccgatataagactatcagacgtaaagaaatatggtggatttacttccgcaacagtagcgtactactttatagtccaccataaagaaggaaagaaagaaaatacaacaatagaagcattaccattatattgtaaacgaaaagtagaaaacgaagaaaatggactactaaaatactgtgaagaagtgttaggatacggagacgtcaaaatattgttcaacaaacttaaaatccaatcactactagatatcaacggttaccaagctcatttatcaggaaaaactggcaaccaactaaccctaaggaatgccatgaacctctgcgtaccagaaaaatggacggcatatataaagaaattagaaaaattagtcgtgggacacgtgaaagaacaagagataagttcagaagcaaatatagaactatacgatttgctgaccgataaacacttaaatagcgtgtatgccaaaagaccaaatgcatacggacaaaaactcatagacaacagatcaagattcgtaaatttaaaaccggaatctcagtgtgaagcaatactacaaatattaaaacttacaaaaataggaaataatgaaacaaatctgaaactaatcggggaatcagagcactcaggaaaaatgttaataagcaaaaatttaaaagacacagacaaaccagcaatcatatgccaatcagtaacaggactgtatgaacgcaaaatatacatattcgatgaacaactagacaaatga

SEQ ID NO: 5403 - RNA, 4095 nt, synthetic construct
  misc_feature 1..4095: note = Cas9 variant
  source 1..4095: mol_type = other RNA
atgaacaaacgctataatattggtctagacatcgggactaatagcataggttggtcagtagtcaatgatcaatcacaacttgttagaattaaaggaaaactaggctatggagtacgcttatacgacgaggggcaaacagcagaagaccgacggctctttagaaccacaagacgaagactgaagagaagaaaatggcgccttggcttgctcagagaaatattcgaaccatatattactcctcaagatgccacatttttcctaagacaaaaacaatcaaatctatcccctaaagatctacaaaaacaacaaccacaaataggcttattcaacgatagattagatagcgacttccactatcaatacccaaccatatatcacctaagatatgcattgatgactgaaaaacgccaattcgatctacgtgaaatatatttagcaatgcatcacattgttaaatacagaggacatttccttaatgcagcagcggcatccagctttaaaagcggagaaatagatctagctaaagatttcgcagcactaaaccaaatatttggcacaatctttagtgaagtgggttttagtttatccgaatcgaatctagacgaaataaaaagcatattattagataacaacctctcagcaagcgtgagacaaaggaaagccctaccattgatataccaaacggcggcaagcaaagactctgaaaaacaatacaaagcaatagccactgaattactaaaagctatattgggattaaaagcaaaattcaatcttataacaggtattgaggtagaagacgtaaaggcttggacattatccttcaacgcagaggattttgatgcaaaactaagcgacctgaatattgccgataacgacgatgcagtacaaatcatagaaatcctccgcgcgttatactctggagtattattgacaggtatagtgccggaaggacaaagtatatcacaagctatgatagacaaatacgaagcacataaagcacatcttattatgttaagatcaattcgtgaacaattatcggataaagaaaataaagcactagaaaaggcttatgacgattacattgatcaccccgaagataaacaacacgggagcagagaagatttttatgctgcaatcacaaaagtactaaagaaagattcagaagatactaatatcatagaaatactaaaattaatagaactggaccagttcatgcctaaacaacgtacaaaagataatggagcaatcccccatcaactacaccaacaagaactagaccaaattatagaaaaccaaaaacagtactacccatggctcgctgatataaatccaaacgaacaacgacagaaaatggcaccatataagctagatgaactcgttacgttcagggttccatattacgtaggtccaatgataacagcagaagaacaatttcaaacttcaaataagaaattcgcatggatgatacgaaaagaaccaggagcgataacaccttggaacttcgaccaaaaagtagatagacaagcaagcgcaaatgaatttattaaacgcatgactacgactgacacttaccttctcgcagaagatgtcttaccaaagcaatcacttttataccaaagatttgaagtactaaacgaactaaatggaattaaaatcgacgaccagcccataaccgtagaacaaaaacaagctatctttaatgataaatttatgcaacaagcccatgtaaccgtcaaaaacatacaagcatacctagtatccgagggccaatatgcaagtagacctaacatcacaggacttagcgacggagaaaaattcaatagttcgctatcgacgtatcacgacttaaagaaaattttcggagatatgatagatgaccccaataaacaaacagattttgagaaaatgatagaatggtcgactatttttgaagacggcaaaatctttgcggataaactcagggaaattaactggttaacagatgaacaaagacaaagattatctaacaaaagatacagagggtggggccaactatcaaccaaattactcactaaaattgtagatcaaaacggccaaagaataatagacatcctatggaacacaaatgacaacttcatgcgcataatacactcagacgattttgaccaagcggttacccaagcgaaccaaatgttgctagctgacaacgacactcaagatgtcataaatgaactgtatacaagcccatcaaacaagaaagctctgaggcaaatactcttagtggttgcagatattcaaaaagcaatgaaaggacaagcccctgcaagaatactgattgaatttgcacgagaaaaacaggcaaaccctagactatcaactcaacgaagacgacaggtagaacaagtataccaagaattaaacaacgatcagttaaataaagaattagcagacccacaatatgctaacctatcaaaagatagactattcctatatttcatgcagggaggaagagacatgtataccggcgaaagccttaatatagatcgactcagcgaatacgacattgaccacatcttaccacaagcgttcattaaagacaactcactcgataaccgtgtactcgtctccgctaaaatgaaccgtagtaaatccgatcacgtaccactagatttcactgaggaacgtttcggtcagaaaatgcgatcacagtgggaacaaatgctacgtgccggactacttacaaggcgtaaatacaataacttgaccttaaaccctgattcccttaacaaatatacaatgtcagggttcattaatagacaattagtggaaaccagacaagtaatcaaactagccacaaacctcttagtagaccaatacgccgatgaagacgtgcagcttgttacagtcaaaagtggattaacgcaccaaatgagagaagacttcgactttcctaaaaacagaaacctcaacaattaccatcatgctttcgatgcatatctcacagccttcgtaggattatatttgctaaagaaatacccaaaattagcccattactttgtctatggccaataccaacaaggatttaaagccaatgatcaatggagaaatttcaactttttaaatggattaagacaagaacaacaagttgacgcagagacaggagaattgatctggcaaaaagaccacgacctcgcatatatgaacaaaatctatgattttaagaaaatattggtaacacgcgaagtgcatactaaccatggcgccctctataatcagacactctataaagcaaaagacgacaaagcatcaggtcaaggagggcggcaattaatagcggccaaagaaaatagacctaccgccatttatggtggatattccggaaaaacagtagcatatatgtgcctagtacgaatcacagaaaagaaaggggacttctatcgaatatgtggagtacaaacagcatgggtagacgaattagaacatatagaagacgctaccatcaaactccaaagactaactgccctactaacaccgcaatttagcgcaacaaagaaacaaaaagacgaagtagtcacagtagtgaaaccatttgaagtacttctacctaaaattctaatcaatcaaagattttacgacggaggacaagaacttacactagcatccgcaacctacaaaaataacgcccaagaattagtactagataagaaagccgtacaagtattgaatggtcaactcccaaaagccgaactagaagctcaagcaacagttgtatatgatcagattctcgaacgagtgcaaaaatacttcccattatacgatatgaatagcttccgagaaaaactttttgtaggtagagataaattcaatgagttaccatggcaagaccaatgggaaaaccataaactaatccaagtaggtcagaaaacaatcctagatcgaatactaattggattgcacgcaaatgctgccatgggggacctaaaagcattaaacatgagcacacccttcggcaaactacaaaaatctaacggaatatcattatctccagaaacacaaataatataccaatcaccaacaggacttttcgaaagaagagttgctcttaaagatctatga

SEQ ID NO: 5404 - RNA, 4095 nt, synthetic construct
  misc_feature 1..4095: note = Cas9 variant
  source 1..4095: mol_type = other RNA
atgaaaaacctaaaagaatactatataggactagacataggaacagcatcagtcggatgggcagtaactgacgaatcatataacataccaaaatttaatggcaagaaaatgtggggagttcgcctgtttgacgatgctaaaacagcagaagaacgcagaacacaaagaggatcaagacggcgattgaacagaagaaaagaaagaataaacttattacaagatcttttcgcaaccgaaatatccaaagttgatccaaacttctttctaagactagacaactccgatctttatcgagaagataaagacgagaaacttaaaagtaaatacacactgttcaacgacaaagacttcaaagaccgagactaccacaagaaataccctacaatccaccatcttataatggatcttatcgaagacgaagggaagaaagacataagattactgtatctagcatgtcactacttgcttaaaaacagaggacactttatattcgaaggacaaaaatttgataccaaaaactcctttgataaatcaataaacgatctaaaaatacatctacgagatgaatataacatagacctagaatttaataatgaagatttaatcgaaataataacagatacaacactaaacaaaacaaacaaaaagaaagaactcaaaaacatcgttggagacaccaaattcctaaaagcaataagcgcgattatgataggttcaagtcaaaaactggtcgatctatttgaagacggcgaatttgaagaaacaacggtcaaaagcgtggacttctcaactacagcattcgatgacaaatacagcgaatacgaagaagcacttggtgacacgatatcattgctaaatatcttaaaaagtatttacgacagctcaattttagaaaatctattaaaagatgcagataaatcaaaggacggaaacaaatacatatctaaagcatttgtaaagaaattcaacaaacatggcaaagacctcaaaaccctgaaacgaatcataaagaaatatctaccgagcgaatacgcgaacatatttcgaaacaaaagcattaacgacaattatgttgcatacacaaaaagtaatataacatcaaacaaaagaacaaaagcgtcaaaatttactaaacaagaagacttctacaaatttatcaagaaacatctcgatacaattaaagaaaccaaacttaacagcagcgaaaacgaagacctgaaattaatcgacgaaatgctcacagatatagagttcaaaacattcattccgaaactcaaaagctccgataatggcgtaataccctaccagctgaaactcatggaactcaagaaaattcttgacaatcaatctaaatattacgacttcctaaacgaaagtgatgaatatggtacagtgaaagataaagtagaaagtattatggagttccgtataccgtattacgtcggtccattaaacccagacagcaaatatgcatggataaaaagagaaaacacaaaaattaccccttggaatttcaaagatatcgtagacttagactcaagtcgagaagaatttatagacaggttaatcggaagatgtacatatttaaaagaagagaaagttctaccaaaagcatcactaatatacaacgagttcatggtgctcaatgaactaaataatcttaaactcaatgagttcctaataactgaagaaatgaagaaagcaatttttgaagaattattcaaaaccaaaaagaaagtaacattaaaagcagtatcaaatttacttaagaaagagttcaatttaacaggggacatactactatcaggcaccgacggagactttaaacaagggctaaattcctacatagatttcaaaaacatcataggggataaagtagacagggatgactaccgcataaaaatagaggagatcataaaactaatagtcttatacgaagacgataaaacatatcttaaaaagaaaatcaaatcagcttacaaaaacgatttcactgatgatgaaatcaagaaaatagcagcactaaattacaaagactggggacgtctctctaaacgatttctgacaggtatcgaaggcgtcgacaaaacaaccggagaaaaaggctccatcatctacttcatgcgcgaatataatttaaacttaatggaattaatgtcgggtcactacacatttaccgaagaagtagaaaaactcaacccagtagagaatagagagctatgctacgaaatggttgatgaactttacctatcaccatccgtaaaacggatgttatggcagtccctaagagtggttgatgagattaaaaggataataggtaaagatccgaagaaaatattcatagaaatggcaagagcaaaagaagccaaaaattctcgcaaagaatcacgtaaaaacaaattacttgagttctataaattcggtaagaaagcattcataaatgaaataggagaagaacgatacaactacctactcaacgaaataaacagcgaagaagagtcgaaattcagatgggacaacctttacttatactacacacaacttggccgttgcatgtatagcttagaaccaatcgatctagctgatttgaaaagtaacaacatatatgaccaagaccatatatacccaaaaagtaaaatatacgatgactcattagaaaacagagtccttgtaaagaaaaatttaaatcatgagaaagggaaccaataccccatcccagaaaaagtactaaacaaaaatgcatatggattttggaaaatcctattcgacaaaggacttattggccagaagaaatatactcgactaacccgaagaacaccatttgaggaaagagagttagccgagttcattgaaagacagatagtagaaacccggcaagcaacaaaagaaacagcaaacctactcaaaaatatatgccaagattctgagatagtctatagcaaagccgaaaacgcgtccagattcagacaagagttcgacattataaaatgtagaacagtaaatgacttacaccacatgcatgacgcatatctaaacatagtcgttgggaacgtatataatacgaagttcaccaaaaacccgttaaatttcattaaagataaagacaacgtacgctcgtacaatctagaaaatatgtttaaatacgacgtagtaagagggtcctacacagcatggatcgcggacgatagcgaaggcaatgttaaagcagcaaccatcaagaaagtcaaaagagaattagaaggcaaaaattatagatttacaagaatgtcatatatcggcacaggaggtctatatgaccaaaatttaatgagaaaaggcaaaggacaaatccctcagaaagaaaacacaaacaagtcaaacatagaaaaatatggaggttacaataaagcatcctcagcctacttcgcattaattgaaagcgatggaaaagctggtagagaaagaacactcgaaacaataccaattatggtttacaaccaagaaaaatacggaaatactgaagcggtcgacaaatatctcaaggacaacctggaactacaagatcccaagatactaaaagacaaaattaaaataaattcattaataaaactggacggtttcttatataacataaaaggaaaaacaggcgatagcctttccatagccggttcagtacaactaatcgtaaataaagaagaacaaaaacttatcaagaaaatggataaattccttgttaaaaagaaagacaataaagatataaaagtaacatcctttgacaacattaaagaagaagaactgataaaactatacaaaacacttagtgataaattaaataatgggatttactcaaacaaaagaaacaaccaagccaaaaatatttctgaagcattagacaaattcaaagaaataagcatagaagagaaaatagacgtactcaatcaaatcatactacttttccaaagttataacaatggctgtaatttaaaaagcataggactctcagcaaaaaccggagtagtatttatacccaagaaattaaattacaaagaatgtaaactaattaaccaatccatcactggattatttgaaaacgaagtagacctacttaacttatga

SEQ ID NO: 5405 - RNA, 4098 nt, synthetic construct
  misc_feature 1..4098: note = Cas9 variant
  source 1..4098: mol_type = other RNA
atgtacaagaaagattataccgtaggacttgatataggcagcacaagcgttggattcgctgcaatagacgacgactaccaacctatcagattaaaaggtaaacgcgttatcggggtcagactatttgaagaaggaaaaacggcagcagaaagacgaaatttccgcacaacgcgtcgaagattaaatcgaagaaaatggcgacttagtttacttgaagaaattttcgacccatatatggctaaagttgatcctactttcttcgctcgattaaaacaatccaatctcttccccaaagacaaaaacaagaaattcaccggatcacttctattcccaaaaacaactgacagcaaattttatgatgaatatccaactatttatcatctccgatatcatctaatgaacgatagtcgtaaatttgatctaagagaaatattcttagcaattcatcacatagtaaaatacagaggaaatttcctcaattccgcccccatcgcttccttctcaacagataaaattaatctcgtagacgacttcgaaaccgtcaacgccgcatacctccaaataaacagctccaatcctgtacagttagatactgaccaagcggatcaagtaagcagaatcctgctcgataataaactaagcaaccttgacaaacaaaaacaagcagctaaagcactagcacagaaaagtggggacaagaaacaagacaaaataaataacacaacaataaaacaaatatgtaaagccttattaggttacaaatttgacctagctgtagtactaaatatagacagtgacgaccacaacaaatggaaactgcaactcagtgatgaaaatatcgactcgagactcgccgaactcactggagaactcaacgaagcccaattggacatattaaatgtcctgagccgattatatagccagattacactaaatgatatcgtacccagtgggatgacactatccgaagctatgatcgaaaaatataaagcccataagaaacatttaaaaatgctaaaagattttgccagatcacttagtaagaaagactatggtcaagtaatggaggcttatgccgaatacataggaaatatacccgaatcagcctcctctaaagctcaaaagaaaatcagccaagacgacttctacaagaaaataaaaagatatctagacgattccaaactgggacagaaaattgcagaattaatcgccaaaaatgaatttatgccaaaacaacgaactaatcaaaacggcgtaataccttaccaactacacttaaaagaactcaatcaaataatagaaaaccaatcaaaatactatccgtggctagcagaattaaatcccaacgagaaaaggagaggaaaagcaaaatataaactttccgaacttgtagcatttagaatcccttattatgtaggaccactaattacacaagaagaacaacaaaagaccagtaacgcaaactttgcatggatgatacgaaaaagcgaaggtaggatcacaccatggaacttcgatgaaaaagtcgatcggatagcgactgccaatcgtttcataaaaagaatgactacaaaggatacatacctaattggtgaagatgtcctaccagcacactcattactttatgaacgatttaaagtactaaacgaattaaacatgattagagttaataaccaccgattatcagtcggacaaaaacaagatgtattcgaaaaactcttccaaaaacacaaaaccgtaaagactcgagaactcataaaacaactaatggcttcaggcttaccaacgcaaccaagaataacaggattatcagaccccgcaaaatttaacacaagcctaggaacatataataacttcgccaaaatactcggagacgaaataaaccaaccagaccgtcaagaagactttgagaaaataatcgaatggataacaatattcgatgataaagatattttaaaaactaaactctccgaattatcatggctggacgaaaaacaaattaatgccttaattaacaaaaactattcaggatggggacggttatcacgaaaactactaacagaattaaccaacaagaaaggacaatcgataatagaccgcatgtggaacacacagaaaagttttattgaaatcatcaatgaacccgtctttgcagaacaaattaaagacgccaaccaagaccaacttgatgaagacgactacgaaaccgttctacacgatgcctatacgtcaccacaaaacaagaaagccataagacaagttattaaagtagtcgatgacatagtcagagccgccggcagagcaccaaaattcatttcactagaatttgcacgcgaagaccaggaatcgagaagaacccaatctagactatctcggataaagaaaatttacgaaacaaccaccaaagagctagtagccaacgatcagataagagaagaacttggaaacgtcaaagatctaaacgatcgattgttcttatattttacccaactcggaagagacgcttatactggagaaaggataaacatcgatgatatatccacaaaatacgatatagaccacatattcccccgcgcatttatcaaagacgactccctcgataataaagtgctagtaaaaagagctgttaacaatggaaaaagtaataatgtaccactcaaactcttcggagccaaaatgaaaccaatatggaaaatgtggaaagaccatcaactaatttctaaacgaaaatatgaacacctaatgactaaccccgacgcaatcgataaatacaaagccaatggattcataaatagacaactaattgaaacacgtcaaataataaaactagccgcaaatatactcgcaaacagatattcgacagaagacacgaaaatcatagaagtcaaagcaaatctcaatcaccaacttcgacaatctttacacctttacaaaaaccgccaagtaaatgactatcatcacgctgtcgatggctacttatcagcatttgtcggccaatacctataccaccgatacccgagtctacaaagctacttcgtatacggtcaataccagcgattcttcgataaacaagttcaagaaaacatgaaatttaacagattcaactttctatatgacctcacagacagagataacgatcaaatagttgtcaaaagtacaggcgaaatcgtaggagaaaaatccaaactcatagaacaaattaaatgggtatatcgctacaaattcatgctagtaagccaagaggtattcaccaaaactggacctttgttcgatcaaacaatataccctgcagggagtaataaatcacgattaataccaatcaagaaagacagacccacagacatatacgggggatatagctcgtctacagacgcctacatgagcctcatcagggtcccagataagaaagaagacaaatacaaagtagtcggagtaccttcccgaagtcttgcatctctaaatcgagcagaaaaacgcgggcatgatgcatacttagatcaattgagacaagtaatcgccaaatcacaaaagaaagagttccaaataataatacccaaactcagatacagacaacttataatcgacggaggattgaaatataccttaggctcatccgcctatcaatacaacgcacgtcagctcgtcctatcagaaaaatctatggaagtcctagtaacagacttttcaaaagtaacaaccgatttagacaaacaaaaccaaaaactcatcgctgtatacgacgacatactagacaaagtaaatcgatgtttacctctatacgacaaaaatcaattcagaaaagccctcaatggtgcccgtgacaaatttgtacagttgcctatactaccaaaattcaacggaaacaagaaagaagaagcaggtaaagttgaaatactaaacgaaattttattaggactccacgatgatgctagcacaggaaatctcaaacctctaggaataaaaacgccctttggaatgctccaaacacaaagcggtataacgatgtcatctaatgctgtaattgttaaccaatccccaacaggactctttgagcaccgtatatatctcaaagcgctactaaacaaattaaacaaatga

SEQ ID NO: 5406 - RNA, 4098 nt, synthetic construct
  misc_feature 1..4098: note = Cas9 variant
  source 1..4098: mol_type = other RNA
atgaccaaacttaatcaaccttatggcattggacttgatataggctcaaattcaataggattcgctgttgtagacgccaatagccatttattgagattaaaaggagaaacagcaatcggagctagattatttagagaaggacaaagcgcagctgacagacggggatcaagaactaccaggcgacgattatccagaacaagatggcgccttagcttccttagagatttctttgcgccccatataaccaaaatagacccagacttctttctaagacaaaaatactctgaaatctcacctaaagacaaagaccgatttaaatacgagaaaagactatttaacgatagaacagacgctgaattttatgaagactatccatctatgtaccatctacgactacaccttatgacacatacccataaagccgacccaagagaaatatttcttgcaattcaccatattctgaaatctagaggtcatttcttgacaccaggcgctgcaaaagattttaataccgacaaagtagatttagaagacatatttccagctttaacagaggcttacgcacaagtatatccagatctagaattaacattcgatttagcaaaagccgacgattttaaagccaaacttttagacgaacaggccacgcccagcgatacacaaaaagcccttgtcaagctattactatcctcggacggagaaaaagaaatcgttaagaaaagaaaacaagtccttacagaatttgcaaaagcaataactggactaaaaacaaaatttaatttagccttagggacagaagtcgacgaggcagacgcatctaactggcaattctctatgggccaacttgatgacaaatggtcaaacattgaaacatcaatgacagaccaaggtacagaaatatttgagcaaatacaagagttgtacagagcaagacttttaaacggtatcgttccggcaggaatgtcactttcccaagctaaggttgcagattatggccaacataaggaagatctggaactttttaaaacatatcttaagaaattaaacgatcatgagctagccaaaactattagaggcttatacgaccgatacattaatggagatgacgccaaaccctttcttcgtgaagatttcgtaaaagcactaacaaaagaagtcactgcacacccaaatgaagtatcggaacaattactaaacagaatgggacaagcaaattttatgttaaaacagagaacgaaggcaaacggagcaattccggtacaacttcagcagcgagagctcgaccaaatcatagctaatcaatcaaaatactacgattggttagcaaaaccaaatcccgtcgaaaaacacagagcaagtaaaccatatcaactagacgaattactcacattcagaataccatactatgttggacccttaataacgccaaaacaacaagccgaatcaggagaaaacgtgttcgcatggatggttagaaagaatccctccggaaatataacgccctacaactttgatgagaaagtagaccgagaagccagcgctaacacctttattcaacgcatgaaaacaactgacacgtacttaatagacgaagacgtactacccaaacaatctctactctatcaaaaatacgaagttttaaacgaacttaataatgttcgcatcaacaacgaagccctaagcactgaccaaaaacaacgactaatacatgaagtttttgaaagacattcatcagtcactattaaacaagtagtagataacctagtagcacacggtgattttgcacaacgtcccgaaataagaggacttgctgacgagaaaaggttcctctctagtctatctacgtaccatcaactgaaagaaatattacacggagctatagatgattccacaaaattgcacgatatcgaaaatatcattacatggtcaacagtcttcgaagacgctgctatattcaaaaccaaactagctgaaatcgattggctagacccagctaccataaagaaactcagtaacattcgctatagaggatggggacaatttagtagaaaattgctcgatggcctaaaacttgggaatggtcatacagtaatacaagagttaatgttaagcaatcataatttaatgcaaatattagccgacgaaaccctaaaagaaactatgaccgagttaaaccaagacaaattaaaaactgatgatatagaagacgtaataaatgatgcatacaccagccctagcaataagaaagcacttcgtcaggtccttagagtagtagaagacataaaacatgccgcgaacggacaagacccaagctggttatacatcgaaacggctgatggtacaggcacagcaggtaaaaggactcaaagtagacaaaaacaaatccaaactgtttatgcaaacgcagcacaagaactaatagacagtgctgttagaggagaattagaagataaaatcgcagacaaagcatcattcacagacagattagttttatactttatgcaaggcggccgagacatatatactggagctcctctaaatatagaccaattgtctcactatgacatcgaccatatactaccccaaagtttaataaaagatgactcactcgataatagagttctagtaaatgccacgattaatagggagaaaaataacgtattcgcgagcactctatttgctagtaaaatggcagcaacatggcgtaaatggcacgaagcaggattgatatcaggacgaaaactaagaaatctaatgttaaggccagacgaaacagacaaattcgctcacggattcgtcgctcgccagctagtagaaactagacaaattatcaaattaacagaacaaattgcagcggcacaataccccaacactaaaataattgcagtcaaagcaggcttatcacaccaattaagagaagaactcgattttcctaaaaatcgtgacgtaaatcattatcatcatgccttcgatgcgtttttagcggcaagaataggtacatatttactaaaacgctaccccaaactagcacctttctttacgtacggcgaatttgcaaaagtagatgttaagaaatttagagagtttaattttatcggagccctaacccacgcgaagaaaaatatcattgctaaagatacaggtgaaattgtatgggataaagaacgcgacatacaagaattagaccgaatctacaacttcaaaagaatgctaattacacatgaagtacactttgaaaccgcagacctattcgaccaaaccatttatgcagcaaaagattcaaaagaacgaggtggacgaatgtctctaataccgaagaaactaggctacttaaccggtatctatggaggataccaaaccgaaagaggatcatatgtaagtataattagaacttttaagaaaggcgaaaccatttataaagtcgttaacatacttacagcggacgtttccctcctatctgaaaaagaaaaagtatcgaaaaccctggcagatatttacctgaaagaattaatcgctaagaaattatcgaaaggaaaatcggggaaaaacatagcctcggaaccatttgaaattgtactacctagagtaggaaaagactccttattcaaaaacaagaaatacggattattccttatagaatctgcgacggaacttcacaattatcaggaattatggttaccaagaaatgaccaactattaataaaaaggatacaagcgcgacaaattgaagaatcaaaagccgattacgagctcacacgtatgtaccgcaatattgcgtggcaagtagaccattacttcagattatataaaattcgaaaattcgctgaaaaactacaagcgtcagtcgaggattttgcaggattacctgtatataaaaatgaaacctcagacggaaaagtcgaagtattagctagtgtactgaaaagactaaacggggcagcagataaaggaagaacaaatccaaccacagtcaaacttcagagcgacttcggaagaactctattaaccaacggtattgttctagaagatgatagttccatagtatatcaatcacccaccggactttttaaacgaagtgtaaaactcgtcgacctatga

SEQ ID NO: 5407 - RNA, 4098 nt, synthetic construct
  misc_feature 1..4098: note = Cas9 variant
  source 1..4098: mol_type = other RNA
atgacaaaagaatactacttaggacttgacgtaggaacaaactcggtaggctgggcagttacggatagtcaatataacttatgtaaatttaaaaaaaaggatatgtggggcataaggctttttgaatcagcaaataccgccaaagaccgcagattacaaagaggaaatagacggagactggaacgaaaaaaacagcgaatcgacctccttcaagaaatatttagccctgaaatatgcaaaatcgacccaacattcttcataagacttaacgaatcaaggctgcacctcgaggataaaagcaatgacttcaaataccctctctttatagaaaaagactattccgatattgaatattacaaagaattcccaaccatattccatctgcgaaaacatttaatagaatccgaagaaaaacaagacattcggttaatttacttagcgttacacaatataataaaaacaagaggacactttttaatagacggagacctccaatctgcgaaacaactgaggcccatattagacactttcctactatcattacaagaagagcaaaacttaagtgtctctttaagcgaaaatcaaaaagatgaatatgaagagattttaaaaaatcgaagcatagcaaagagtgaaaaagtaaaaaagctaaaaaatctctttgagatttccgacgaattggaaaaagaagagaaaaaagcccagtcagctgtaatagaaaacttttgtaaattcatcgtagggaataaaggagatgtatgtaaatttttacgagtaagcaaagaagaacttgaaatagattccttttcattttcagaaggaaaatacgaagacgacatagtcaaaaacctagaagagaaagttcccgaaaaagtatatttatttgaacaaatgaaagcaatgtatgactggaacattcttgttgacatattagaaaccgaagaatacatatctttcgcaaaagtaaaacagtacgaaaaacataagactaacttaagacttttaagagacataattctcaagtattgtacaaaagatgaatacaatagaatgttcaacgacgaaaaagaagccggatcatacaccgcatacgtcggaaaactgaaaaaaaacaataaaaaatactggatagagaaaaaaaggaatccagaagaattctacaagagcctcggcaaacttttagacaaaatagaacctttaaaagaagacctagaagtcttaacaatgatgatagaagaatgcaaaaaccacactctattacccatacagaaaaacaaagacaatggggtgataccccaccaagtacacgaagtcgaattgaaaaaaattttagaaaacgcaaaaaaatattattccttcctaaccgaaacagacaaagacggatactcagtagtccaaaaaatagaatcaatatttagattccggattccctattacgtggggccattaagcacacgccatcaagaaaaaggttctaacgtctggatggtaagaaaaccaggaagagaagacagaatatatccatggaacatggaagaaatcatagattttgagaagtcaaacgaaaattttataacaagaatgacgaataagtgtacttatttgataggagaggacgtactaccaaaacactcactgctatactcgaaatacatggtactaaacgagctaaacaatgttaaagtacgaggaaagaaattgcccacaagtctcaagcaaaaagtctttgaagacttattcgaaaataaaagtaaagtcacaggcaaaaacctgttagaatacctacaaatacaagacaaagacatacagatagacgatctatcgggatttgataaggacttcaagacaagcctcaaatcgtaccttgattttaaaaaacaaatttttggagaggaaatagagaaggaatccatccagaacatgatagaagatattattaaatggattacaatatatggaaatgacaaagaaatgcttaaaagagtcataagagctaattacagcaaccaactaacagaagagcaaatgaaaaaaataaccggatttcagtactcaggatggggaaatttcagtaaaatgtttctcaaaggtatatcaggttccgatgtaagcaccggagaaacgttcgatatcataacagcaatgtgggaaacagacaacaatctcatgcaaatcctttccaagaaattcacattcatggacaatgtagaagatttcaactcaggaaaagtcggcaaaattgacaagataacctacgattcaacagtcaaagaaatgtttttgtcaccagaaaacaaacgcgcagtgtggcagaccatacaagtcgcggaagaaataaaaaaagtcatggggtgcgaaccgaagaaaatattcatagaaatggcaaggggaggagaaaaagtgaaaaaacgaacaaaatcaagaaaagcccaattattggaactatatgccgcctgcgaagaagactgtagagaattaataaaagaaattgaagacagagatgaaagagacttcaactcaatgaaactctttctttattatacccaattcggaaaatgcatgtattctggtgatgacatcgatataaacgaactaatcagggggaactcaaagtgggatcgcgaccatatatatccacaatctaaaataaaagatgattcgatagataatctcgtgctcgtcaacaaaacatacaacgcgaaaaaaagtaatgaattactatcagaagacatacaaaaaaaaatgcactctttctggttatcattactaaataaaaaactcataacaaagtcaaaatacgaccgactaacaagaaaaggggattttactgatgaggaactctcaggattcatagcaaggcaactcgtagaaaccaggcaatcaacaaaagcaattgcagatatattcaaacaaatttatagtagtgaagtagtttacgtcaaatcatccctcgtatcagatttccgaaaaaaaccattaaattacctaaaatccagaagagtaaacgactaccaccatgctaaagacgcctatctaaatatcgtagtgggaaacgtatacaacaaaaaattcacaagtaatccaattcaatggatgaaaaagaacagagacacaaattacagcttgaacaaagtatttgaacatgacgttgtaatcaacggagaagtaatatgggaaaaatgtacatatcatgaagacaccaacacatacgatggaggaacactcgaccgaataagaaaaatagtggaaagagataacatactgtatactgaatatgcatactgcgaaaaaggtgaactattcaatgcaacaattcaaaacaaaaacgggaacagcactgtttcactaaaaaaaggtttagacgtcaaaaaatacggaggatacttctccgcaaacacatcatacttttcactcatcgaatttgaagataaaaaaggcgacagagcaagacatataattggagtaccaatatacatcgctaatatgctagagcattcaccaagtgcatttctagaatattgtgaacaaaaaggataccaaaatgtacgaatcttagtagaaaaaataaaaaaaaatagcttacttataataaatggatacccattaagaataagaggtgaaaacgaagtcgacacttcattcaaacgcgcgatccaactaaaacttgatcaaaagaattacgaattagtacgtaacatcgagaaatttctggaaaaatatgtagaaaaaaaaggaaactatccaatcgatgaaaacagagatcacattacacatgaaaaaatgaaccaactatatgaagtactactaagtaaaatgaaaaaattcaataaaaaaggaatggctgacccctcagatcgtattgagaaaagcaaaccaaaattcatcaaactagaggacctaatagataaaataaacgtaataaacaaaatgttaaatctactccgatgtgacaatgatacaaaagcggatctatcattaatagaattaccaaaaaacgcaggtagttttgttgtaaaaaaaaatacaatagggaaatcaaagattatactagtcaatcaaagtgtaacaggcctctatgaaaaccgacgggaattatga

SEQ ID NO: 5408 - RNA, 4098 nt, synthetic construct
  misc_feature 1..4098: note = Cas9 variant
  source 1..4098: mol_type = other RNA
atggacactgccaaaaccaacaaacaaccctattacattggcttagacatgggtacctcgtcagtcggatgggctgtcacagacgcttcctacaatgtggtcaagaaacacggaaaagccttatggggtgtccgtttgtttgaagaagcacaaaccgcagctgacagaaggttacatcgaacagctaggcgtcgaatacaaagaagaaaacaaaggcttgcattattacaagaattatttgcaaaagaaatatgcaaagtcgatccgggcttcttcatacgactacacgaaagcagactatggcaagaagataaaagcatagatcaacctaacactttatttaatgatgaagatttcgacgacaaagcataccataaagcctatccaacaatataccaccttagatacgccttaatgacagaaaacaagagcttcgacgtcagactggtttatttagctatacatcatataataaaacaccgcggccatttcctactagaaaattatgacctcagtaatcaagaaacaagtggatttgacgaatcttatattgccctgacaaacgcaattaaagaacttctccaaaaagagattccagttggacatgtggagaaaattcaaataatacttaaagacaaatcgctatcaaaaagagagaaaacagagaaaatcctacaagtttgggacgtaataaaagataaacaattaaaagaagtggtacaattaatatgtggcggtacagcaaatctctcaaccttattcatggacgaatccctaaaagaagcactaaaagtatttgaaatcaaagactcaaaaattagcttctcaactgcggtgtatgaagaaaaagaatcagacctacaaagcgtactagaacaacgatttgacctagtctatgctgccaaaatgctgtacgattggtctcttctagcagaactaatgggcgatagaaaaaccctatcagaagcaaaaattgcaatatacgaaacacataagaaagatctagaagtcttaaaacgtttaacaagacaagataaatctctataccgcaaattattccgaggaaccgacaaagattcatatagcgcatacgtgggaagctgcatgatacatggagaaaaattagtaatagagaaaagaggctcaaccgaagaattttacaaatttctcaagaaagaaatttcgaaactaccagattgcgaagataaaatttacgtactctcaaaaattgaggcagaaaacttcttaccaaaggcagtatccaccataaatggaataatcccttatcaactacaagagcaagaattagacatcattctaaagaaggcggaacagtatctaccattcttaatggaaaaagacgcatatggaacaataagtgagaaaataaaacaattactcacattccgtattccattctacgtaggacccttaaatagacacagcgataaatcatgggctgttcacactgataaagaaggaaggatcctcccttggaactttaatgaacgcataaatgaagagaaaagcgccgaaaagttcataacaagaatgaccaacaaatgcacctacttgttaggaaaagacgtactacccaaaaactctctattatatactgaatatatgctatttaatgaactgaataacgtcaagatcggcaaggcaggaacctatttgactgaagaacaaaaagaaaaactgtggaaagaactatttcttactacaaagaaagtaacactaagtaaattcagtaaattcctaattaaagaaggaatcgataaagaagaagcggtcgaaataaaaggattagacggtggatttaaatcatcgttagcaccgtggatagatcttaaaaacatactaggggaagactttacaagggacaaagcagaagaaataataaaggctatcacattatttagcatggataagaaaatactcaagaaatatttaatgagaatagttagtgaaccagttgcaaaacagttatcaaaactacgatatactggttggggcagattctcaaaagagttcctcacggaaataacaccccgagtgacagacgatgtccaagtacttgtcgacacaagcactggtgaaataatgaacatcataacagctttaaagaaaacgtcattaaacctaatggaaatattaagttcaacgtacggttactcagcagcaatttctgaagccaacaaagaactggttggtaatacagtactcagctacgaaacagttaaagaactgacggtaagcccagctgtaaaaagaccaatatggcagacactaaaaataataaaagaaataactcatatcatgggtgcagaacccgcacgaatattcatcgaaatggcgcgagacaaacaacctgacaaaggtagaaccgattcacgtaagaaacaattgatcgaactatacaagaaatgtaaagaagacgttcgctcttggagcaatcgagaaagcaaagactgggtcgaagaaatagaatcaaaatcagattcccaactccgatccaataaactatttctatattacacacaaatgggcaaatgcatgtatacaggcaaacctatagacctcggagcactcctaaagggacaactatacgacagagatcacatatacccgcaatcacaaacgaaagacgatagtctagacaacctagtaatagtcgacaatcgagaaaacagagacaagtccaacacatatccattatccaaaaatatcagagaaagacaaattggattctggaaactattaagagacaaaggattcatatctaaagaaaaatacttccggctaactaggaatacccccttttccgacgcggaaaaagcggaatttatagcgagacagctagtcgaaacccgacaatcaacaaaagcagtcgccgaaatacttaaacgtgtattaccaaaatcaattatagtgtatgtaaaagcgggactgacatcaagattcagacaatatggagaatttataaaagtaagggatcttaatgattaccatcatgcaaaggatgcctacttaaatatagtaactggcaacgtacattacacaaaatttacatccaatcccatacgcttcgtaaaagattgccaaatttattcactgaacgaacacgccctctacaaatatacggtagaaagaaatggagtagttgcatgggcccctaatgaagaaggaatgatgccatccgtaacgagatggatgaacaaaaacaacatcctagtcacccgcatgagctatgttggtcaaggcgaactattcgatcaactccctctcaagaaaggcaaaggacaagtatcattaaagaaagaaggagcgatttctgacatttctaaatacggcggatataactctgcctcaactgcatacttcatgtacgttgaaggagaagacaacaaaggaaaacccgtctacgtaatagaaaccatgcccctacatttagcagcacgcctcacaacactagaagaaaaacaaaagtattgtgaagaattatggatgtccacaggcggcaaacttaaaaaccctaaagttctaatagaacaaatccctatacaaagtttattctcagtagacggattcagagtgaccatcgcaggaaaaactggaaaacaatacgggtgccgattagcagaagaactcgtactaaacaacggatatgcaatgacgctaaaggctgtattaaaattcgtgaatcgaagaaaaatgaataaagaagcacttattacaagttatgaccatctagaagaaagccagttactagcattgtacgacgtatttttagacaaactagagcactcgtgttttagtaaaagattcagcacacaaagagatgttttaaagaatgggcgcgaaagttacatcgcactatcactagaagacaaatgccaaatactctcagaaatcctacatctttttcaatgcaacgctacattatccaatctgtccttactcggatcttccaaacagtccggacgattatacatgagcaaaaatctatcagataaagattcatggtacataatccatcaaagcgtaacaggtttttacgagcaacacataccactagcaccctacaagaaatcatga

SEQ ID NO: 5409 - RNA, 4098 nt, synthetic construct
  misc_feature 1..4098: note = Cas9 variant
  source 1..4098: mol_type = other RNA
atggtgaaaaagaaatatgccattggcatagatataggaacaaactcggtaggttggtcggtcgtcacagatgactacaaagtacccagtaagaaaatgaaagtctttggaaatacagaaaaacgatatattaagaaaaatttattaggaacattattatttgatgaaggcaatacagcagaaaaccgaagattaaaacgaacagcaaggagaagatacactcgcagaagaaatagaatactctacttacaagaaatattcgcagaagaaattaacaaaatagatgactcattctttcaacgattagatgactcattcttaatagtggaagataaacaaggatccaaacacccaatctttggaacgttacaagaagaaaagaaataccataaacaattcccaacaatataccatctaagaaaacaactagccgactcctcacaaaaagccgacatacggctaatatatctcgcactagctcacataataaaataccgaggacacttcttgttcgaaggtgacctaaaatcagaaaacaaagatgtccaacatctttttaatgacttcgtagaaatgtttgataagacggttgaaggatcatacctcagtgagaatttgccaaacgtagctgacgtattagtcgaaaaagtctcaaaatcaagacgactcgaaaacatactacactatttcccaaatgagaagaaaaacggactattcggcaactttttagcattagcactaggcttacagccaaattttaaaaccaatttcgaactcgctgaagacgccaaaatccaattttctaaagaaacatacgaagaagaccttgaagaactcttaggcaaaattggcgatgattatgccgatctctttattgcaaccaaatctctctatgacggtattctactcgctggaatactgagcactacggattcaacaacaaaagcacccttatcctcttctatggtaaatcgatacgaagaacataagaaagacctcgctctactgaaaaacttcattcaccaaaacttaagtgactcatataaagaagtattcaacgataaactgaaagatggatatgcaggatacatcgaaggcaaaacaacccaagaaaacttttacagattcataaagaaagcaatagaaaagatagaaggttcagactactttatagataaaatcgacagagaagatttcttaagaaaacaacgcacgtttgataatggctccattccacaccaaatccatctccaagaaatgcacgcaatcattagacgacaagcagagttctatcctttcctcgtagaaaaccaagataaaattgagaaaattctcacattccgaataccttattacgtaggacccctcgcaagaggcaagagcgagttcgcatggctaaaccggaaatctgacgagaaaatacgcccatggaacttcgatgaaatggtagataaggaaacatcagcagaaaactttataaccagaatgaccaactatgatcaatatttaccagaccaaaaagtcctacctaaacattctctactttatgaaaaatttgcagtatataacgaactaacaaaagtaaaatttattgcggaaggtatgcgagactatcagttcctcgactccgggcaaaagaaagacatagttaaaacactcttcaaaaccaaacgaaaagtaacagcaaaagacataaaagcctatctagaaaacagcaacggatatgccggcgtagaactgaaaggtcttgaagaacaattcaatgcgagcctaccgacataccacgacttactgaaaatattaagagataaagcattcatagacgcagaagaaaatcaagaaatattagaagacatagttctaacattaacactattcgaagacagagaaatgatacgaaaaagattagaaaaatacaaagatatactaaccgaagaacaaagaaagaaactcgaaaggcgtcactataccggatggggacgattgagtgcaaaattgataaacggcatactggataaagtaacccgcaaaacaatcttaggatacttaatcgatgacggaacgagcaatcgaaatttcatgcaacttatcaacgacgataccctctccttcgtagacgaaataagactagcacagggatcaggagaagcagaagactaccgcgccgaagtacaaaatttagctggatctccagccattaagaaaggaatccttcaatcgctaaaaatcgtagatgaactcatcgaagtaatgggatatgacccagaacacattgtcgtagaaatggcaagggaaaatcaatttactaaccaaggtcgacgaaactcacaacaaagatacaagaaaatcgaaaacgccattaaaaacttagactcaaacttaaacagcaaaatattaaaagaataccccactaacaaccaagctctacaaaatgacagattatttttgtattatctccagaacggaaaagatatgtatacagacgaagaattagatatagaccaactcagtcaatatgacatagaccacattataccccaagcattcatcaaagacgatagtttagataacaaagttcttacaaaaagtgccaaaaacagaggcaaaagcgacgatgttccatccttagaaatagttcacaaaaagaaaaatttctggaaacaattgttagactcccagctcatatcacagcgaaaatttgacaatttaacaaaagcagaaagaggcggactaacgaatgaggacaaagcaagatttattcaaaggcaactcgtagaaacacgccaaatcaccaaacacgtagctaggattttagacaccaggttcaacacgaaactagacgaagccgggaaccgaataagagatcccaaagtaaacataataaccttaaaaagcaatttggttagtcaattcagaaaagactatcaactatataaagtacgagaaattaacaattatcaccacgcacacgacgcctacctaaacgctgtagtcgctacagctctcctaaagaaatacccacaactagcaccggaatttgtatacggggactaccccaaatacaatagctataaatctagaaaaagcgccactgaaaaagtactcttctattccaacattatgaacttctttcgcagagtcctagtatatagcaaaaccggtgaagtacgaataagaccagtaattgaagtcaataaagaaacaggcgaaatagtttgggataagaaaagcgacttcagaacagtaagaaaagtactctcatacccacaagttaacgttgtgaagaaagtagaaatgcaaacaggaggtttttcaaaagaatcaatactacaacacggcgattcagacaaattaatccctagaaaaaccgaaaaattctacctagataccaagaaatatggaggttttgattcccctacaatagcctacagcgtattattaatagccgatatagaaaaaggaaaagcaaagaaattaaaacgcgtaaaagaactcataggaataaccataatggagaggatggcttttgagaaaaaccccatagaatttttagaacacaaaggctataaaaatattttagagaaaaacattataaaactaccaaaatatagtttatttgaactagaaaacggaagacgtagactcctcgcttctgcaaaagaattacaaaaaggaaacgaaatgatcttaccaccacatttagtaacccttttatatcatagttcaaatatccataaaataacagaaccaatccacctaaattacgtaaacaaaaataaacatgagttcaaggaattattaagacatataagcgatttctcaaccaggtatatattagcacaagaccgattatcaaaaatagaagaattatacgacaaaaatgacggggatgacatatccgatttaacctcgagtttcgtcaatcttctcacttttacagctatcggcgcccccgccgcctttaaattcttaggctcggtcatagatagaaagagatatacaagcatcgcggaaatattagaagctacccttatacaccaatccgtaacgggattatacgaaacaagaatagacctcagcaaattaggcggcgactga

SEQ ID NO: 5410 - RNA, 4101 nt, synthetic construct
  misc_feature 1..4101: note = Cas9 variant
  source 1..4101: mol_type = other RNA
atgaagaaaccatactcaatcggtctcgatataggaaccaactccgtgggttgggcagtgataacggacgactataaagtaccagcaaagaaaatgaaagtcttaggcaatacaaacaagaaaaccataaagaaaaacctaataggtgcactactttttgatgcaggaaacacagccgcagatagacgcttaaaaaggaccgcgagaagaagatatacaagaaggaggaaccggattttgtacttacaagaaatctttgccgctgaaatgaataaactagatgaatcattctttcaccgactagacgattcgtttttagtaccggaagacaaaggagggtccaaatatccaatattcggaacattagaagaagagaaagaataccacaaacaattcccaacaatctatcacctacgaaaaagcctagcagatagcaaggaaaaagcagatcttagattgatctacttagcccttgctcatataataaaatataggggtcatttcctatacgaggacacttttgacattaaaaataatgacatacagaaaatatttaacgagttcacatcaatatacaacaacatctttgaagaatcatccctatctaacgaaaatgcacaagtcgaagaaatattcaccgacaaaatatctaaatccgcaaagaaagatagggttctaaaactctttcctgatgaaaaatctacaggcttattcagtgaatttctaaaactaatagtaggaaataaagcagactttaagaagcatttcgatctggaagagatggcaccattacaattcagcaaagatacctatgacgaagatttagaatcattattggggcaaatcggagacgactatgcagacttattcgttgtcgcaaagaaactatacgacgcgattttactagcaggaatcctaagtgtaaaagacccagccacaaaagcaccattatcagcatcaatgatagaaagatatgataatcatcaaaatgatctatcagcactaaaacaattcataagaagtaacctaccagaaaaatacgcagaagtcttttcagatgactcaaaagatggttatgcaggatatatcgacggaaaaacaactcaagaaggattctataaatacattaaaaaccaaataagtaaatttgaaggtacaaaatatttcctagagaaaatagaaagggaggattttctaaggaaacaaagaacattcgataacggatcaattccacatcaaatccacctacaagaaatgaatgccattttacaaaatcaaggaggttattatcccttcctaaaagcgaacaaagagagaatagaacaaatactaacattcagaataccatactatgtcgggcctttagctaggggaaactctgacttcgcatggcttaccagaaactcagatgacgctatcagaccgtggaatttcgaagaagttgtagataaagcaagttctgccgaagatttcataaacaagatgacaaattacgacttatatttaccagaagaaaaagtcctccccaaacactcattattatatgaaacatttgccgtatacaacgaactaacaaaggtgaaattcatcgcggaagcaatgaaggattacgagttcctcgactcgggacaaaagagaaaaatcgttgaaaatatctttaagaatcatagaaaagttacagaaaaagatattattaattacttacataacgttgatggatacgacggaatagaaataaaaggcatagaaaaacaatttaacgcatcattatccacataccatgacctcttgaaaataataaaagataaagagttcatggataatcctaaaaacggagaaatactagaaagcataatccacaccctaaccatatttgaagacagagagatgataaaacaactgctagcacagtataattcagtattcgacgaaaaagtaataaaagcactaagtagaaaacattacactggttggggaaaattgtcagcaaaactaatcaatggaatcagagacaaacagacgggaaactcaattctagactatcttatggatgatgggaaatctaatcggaattttatgcaacttattaaggatgatggcctgagctttaaagaaataatagataaggcccaagttgtgggcgaaacagataatttacgccaagtagtacaaaacctaccaggatccccagccatcaagaaaggaatcttgcaatcgattaagctagttgacgaattagttaaagttatgggatcagacccagaatccatcgtaatagaaatggcaagagaaaatcaaacaaccaacaaaggtaaatccaaaagccaacaaagactcaaaacactaagcgacgcgatatctgaattaggcagcaacattttaaaagaacaccctacagataacatacaattgcaaaacgacagactattcctgtactatctacagaacggcaaagatatgtacacaggtgaagcactagatataaaccaattatcaaattacgacatagaccacatcatacctcaagcatttataaaagacgattcactagacaatagtgtgttaacgtcatcaaaagacaacagaggtaaatccgacaatgtaccttcgttagaaatagtagagaaaatgaaaggcttttggcaacaattattagattcaaaattaataagcgaaagaaaatttaacaacttaacaaaagtagaaaggggaggtttagatgaacgagacaaagtaggattcataaaacgacagctagtagaaacaagacaaatcacaaaacacgtagcccaaatcttagacgcaaggtttaacgccgaagtaaatgagaaaaatcaaaaattacgaagcgtcaaaataatcacactaaagagcaatttagtatctaatttccgaaaagagttcggcttatataaagtcagggaaataaacgactatcaccacgcacatgacgcatacctcaacgcggtaatagcgaaagccatactcaaggaatatccgaaattagaaccagagttcgtctacggtgactaccaaaaatacgacctaaaacgatatatatcccgaactaaagatccaaaggaaatagaaaaagccaccgaaaaatatttcttttattctaatttactaaacttctttaaagacaaagtgtattacgcagacggaaccataatccaaagagggaatgtagaatactctaaagacaccggagaaatagcatggaataaaaagagagactttgctatagtccgtaaagtattgtcatatccacaagtaaatatcgttaagaaaacagaagaacaaacaggaggtttctctaaagaaagtatactaccaaaaggtaactcagacaaattaatcccaagaaaaactaaaaatatccaactagacacaacaaaatacggaggatttgattctccagtaatagcttattcaatcttattagtcgcagatgtggagaaaggcaaatcgaagaaactcaaaaccgtcaaatcactcataggaataaccattatggagaaagtcaaattcgaagcgaatccagtcgccttcctcgaaggcaaaggctatcaaaatgtagtcgaagaaaatattatacgtctaccaaaatacagtttattcgagttagaaaacggccgaaggagaatgctagcatcaagtaaagaacttcaaaaaggcaatgaaatggtattaccaagttatctattagcgctactctatcacgctaagaaaatccaaaagaaagacgaaccagagcatctagaatacataaaacaacatcattcagaatttaatgatttacttaattttgtatcagatttttcacaaaaatacgttttagcagaaagtaatttagagaaaattaaaaacttgtatatagataatgaacaaacaaatctagaagaaatagcaaatagttttataaacctacttactttcactgcatttggtgcccctgcagttttcaaattcttcggaaaagacatagaacgaaaacgatactccaccgtaaccgaaatactaaaagcaacgctcatccaccaatctatcacaggcttatacgaaacgagaatcgatctcagcaaactaggagaagaatga

SEQ ID NO: 5411 - RNA, 4101 nt, synthetic construct
  misc_feature 1..4101: note = Cas9 variant
  source 1..4101: mol_type = other RNA
atggataagaaatataacataggcttagacataggaacatcatcaataggcttcgtagcaactgatgaagataatcacgttatacgcgcaaaaggcaaaaacgtaattggagtcagattattcgatgaaggtcaatccgctgcagaaagaagaggatttagaacaactagaaggagattaaatcgccgaaaatggagactaaatttactcagagagatttttgaaccccacatatatcctattgatgccagtttctttatgagacaaaaatactcaaacttaagtaaacaagatccaaatcagaaaatagagtttaaagacatactattctcagataaatcagatgcagagttctaccgacaataccctacgatctatcacttaaggcaagccctcatgaccgagaaaagacaatttgatctccgagaaatttatttggcaatacaccacattgtaaagtacagggggcactttttagatgaaacccctacagataaattctcttttgaccaactcgacctaacccaagaatttgaacgtctcaatgtactctttagcgaacaaaaccctgaagaaccatttgaaatagttgtaaaccaaaaccaaagcatagaagatatcctttcaaaccaatccatgacagcatccgatcgaagaaaacaagccttagtagtattctatcaacaaagcgaaaataaagaaaacgaaaagcaatacaaagcaatagctacagaaatattaaatctacttttaggaaacaaagcgaaacttaatgtcattttagctcaagaagtcgacaaagaagcagccaaagattggtcactatcattatcaagtgaaacatttgacgacgacttagaaaaagcctcatcaggactaaacgactcccaattggaaatggttggaatatttgaacgaatatatagttctctgattctaaaatcaataattggagaccataattcgctctctgcagctatggtagataaattcaaaacccacgcgcaacacagggacctcttgaaggacgtcattaaaaattcagacgccacaaaaggcgaacaacttcagttcgcttacgaccactaccttcaaagacacagcgccgacgggaaagcatatggaaaagacgacttctataaagaagtaaagaaaaatctagacgatagtgatgctgcacaacaaatccaacaactaatcgacacagaccaattcatgccaaaacaaagaacaaaagccaacggtgctattcctcatcaagtccaacaaaaagaactagacttaataatagaaaatcaatgtcaatattacccatggctagcggaagaaaatccgaatagcgaaagacataatgtagccaaatataaattagatgaattagtgtctttccgagttccatactacgttgggccgctaatttcgccggcagacgatgaaacagatccccaggccatccaaaatacaaaattcgcatggatgatacgaaaagatgcgcaaggcagaataacaccctggaatttcgatgacaaagtggatagagaaaaatcagcagataaatttataaaacgaatgacaacaacagatacctaccttatcggagaagacgtcctaccagatcagtccctaatataccaaagatacaaagtcctaaacgaactaaacaacgtaagaatcaacggacgacccatagaagtccaaattaaacaaaacatatataccgacctattcaagaaattcaaatcggtctcggtcaagaaattaagatcctatcttgaggaaatgtcctattatccaggctcattcaaaatatcaggattaacgaacccaggcaaattcgacaatggacttacttcatatctcgattacaaaaacatcctaggagactctgtcgacgctaatgataaaagagcggacatagaacaaatgatagaatggtcaacaatattcgaagataataaaatatttgcacaaaaactcgagtcaatgacatggctcaccgcagaacaacgtaaagcaatatcaagaaaaagatacacgggctgggggagactctcaaataaacttctcacacaacttaaaaaccaagacaacagatctattatggatctattatgggagacagaagaaaatttcatgaaaatacaatccgcacctgacttttctaaaatgatagaagcgcataatcaacaatttatcaaaaacgaagcaaacatccaacaagtaatcagcgatctttacacatctccacaaaataaaaaggctataagacaaatactattagttgtagatgatatacaaaaagcagtcggacatgctccagagcatatcgctatcgaatttgcaaaaggggaagacaaaaatcccagaagaactataagtcgagaaatgaaaattcaagacgtttaccaacaaatctcagatgatatcttagtctcgccggaagtacgagcacaactcaatgagaaaatagaaaatagacacggacgcctcagtgaccggctatttttatactttatgcaaggaggaagagacatgtatactggcaaacctattaacataaacaatataagtcattatgacatagaccacatcctaccccaggctttcatcaaggatgactccctcgataatagagtattagtctcagacaagctcaacagagaaaaatcagatacagtgccaagagacttgtttggccgagaaatgatgtctacctgggagaaaatggcagacagaggcctaatcacgaaaagaaaactggcgaacttaaaaacaatacctggaagcatcgacgcacacaaagcacaaggattcataaacagacagctagtagaaacaaggcaagtaatcaaacttgctgtaggaataatgattgaccaatatcctgaaacacaaatcgtaagcgtcaaagctaacttaacccacgaaatgagggagatgtttgacctcgttaaaaaccgagacgtgaatgactaccaccacgctttcgatgcatatctcactgcattcgtcggaaactacctattacaaagatatccgaaacttgagccctactttgtatatgataaattcaagaaattaaaagatcaaaacataagtatgcgtgactttaacttactgtacgacttgaagaaaaatgaggacgtatacgaccaacgtacaggtcactcagcacacaaaatatgggatcaacacgggtctatagactatattagacacctattcgcatataagaaaatacttgtttctcacgaagtacaccaaaacggaggcgcattatataacatgacagtatatggaaaagcagatgacgcaaaaagaaaactgataccaattaaagccgataaaccaacagaactttatggcggatatacctcaaggaaactagcctacatggcaatagtaaaaacaaagaaaggaaagaaagaacaataccaagtaacaggagttccagttagcgcactaacaaccctacgacaatttaaagaagactcaccagaacaaaaacaagcattagaagaaatagttagaaggaattttgatgagaaaacagaagtagaaataatagtacccaaagtactctttaatcaattaatagtagacgaaaaatgtagattcatggtagggagtgatacataccggtacaatgcacaacaattagtactatcagcggacgatctggaaatcatcaatgcttctcataaagacatacaaacgattgattcatccgattactcacaacaactggaccaagtatatcaaaatattctcactatagtagataaacattttcctatgtacgacataaacaaatttagaacaaaactacatgacatttatgaacaatatatagaactacctaatgaagacgtgtgggaaaataacaaattaacaacactaggcaaacatactatcattataagaatcctccaaggtttacatgccaacgccacagtagtagatctaaaacaactcggaataaaaactccattcggctttatgcagcaggcccgcgggattgtagtgagcccggatgcacaattaatataccaatccccaacaggactctatgagagacgcgttcggttaggagacttgtga

SEQ ID NO: 5412 - RNA, 4101 nt, synthetic construct
  misc_feature 1..4101: note = Cas9 variant
  source 1..4101: mol_type = other RNA
atgggcgatagaaaatacaatttagggctagacatcggaacatccagtatcggatttgccgccgtggatgaaaacaatcagccaatcagagtcaaaggtaaaactgcaatcggagttcgactcttcgaagaaggaaaaacagccgcggatagaaggggattcagaacaactcgaagaagattatctagaagaagatggagaataaatttactaaacggaatatttgacgcacacttagctgaagtagatcccacattcttagctagactgaaagaaagtaatagatcaaacctagatcccaagaaatcgttccaaggcagccttctattccctgaacgaaaagactaccaattctacaaagagtatcccacgatttaccacttacggaaagcattgatggaagaagatagaaaattcgatatccgagaaatctatttagcagttcatcacataataaaatacagagggaatttcttaaacggcacaccaatgaggtcatttaaagtagaaaatatagaattggacacactcttcgacaggttaaatcaattatatgaagaaataataccggacaatgagttggctttcgacctcgaacaagtggcagatgtcaaagaagtacttagctcaacaacaatatataaaatggacaaaaagaaacaattagtaaaaatgatgttattacccaccagtaacaaagctctacaaagcgaaaataagaaaatagtcacccagttcgtaaatgcaattctgaattataaattcaaactagatgtgctactacaggtcgaaacagatgccgactggtctcttaaattaaatgacgaaggagcagacgacaaattagaagagtttacaggagacttagacgaaaacagactcgaaataatagacctcttacagagactacacaattggttttcattgaatgaaataaccaaagacggaaattcgttaagcgctgccatggtggaaaaatataaagatcacagacatcacctagaattacttaagaaagtaatagaagaccatcctgacgcaaagaaagcaaaagcgctgaaagaaacatatacagcatacgtaggaaaaacagacgataaaacgcaaaaccaagatgacttctataaagccgtagagaaaaatttagacgactcgccagacgccaaagagattaaacgcttaatacaactagatcaatttatgccaaaacaaagaacagggcaaaatggcgccataccacatcaattacaccaacaggaacttgaccaaatcatagaaaaacaatctaaatactacccattcctggcagaaccaaacccaaatgtaaaaagacgaaaggatgccccatataaactagacgaattaatagcgttcaaaatcccatactacgtcggcccattagttaccccagaagaacaagctcaaaacggtgaaaacgtatttgcctggatgaaacggaaagttgcaggacccataaccccatggaatttcgataagaaagtagatcgaatggagtccgcaaacagattcataagaagaatgacgacaaaagatacgtacctattcggtgaagacgtactaccagcagaatccatgatatatgaaaagttcgttgtactcaatgaattaaacaatctaaaaattaatggcaggcatctatcactgaaagacaagcaagacatctacaacgacttatttaaacaacagaaaactgtatctatcaaagcactccaaaattactacgtaacaaagaagaaagcagcaaccgcaccaacagttgggggtctagctgacccaaagaaatttctttcctcactttcaacctatatagatttcaaaaacatgttcggagaacaggtcaatgacccacaattccaagaagacctagaacaaattgtcgaatggtccacaatatttgaggaccgcggcatatttaaagcaaaattacaagcactaggatggttatccgaaaaacaaatacaacagctagttgccaaaagatataaaggatggggaaggttgtcaaagaaattactaacaggcctgaaaaacgcagaaggatactcaatactagatgaaatgtggagaagcaccgaaaacttcatgcaaatacaaagccgaccagaatttgcagcacttatacaacaagctaatgaaaaacaattcgagggtaatgaccctaataatgtatgggaaaatatcgaaaacatattgggtgacgcatatacgagccctcaaaacaagaaagcaataagacaggtagtgaaagttgtacaagacatagaaaaagcagtaggaaacccacccgagaaaattgccatagagttcaccagggaagcagcagcaaacccgcaacgcactcaatcacgattaagaacattagaaaaactatatgaatctgcagaagaagtagttgatgcaagacttacggcagaattagcagagttcaaagaaaacaaacacgtattatccgacaaatattatttatactttacacaattaggtagagatgtatacacaggagacaccataagcctcgacagactcaacgactacgatgtagatcacatacttccacaatccttcataaaagatgatagtttagacaatcgagttttaaccataagagcagtaaataatggcaaatcagacaatgtacctgccaaaatgtttggaaagaaaatgggcagtttttggagatatctactagataacggcatgatcagtaaaaggaaatacaacaatttaataacagacccagacaatatctccaaatatgcacaaaaaggatttataaatcgacagttagtggaaaccagtcaggtcataaaattgactgcgaatatcttaaatggaatctacgataaagatacagaaataattgaagtacctgcaaaaatgaactcacaaatgagaaaaatgttcgatctagtcaaagtaagagaagtaaacgactaccatcacgcctttgacgcgtacctaacaatattcattggcaactacctttacaaatgctatcccaagctgagaccatattttgtgtatggaaaattcaagaaattcagcgataacgaagacatagaagtcggtgacggaagattcaatttcctaaatagaatagaacgacttaaaaatgtaacagatccagaaacaggagaaatattatggtcaaatgttgcaccaaacgaaactataaaaagaataaagaaagtatataactataaatttatgatcgtgtctcgggaaatcactacaagacgcgccgaactattcaaccaaaccgtctatccgaaaaattatcgaggaaaactaattccaatcaaagaagaccgtccaacagacttgtacgggggatacagtggaaacactgatgcatacttagcgatagtagcactcgaagataaaaagaaaggaaaatatttcaaagttgtcggaataccaaccagagcggccgctaaactagagaaattaaaacaacaggattctcaacagtatcttcaagcagtccacgaagtcatagcacctcaatttacaaaaagcactaagaaaggaataaagaaaactgagttccgcatagtactagataaagttcattatagacagttagttcaggacggaccagtgaaaatgatgctaggaagctccacatataaatataatgcaaaacaactggtgttatcagaaaaagccctacaggtaataaaagacgaccgtaaattcgatgaaacccaaaaagatgacaaccttatagccgtttacgatgaaatcttaagtattgtaaaccaatctttcgacttatacgatatcaacggatttcggaagaaactaaacgacaatcgaaatcaatttatagaccttcctgcagaaacaaaatacgaaggccgtaaagtagtagcacatggaaaacgagaaatgatactagaaatacttaaaggacttcatgcaaacgctagttttggcaatcttaaaccaattggattcgcaactccatttggacaaatgcaatccaaaaatggtatagaattatcagaaaatgcattcttaatacaccaaagccccagtggtctatttgaacacaaaattaaactttccgatctgtga

SEQ ID NO: 5413 - RNA, 4101 nt, synthetic construct
  misc_feature 1..4101: note = Cas9 variant
  source 1..4101: mol_type = other RNA
atgacaaaattaggaaaaccatatggaataggtgtagacattggatccaattcaataggatttgcagcagtcgatgaaaattcccacctaataaggcttaaagggaaaacagttataggagcaagattgttcgaagaaggaaaagcagcagcctataggagagcatcaagaactacaagacgacgactctccagaaacagatggagattatcctttcttagagactttttcgaatcacatataacaccaacagatcctaactttttcatgcgtcaaaaatatagtgaaatatcaccaaaagataaagctcgatataaatacgagaaaagactattcaatgacagaacagatgcagaattttaccaacaataccccaccatgtatcacttaagaacaaggttactcactgatccatcaaaagcagacgtacgagaaatatacttcgcaatacaccacatactaaaatctagaggacacttcctaactccagggtacgctaaagactttaatactaacaaagttgcactgaatgaaatattcccagcgctacaagatgcatacgcccaggtatatcccgatcttgacataacatttgacgaaaacaaagtcaatgaatttaaaacagtgttactaaacgaaaaagccaccccctccgatacacaaagagcgctagtcaacttgctattagccaaagagggtgaccgagacatattaaaacaacaaaaacaagtcctaacagagttcgcgaaagcagtagtgggtcttaaaactaaactaaacgtagcattaggaacagaagttgactctagtgaagcaacagcttggaatttcagcttaggacagttggatgacaaatgggcaggtattgaatcggctatgactgacgaaggaacagagattctagaccagattcgagacttatacagggcccggctattaaacggcatagtcccagctggaaaaacactctcacaagccaaagtagatgactacgcacaacaccacgaagatctcgaactatttaaagattacctaaaacaactcgaagatgatggaacagccaaagctattcgacaactgtacgaccgatatatagacggcgatgatgccaaaccctttgtaagagaagacttcgtcaaagcactaacaaaagaagttaccgcccaccccaacgcaaaaagcccagaactattggagcgattagcccaacctgatttcatgctaaaacaaagaaacaaggccaacggcgcaataccggtacaaatgcaacaaagagaacttgatcaaatcatcaaaaaccaagcagtttattacgattggttagcagcccctaaccctgtcgagaaacatagacaaagtatgacttaccaacttgacgaattacttaattttcgaataccatactacgtcggccccctagtaacagctaaggaacaaaaggctgcacaagggggagttttcgcctggatggtgagaaaagatccagatggaaacatcacaccatacaacttcgacgaaaaagtcgatagagaggccagcgcaaacacattcatacaacgaatgaaaactaccgatacatacctaatcggagaggacgtactcccaaaacaatcactattataccaatcctatgaagttttaaatgaacttaataacgttcgtgtaaatgataataaactcagtttcgatcaaaaacagcaagtactaggtgagttattcgaacgacacaacacagtgacaataaaacaatttgttgataacttactagcacacggagattacgatagaataccagaagttaggggcctagcagacgagaaaagattcttgtcaagcctatcaacatacaatcaattaaaaggcattctacacgaagcgatagatgatgcagataaacaaacagacatcgaaaatataatagcatggtcaaccatattcgaagataaagcaatcttcaaaacaaaattgaacgagataagctggctaaacgcgggaatgatcaattccctagccaacatacgttacagaggatggggacaattcagtcacaaattactaaatgaattaacattatccactggaagaacagtatttgaagaactactcatctcatcaagaaacttgatgcaaattttgactgacgaagtactaaaacagaaaattgccgaattaaacgcccacgaattaaaagcaagcgggatatatgcagctatcgatgacgcgtacacctctcccagtaacaagaaagcactacggcaagtactatcggtaatagatgatataacaaatgcagcaggacaagctccgaactggctttacatcgaaaccgcagatggagacggtgttcccggcaaacgaactaattcaagacaaagaaaaatacaagaaatttatgctaatgcagcacaagaactaatcaccggttcagtaagaggagaatttgaagacaaaatcgcatcaagagctgattttaccgatcgcttagtactatatttcatgcagggtggtagagacatatacacaggagaaccactcaatatagacaacttatcatcatatgacattgaccacattctaccacaatcactcataaaagataactcactagacaacagagttcttgtccaccctcttgttaatagagaaaaagacaccatattcgcatccacaagattcgccaaacaaatgaatggaatgtggcggcagtggcacgcggcaggactcatatcatcaaggaaactccgaaacctacaaatgcgaccagacgaaattgacaaatatgctagcgggtttgtcgcaagacaactggtagagacaagacaaataatcaaactaacagaacaaatagtcgcagaccaatatccagacacaaaaattatagccgtaaaagcaggactctcatcacaactcagaaaagaattagacttccccaaaaaccgcgaagtgaatcattaccatcacgcttttgacgcttttcttgcagctagaattggaacatatttactcaaacgatacccaaatctcgaaccatttttcacatacggtaaatttaagaaaacagaagtgaagaaactaaaaagtttaaaatcactaaaatcattcaactttatcagagatatgacgcacgcgaaagataaaattgtagcaaaggaaacaggtgaaattgtatgggataacgcatctgatattaacgagctcgatagaatttataacttcaaacgaatgttaattacccacgaagtccgctttgaaactgctagcctctttaaacaaactctttatgcagccaaaaattccaaaaacaggggaggatctaggcaactaataccaaagaagaaaggatacctggttgacatatacgggggttatacacaagaaactggaagctacttaagtgtagtacgacttacaaagaaagcaatgtatgctgtagtcaaagtcagcacaagagacgcagcaaaattagcagtagccaaatcgatcagcgaacaaaaagaaaacgaaacgctaaagaaaatcatagatggaaaactatcaaaaacctcaaagaaaggaaaaacaacacatcaactctttgaaatcgtactaccaagggtaggacagaaaacactatttaaaaattctaaatacaatcaattcctagtcaatagcgatacctatatgcataattatcaagaactatggatgccaagagagtaccaaagaatgtggaaagatatactattatccaatcatggagatgcacaaattgaaggacaactggaccaaatatttaaattcatcgtttcgcaagtaaactcatactttaatctttacgacataaaccagtttagaaagaaaatagcagacgctactgacaaattcgcaaaactacccacacacgacactgataacgcaagaggcaaaatagcaacaatcggtcaactattaatcggactgcaagcaaacgcaatgcgatcagatctacggaacctggatatcaaaacacccttcggtttattgcaaatcggcacgggaatcacactagatttagatacatcgatcatttaccaatcaccaacaggactattcgaacgagaagtacctcttacagatctatga

SEQ ID NO: 5414 - RNA, 4101 nt, synthetic construct
  misc_feature 1..4101: note = Cas9 variant
  source 1..4101: mol_type = other RNA
atgactaaagactactcattaggactagacataggcacaggaagcgtaggttttgcagccttagatacgaactatcgattactacgagcaaaaggcaacaatgtaattggagtccgactattcactcccgcagaaacagccgaagaacgacgcggcttccgaacagcaagacgaagattatcaagaagaagatggagactaggagcccttaacgggatatttgcaccagagttagcaaaagttgaccctaacttcctacatcgattaaaatacgcttgggtgcatccagcagaccaacaaaacaaggggaaatactcagccgctccattatttaacgacgcagctttggatcgacaatttcacgacgactatccaaccatatatcacttacgcttaaaactaatgacagacacctcacaacatgatctacgcgaagtctatcttgctatacaccatataataaaatttaggggaaactttttacgaggagaaggaccaataaacgcttctgaggctttcgacatcaatacctttatagatcaaatgacagctttctacgatcaggcttttcccgattttaaaattgtcgaccaagtagaccaacaaattatttttaaaggattaaccgacatgacgctatctccagcagatagagctaataaagcactcatgggatttaataatgcagcacaacaacctaataagcggatttttaaagccatcctaagcggcttagtaggcaatcaggtcgacctaatggcaatctttcaattagatggcattccaaaagaagaccaaaaagagttcaagtttaaattcgtcgacaatgacatagaagaaaaactagccgcattaggagacaatccagccctttcagatgaacaaaacgagttcctaacaacattatacgcggcatttagtggacttacgctcaaaggacttctaggtgacgccacctcaatttctgcagcaatggtagcacgttacgcatcacatagaacggattggacatatatcaaggaccacgttctcacaccacaaaacaaccgagaattaagacttgcctacgctgatcttatgacagacaacgaagacgtaagactaaaagcaggaaagaaatttgccaaagccatagaagcagcagatatacccgcagctaagaaaagtgaattttcactaaaaatagataacaatgagttccttccacgtcaaaggacaaaagctaatggcacaatcccccatcaacttcacttaaatgaactacaacaaatcattgaaaatcaagggcaatactacccttttctaaaagcgacatttgaacaggacggtcatacattaaacaaaatagaaggtttggtaaaattcagagtaccatactacgtgggtccgctagttccaaaacacaaagtggcaggtaataatgcaaatcattggatggtaccaaaagaacccggagcaatcacaccatggaactacactgaaaaagtagacagagataagtcaggcaacgagttcattcgacgaatgacgggaacagacacctatctgctaggggaaccgacacttcctaaaaatagccttgtttatcaagaatttaacgtcctacaagaactgaataacttaagaatagaaaagaggcgattagatatcgcagtgaaacaagatatattcgaacacgtttttaagactaataaaacagtgaccgtaaaacgcatagaagaatatttaacaacagaatttggctcgccagtcacactatcaggattcgcaaatgtaaatgaaagaaagctgaactcatctttatcaacttatcactacttcgtaggaatttttggagctgaatttgtagacgatcctaaaaatttaaccctattagaacaaatagttgaactacaaactgtatttgaagatcgtaaagccttacaaagacagttaaaacttcgtccagaactctcggaaaaacaagtcaaacaactggcacgcacccattatacaggatggggaagactttctcaaaaactgttaaccagtaaaatagtacacgtagccctcgaaggtgaaagagaaccaggacaatatagtatacttgaaactctatatggtacccagatgaatttcatggaaattgtcaacgatatgaaggacagatatggagttaaaagctggctagaccaggaaaactcgggttcagaaaacaacctatctttaaaacaaaggattttagatatgccaggacccaaaaatatcaagagaggaattaaccaagcctttcacataatagacgaaataacgagagctgtaggaaatgctccatctcgtatatacattgaatttgcaagagaaagtcaacagtcaaatctgacaaacgcaagggtcaacagacttaaacaactgtactcaaatcaagcattaaagaaagagttcgcgaaactagcaagcgaaatcaaagatttaacaaaagaacaactaaaagacgaccgtttatacctatactatttacaacaaggaaaagacatgtacacagaaactgacatagacataacaaaaatatcatcaaactaccagatcgaccatataatcccacaggcttacaccaaaaataattcactagacaacagagtattagtcaacagtgaaatgaacgcacgaaaatccgattcgcctacatttttgccctcattaattcaagaacgaaaagcatggtggaggcaactaagagacacaggtttaatgtcgacaataaaatataacaacttaactcgaacctctgacgacttcagtgcagatcaaaaagaaagattcatagcaagatcgcttgtagaaactaggcaggttatcaaaaacgtagccacattaataaaagaatactatgacgacagccaagtagaagcattacccagcgaaataactgcagaaatgagaagatacttaaatgtacgtaaaaaccgagatattaacgactatcaccatgcacatgatgctttgcttttcgcaacggctggcgaattttccagaaaagtaggcataatggaaaaaggacgagtctcagatggtgctgggaacatatataatcgatacaccaaagatataatccaaagagcaagagcaaaagcaggacaagacaagaaagtaagaccctttacatttatagtaggatctatggcaaatccagacactaaatttcaaactaatcaaactaccggagaaatagtatggacaccagaagacgtagcttacctaaggaaagtaattgactacaagaaaatgttagtgacaaaaatgactttagatcaaacaggcacattgtacaatgaaactagatacggctcaggagataaacatgttgccgtggcgctatcgaaagataaagctgctgatctctatggagggtttggatctctaaaaccggcatatgctgcgcttgtatacagtaaaaagaaattcaggctagtaaacgtgttaagactttggttacccgaaataaagaaaaatgcctcagtactcgaacggaaagtacaatctgtattaggagacgataatgcaaaagtgatacgagcccacgtcccatgcggtcaattattaataaaagatggagcattagtaacagttagctctgccaccgaattacataattttagacaactatggcttcctaaagcagactaccaagatatttccatccttcttggagctcctgacaaagtgacagcagaaaatcgtctacaagcggaatcacatttcgacgatgtagatcaaagatttgaaagtttacttaaagatgtaattgatcaagccaggcaatattacccactaaaaacacatcaaacatccctggaaaaactaatagggaaaataggaaaattcgacgaattgaaatttgcacagaaacaacaagtatttagtagacttctaagtgcattgcatgctaacgctacaaattcggatctaaaacaaataggcctatcaacagcatggggtagactaatttatccaaaaggggtttcactaacagacgaagacaaattaataaattcaagttttactggacttttcaacgatgtaatgtcgattaaagaatttcatgatttttcaataaactga

SEQ ID NO: 5415 - RNA, 4104 nt, synthetic construct
  misc_feature 1..4104: note = Cas9 variant
  source 1..4104: mol_type = other RNA
atgaaaaaacaaaaattttcagattattacctaggtttcgatatcggcaccaacagcgttggttggtgtatcacagacctagattataacgtgctaaggttcaacaaaaaagacatgtggggatccagactcttcgaagaagccaagacagcggctgaaaggcgcgtacaaaggaacagccgccgacgactgaaacgaaggaaatggcgattaaacctattagaagaaatcttttctaacgagatattaaaaatagacagcaactttttccgaagactaaaagaaagctcattatggctagaggataaaagctccaaagaaaaattcacattattcaacgacgacaactacaaggactatgacttctacaaacaatatccaacaatatttcacctgcgaaacgaactaataaaaaacccagagaagaaagacatccgtttagtatacctagcgatacatagcattttcaaaagcagaggccatttccttttcgaaggtcaaaacttaaaagaaataaaaaatttcgaaacattatacaacaatttaattgcctttctggaagataacggaataaataagatcatagacaaaaacaatatcgaaaagttagaaaaaattgtatgtgatagcaaaaaaggattaaaagacaaagaaaaagaatttaaagagatattcaactctgacaaacaattagtagctatatttaaactatcagtgggttcaagtgtcagtctaaacgacttattcgacacagacgaatataagaaaggagaggtggaaaaagaaaaaataagtttccgagaacaaatctacgaagacgacaaaccaatatactattcaatattgggggaaaagatagaacttctagatatagcaaaatctttttacgatttcatggttctaaacaacatcttggcagacagccagtatataagtgaggcaaaagtaaaactatacgaagaacacaagaaagacttgaaaaatctcaagtacatcattcgcaaatataataaaggaaattatgacaaactctttaaagataaaaatgaaaataactacagcgcatatataggattgaacaaagaaaaaggaaaaaaagaggttgtagaaaaaagtagattaaagatagatgacttaataaaagtcatcaaaggatacctacccaaaccagagaggatagaagaaaaagacaaaacagtcttcaatgagatattatcaaaaatagaactaaaaacaatattgcccaaacaaaggatatcagataacgggactttaccatatcagatccacgaggttgaactagagaaaatactagaaaaccaatcaaaatattatgatttcctgaactacgaagaaaatggcgtaagcaccaaagacaaactactaaaaacatttaaattccgaataccatactacgtaggcccacttaacagctaccataaagacaaaggaggaaacagttggatcgtgaggaaagaagagggaaaaatactaccatggaattttgagcaaaaggttgacatcgaaaaatcagcagaagaattcataaaaagaatgacaaacaaatgcacatatcttaatggagaagatgtaattccaaaagatacattcctatatagcgaatatgtaatcctaaacgaactcaataaagtacaagtaaatgacgaatttctaaatgaagagaataagcgcaaaataatagacgaactatttaaagaaaataaaaaagtatccgaaaaaaaatttaaagaatatctccttgtcaaacaaatagtagatggaacaatcgaattgaagggtgttaaagacagcttcaactcaaactatataagctacattcgtttcaaagacatatttggtgaaaaattgaacctagacatttataaagaaataagtgaaaagtcaatcttgtggaagtgcctctacggagacgacaaaaaaatcttcgaaaaaaaaatcaaaaacgaatatggagacatcctgacaaaagacgagatcaaaaagataaacacattcaaattcaataattggggccgactcagcgaaaaactattaacgggaatcgaattcattaacctagaaacaggcgaatgctattcatcagttatggacgctctacggcgcacaaattacaacctaatggagctattgagctccaaattcacgttacaagaaagtataaataacgagaataaggaaatgaatgaagcaagctatcgagatctaattgaggaatcatacgtaagtcctagtctaaagcgagcaatctttcagactctaaaaatctatgaagaaatacggaaaataacaggcagagtaccaaaaaaagtcttcattgaaatggcaagaggcggagacgaaagcatgaaaaataaaaaaatacccgccaggcaagagcaactcaaaaaattgtatgactcctgcggaaacgacatcgcaaacttcagtatagacataaaagagatgaaaaactcactaatatcttacgataataattcattaaggcaaaaaaaactatacctatactatttacaatttggaaaatgcatgtacacaggccgagaaatagacctcgacaggctactacaaaataatgacacgtatgatatcgaccatatttacccgcggtccaaagtaatcaaggacgactcattcgacaatcttgtactcgtgctaaaaaacgaaaatgcagagaaaagtaacgaatatccagtaaaaaaagaaatccaagaaaaaatgaaatcattttggagatttctaaaagaaaagaactttatatcagacgaaaaatacaaaagattgacaggtaaagacgattttgaactacgtggatttatggcaagacaattagtcaacgtccgacaaaccacaaaagaggtcggtaaaatactccaacaaatagaaccagaaataaaaatagtatatagtaaagcggagatagcgtcaagcttcagggaaatgtttgactttatcaaggtacgagaattaaatgacacacaccacgccaaagacgcttacttaaatattgtcgcaggcaatgtatataatacaaaattcacggaaaaaccatatcgctacttacaagaaataaaagaaaactacgacgtaaaaaagatatataactacgatattaaaaatgcctgggataaagaaaactcactagaaatagtaaaaaaaaacatggaaaaaaataccgtaaacattacacgattcataaaagaagaaaaaggacaactatttgaccttaacccaatcaaaaaaggagaaacatcaaacgaaataataagcataaaacctaaggtctataacggcaaagacgataaattaaatgaaaaatatggatactataaaagcttaaaccctgcatatttcttatacgtagaacacaaagaaaagaacaaacgaataaagagcttcgaaagagttaatctagtagacgttaacaatataaaagatgaaaaaagcctagtcaaatatctaatcgaaaacaaaaaattagtagaaccacgcgtaatcaaaaaagtatataaaagacaagtaattctaataaaccactacccatacagtatagtaacattagatagcaataaactaatggacttcgagaatttaaaaccattattcctagaaaacaaatatgaaaagatacttaaaaatgtaataaaatttctcgaagacaatcaaggtaaatccgaagaaaactacaaattcatatatctaaaaaaaaaagacagatacgaaaaaaatgaaacgctagaatccgtcaaagatcgatacaatctagaatttaacgaaatgtacgataagttcctagaaaaactcgacagcaaagattataaaaattacatgaacaataagaaatatcaggaattactagatgtaaaagaaaaattcataaagttgaacctcttcgataaggcattcacactaaaatcattcctagacctatttaacagaaaaaccatggcagacttctctaaagtaggactaacaaaatacttaggcaaaattcaaaaaatatcctcgaacgtcctatcaaaaaatgaattatacttgcttgaagaatccgtgaccggcctctttgtaaagaaaataaaactttga

SEQ ID NO: 5416 - RNA, 4104 nt, synthetic construct
  misc_feature 1..4104: note = Cas9 variant
  source 1..4104: mol_type = other RNA
atgaaaaaacagaaattcagcgactattacctaggtttcgatataggcaccaattcagtaggatggtgcgttacagacctagactataatgtactacgattcaacaaaaaggatatgtggggatcccgattgtttgacgaggccaaaaccgccgctgaaagaagagtccaaagaaatagtcgtagaaggctcaaacgacgaaaatggagactaaatcttctagaagaaatattcagcgatgaaatcatgaagatcgacagcaactttttccgaagactaaaagaatcatccctatggctcgaagataaaaacagtaaagaaaaattcacactattcaatgatgacaattataaagattacgacttctataaacagtaccccactattttccacttaagagatgaactaatcaaaaacccggaaaaaaaagacatcagactaatttatctagcactacactcaatatttaagagcagaggccacttcttattcgaaggccaaaacctgaaagagataaaaaattttgagacactatataacaacttaatcagttttttagaggataacggaatcaataaatcaatagacaaggataatataaaaaaactcgaaaaaattatatgcgactcgggcaaaggccttaaagacaaagaaaaagaatttaaagaaatattcaactccgataagcaactagtagccatatttaaactttcagtaggcagtagcgtttccctaaacgacttgtttgacacagacgaatacaaaaaagaagaggtagaaaaagaaaagattagttttagagaacaaatatatgaagacgacaaaccaatatactacagcatactaggagaaaaaatagaactcttagacattgcgaaatccttttacgatttcatggtccttaacaatatattgagcgatagcaattacatctcggaagcaaaagtaaagctctacgaagagcacaaaaaagacctaaagaatttaaaatatataatacgaaaatataacaaagaaaactacgacaaattatttaaagacaaaaatgaaaataattacccagcatatatcggcctcaataaggaaaaagggaaaaaagaagttgtagaaaaatcaggactaaaaatagatgatttaataaaagttataaagggctaccttccgaaacccgaaaggatagaagagaaagacaaaaccatctttaatgagatacttaacaaaatagaacttaaaaccatactaccaaaacaacgaataagcgataatggcacactgccctatcaaatccacgaagtagaactagagaaaatactagaaaatcaaagcaaatattatgacttcctcaattatgaagaaaatggagtcagcaccaaagacaaattacttaaaacattcaaattccgaataccatactacgtcggaccgctaaatagctaccacaaggataaaggagggaattcatggatcgtaagaaaggaagaaggaaaaattctcccatggaattttgaacaaaaagtagacattgagaaaagcgctgaagaatttataaaaaggatgacaaataaatgcacatatctaaacggagaagacgtgataccaaaagacagcttcctgtacagcgaatacataatcctaaatgaactaaacaaagtacaggtcaatgatgaatttctaaacgaagagaacaaaagaaagataatcgacgaattatttaaagaaaacaaaaaagtatcagagaaaaaattcaaagaatatctactagtcaaccaaatagcaaatcgaacagtagagcttaaaggcataaaagacagctttaactcaaattatgtatcatacattaagtttaaagacatatttggtgaaaaattaaatcttgacatatacaaggaaataagcgaaaaatcaatactttggaaatgcctatacggtgatgataaaaagatttttgaaaaaaaaataaaaaacgaatacggtgacatattaaataaagatgaaataaaaaaaataaactcgtttaagttcaatacttggggccgattatcagagaagctattaacagggatagagtttataaacctagaaacaggagaatgttattcctcggtcatggaagctctgagaagaaccaactacaatttgatggaattactaagctcaaaatttacattgcaagaatcaatcgataatggaaataaagagatgaatgaagtgagctacagggacctaattgaagaatcatacgtttcaccaagcctcaaacgagctatactacaaacactcaaaatttacgaagaaataaaaaaaatcactggcagagtgcccaaaaaagtatttattgaaatggcacgtggaggagacgaaactatgaaaaataagaaaataccagcaagacaagaacaacttaagaaactatatgattcatgcggaaacgacattgcgaactttagcatagacataaaaaaaatgaaaagttcactatcctcttatgacaataacagcctaagacagaaaaaactatacctatattatctacaattcggcaaatgcatgtacactggaagagaaatcgacctcgacagacttctgcagaacaacgacacctacgatatagatcatatttacccacgatcgaaagtcataaaagatgacagctttgacaacctagtgttagtactaaaaaacgaaaacgcagaaaaatcgaacgaataccccgtaaaaaaagaaatacaagaaaaaatgaaatcattctggagattcctaaaagaaaagaacttcatatccgatgaaaaatataaaagacttacaggcaaagacgatttcgaactaagaggatttatggcaagacaattagtgaacgtaagacaaacaaccaaagaagtaggcaaaatattacaacagatcgagcccgaaataaaaatagtgtattcaaaagcagaaatcgctagcagcttcagagaaatgttcgattttataaaagtacgcgaactaaacgatacccaccacgcaaaagacgcatatctaaacatagtcgctgggaacgtttacaataccaaattcaccgaaaaaccatatagatatttacaagaaataaaagaaaattacgacgtgaaaaaaatatataactatgatataaaaaatgcctgggacaaagaaaattcactagaaatcgtgaaaaaaaacatgaaaaaaaacacagtcaatataacacgatttataaaagaggaaaaaggacagttattcgacctaaacccaatcaaaaaaggagaaacaagtaatgaaatcataagtataaaaccaaaactgtataacggcaaagaagaaaaactcaacgaaaagtatggatactataagtccttaaatccggcctatttcctctacgttgaacataaagaaaaaaacaaacgtatcaaatcattcgaaagggtaaatttagtggacgttaataacataaaagacgaaaaatcattagtaaaatacctaatagaaaacaagaaactagttgaaccacgtctcataaaaaaagtatataaacgacaagtaatactaatcaatgattacccatatagtattgtcgcactcgattcaaataagctcatggacttcgaaaacctaaaacctctattcctagaaaacaaatacgagaagatattaaaaaacgtaatcaaatttctagaagacaaccaaggtaaaagtgaagaaaattataaatttatctacttgaaaaaaaaagaccggtatgaaaaaaatgaaaccttggaatcagtaaaagatagatataatctagaatttaacgaaatgtacgacaaattcctcgaaaaactagatagtaaagattataaaaactatattaacaataaaaagtataaaaacctactagatgtaaaggaaaaatttatcaaactgaatctattcgataaagcgtttactttaaaatcattcctggatctattcaatcgaaaaacgatggctgacttcagcaaagtaggactaaccaagtacttaggaaaaatacaaaaaatctccagtaacgtattatcaaagaatgagctctatctcctagaagaaagcgtaacaggcctcttcgtaaaaaagataaaactttga

SEQ ID NO: 5417 - RNA, 4104 nt, synthetic construct
  misc_feature 1..4104: note = Cas9 variant
  source 1..4104: mol_type = other RNA
atgaaaaaacaacaattcagcgactactacctaggattcgacataggaacaaactcagtagggtggtgcgttacggacttcaactacaacgttttgagattcaacaagaaggatatgtgggggtcccgattattcgatgaagcgaaaacagcagcagaaagacgagttcaaagaaatagcagacgcaggttaaaaaggcgaaaatggcgtttgaacttactagaagaaattttctcagacgaaatactcaaaatagattccaatttcttcagaaggctaaaagaatcatccctatggttagaagataaaagtagcaaagaaaaatttacactcttcaatgacgacaattacaaagactatgatttctataaacaatacccgaccatcttccacctcagaaatgaattaattaaaaacccagaaaaaaaagatatacgacttgtttacctggccttgcactcaatattcaaatcaagaggacatttcttattcgagggacaaaatctaaaggatatcaagaatttcgaaacactatacaacaatctaatggcattcctagaagacaatgacatctacaaaaacatcgactcatcttatatcggcaacctagagaacataatatgcgattcaaaaaagggactaaaagacaaagaaaaagaattcaaagaaatcttcaacagcgacaaacaactagtaggcttcttcaaattatcagttggatcatcagtatcactcaatgatctctttgacacagacgaatataaaaaaggagaagttgaaaaagagaaaatatctttcagagaacaaatttatgaggacgacaaacccatatattatagtatacttggggaaaaaattgaattcctcgacatagcaaaaagtttttatgattttatggttctcaataatattttagcagatagccaatatatctcagaagctaaagtaaaactgtatgacgaacacaaacgcgatctaaaaaacctaaagtacataatccgcaaatacaacaaagaaaactacgataaactattcaaagacaaaaacgagtcaaattactcagcatatataggtctaaataaagaaaagggaaaaaaagaagtgatagagaaatccagactaaaaattgacgatttcgcaaaaattataaaaggatacttaccgaaagccgagaaaatcgatgaaaaagacagaagtatattcaacgaaatattagataaaatcgagcttaaaaccatactacccaaacaacgaataagcgataacggcaccctaccatatcaaatacatgaggcagaactggaaaagatattggagaaccaagccaaatactacgacttcttaaaccatgaagaaaatggaatatccacaaaagacaaattacttatgacattcaaattcagaataccctattacgtgggtccactaaactcataccacaaaaacaaaggaggaaacagctggatagttcgaaaagaagaaggcaaaattctaccatggaacttcgaacaaaaagtagacatagaaaaatccgcagaggaattcataaaaagaatgacaaacaaatgcacctatctcaatggggaagatgttatcccgaaagactcattcttatactcagaatacataatattaaatgaattaaataaagtgcaagttaacgatgaattcttaaataaggaaattaaaaaaaaaataatagaagatttattcaagaaatcaaaaaaaatcagcgaaaaaaacttcagagaatatctactagtaaatcagataacaaacaaaacagtggagctgaaaggtgtaaaagacgcctttaactcaaattatgtatcgtatatcaaattcaaagatatcttcggagacaaactaaacctggatatctacaaagaaatcagcgaaaaaagtatactatggaagtgcttatatggagatgacaaaaaaatttttgaaaagaaaattaaatcagtatacggcgacatcctaacaaaagacgagataaaaaaaataaactcgtttaaattcaacacgtggggccgattaagcgaaaagttgttaacagaaatcgaattcatagatttggaaacaggagaatgttactcaagtgtaatggacgcactaagacgtacaaactataatttaatggagcttcttagctcaaaattcacactccaagagaacatagacaacgaaaacaaagaagtatcagaatttagctatagagacctcgtcgaagaaagctatgtttccccatctttaaaaagggcaatactgcaaactttaaaaatatacgaagaaatcaggaaaataacaggtaggataccaaaaaaagtattcatcgaaatggcaagaggcggagacgaaactatgaaaaataaaaaaatacccgcaagacaagaacaattgaaaaaattatatgactcatgcggaaaagacatatccaacttctctatcgacatcaaagaaatgaaaaacagcttaaacagctatgataataattcactaagacaaaaaaaactctatctatactacctacaattcggcaaatgtatgtatacaggaaaagaaattgacttaaatagactattacaaaacaacgacacctatgacatagatcatatatacccacgatcgaaagtaattaaagacgattccttcgacaatctagtactcgtactaaagaacgaaaatgccgaaaaatcaaatgaatatccactaaaaaaagaaatacaagaaaaaatgaaaagtttctggaagtttctaaaagaaaaaaactttatctcagacgaaaagtataaacgactaacagggaaagatgaatttgaactaagagggttcatggctcgtcaacttgtaaacgtacgtcaaactacaaaagaagctggaaaaatcctacaacagatagagcccgaaatcaaaattgtatattccaaagcagaaatagcaagctcatttcgagaaatgtttgacttcatcaaagtccgagaacttaatgatacccatcacgcgaaggatgcatacctgaacatcgtagctggaaacgtttacaatacaaaattcactgagaaaccctaccgatatctacaagagataaaggaaaactacgatgtaaaaaaaatatacaattacgacatcaagaacgcctgggataaggaaaaatcccttgaaatcgtgaaaaaaaacatggaaaaaaacaccgtaaacataactagattcataaaggaagaaaaaggccaactattcgaccttaaccccataagaaaaggagagacaagcaatgaaataatagcaataaaaccgaaattctacgaaggctcaaccgagaaattaaatgaaaaatatggatattacaaatccttaaatcctgcatactttatatatgtagagcataaagaaaaaaacaaaataataagaagttttgaaagagtaaacttagtagacgtaaataagataaaagacgaaaaatcactaattaaatatcttattgaaaacaaagggttaatagaacccaaagtaataaaaaaagtatataaacgccaagtaattctcataaacaacttcccctacagcatagtggccctagattccaataaactaatggatttcgagaacttaaagcccctgttccttgaaagaaaatacgaaaaaatactaaagaatgcaataaaattccttgaagacaaccaaggaaaaacagaagagtactacaaatttctctacctgaaaaaaaaagacagaaacgaaaaaaacgaaacaatagactcagtcaaggaacgatataatattgaattcaatgaaatgtacgataagttcctagagaaactagactcaaaagactataaaaattacataaacaataaaaaatactcagaactggttaacgtaaaagaaaaattcatcaaactgaatttattcgacaaagcattcaccctaaaatcttttctagacctttttaatcgtaaaacaatggcagattttagcaaagttggtcttacgaaatacttaggaaaaatacaaaaaatatcatcaaacgtactttcaaaaaacgaactacacctcctagaagaaagcgtcacaggcctattcgtcaaaaaaataaaattatga

SEQ ID NO: 5418 - RNA, 4104 nt, synthetic construct
  misc_feature 1..4104: note = Cas9 variant
  source 1..4104: mol_type = other RNA
atgaaagactattacttagggttagacatgggttcctcatcagttggatgggcgctctccgacgaaagatataacttactaagagcaaaaggaaaagacctatggggagtacgattgttcgatgaagcaaaaacagctgcagaaagaagaacatttaggtctcaacgtagacgacttgaaaggtccaaatggagattatcactacttacatctttattcgaagaagaaatatctaaaatagacgataaattctttgatagactaaaagatagtaaattcttcattgatgataaatcagatcaacaaccaaatacactattcaacgatgtaaacttcacagataaagaataccacaaaaggtacccaagtatataccatctaagaaacgcattatttaatcaaaacgacaaattcgacatccgccttatatttctagcattatcacatatagtcaagaaaagaggacactttcttttcgatggagataaagcagggtttggggaagacatagacgtaatcttagatgaattaaaagcatacttacaagacgcatttcacacaaaactagaatttactagcgaatttaaatcaatcatgctagataaaaacctaaggaagaaacaaaaagaagaagaactcaaaaactcaataaaaatatcaagtgacacaataaattcaaaagacgggaaaagtatactcataaaattatttctaggatacgaagctaatctaaaacccttctttctcgaatacaaagtcgaaaaagacaacgaatacaaaataaatttttcgaaagaagactatgaagaaaaactattagacatgacttcaaaattcgaagaaacaacatattttattgaaatcgcaaagaaaatacacgattacttccttttagaagaaataatgctcggattcaaaaacataagcgcatcaaaagtttcgatttaccaaaaacacaaaaatgacctaaaaaccctgaaaaacattgtcaaaaatcaaataaataattcttacaacgccatattcaaagatataggactggataactacccagcttacgtaagctgttggaacagcaagaaacacaaagaaaaacaaaaaggatgtacaaaagacaaattttacgctttcttaaaaactaaacttaaaaatattaataacgcaaaagaaatcctcgactccatcgacaatgatgactttctacccaggttagtggacaaaaactcaattatcccacatcaaatacatctcgcagaattaatcaaaataatagacaatcaaagccaatattaccccttccttaaagaaataaaagacaaaataatatcaatcttcaaatttcgcataccattttacgtcggaccactaaataatttccataaagataaaggaggaaatgcttggatcgaaaaactaaaagatgaacgaatctttccatggaacttcaacgacgtcgtggacttaaacaaatcagctgccaactttatagagaaaatgataaatgaatgctcatacctaaaaggtgaaaaagtgcttgccaaaaactctttactatacacaaaatattcggtattaaacttgattaataaactaaaaatcaatggtacagcagtttcagtagaaacaaaacagaaaatatacaacgaattgctactgaaacagaaaaatatcaagaaaaccgctatcaagaaattccttatcaacaactcaataatagataaaaacgacgaaataagcggcatagatgattcactaacaagcaatctagcagtcttcatagattttgagaaaataagtaaccggttaagatacgaccaaaaagaagacattataaaaagcatctccttattcggatacgacaacgcaatgctcaagaaacaaatcattaccatagctcccgatctgtccgaagacgaattagaaaaactgtctaaactaagatattccggatttggacgattatccaaaagattattaacaagcataaaacacaatggaaaaagtattattgaaatgctatgggacacaaacgataacctaatggaactcctttcagatagatatactttcatcgaacaaataaacaaacacaacgacggatttaaagaagatattaaccttaacttccaaaatgtagacactctctacgtctcaccgagtgttaaacgacaaatttggcaagcatttaaagtaataaacgaattaattagcgttatgggtagagagccaaagaaaatctttgtcgaaatggcccgcgaagaaggcgaaaagaaaagaacgcaagccagaaaagataaagtattagaactatataaaagtatcaaaaacaacgaaatatcaacattccttacaaactttaaagacattaaaacgaaactcgagggagaatccaacttaaatagcaagaaactctacctctactatttgcaacttggagtagatatatatacaggagagaaaatacccttcgaaaaactttttgaccaaaacatatacgacattgaccacgtaatacccagatccctaaagaaagatgactcattcgataatctagtactaacatctaaaacaaataatgcaaagaaaacggatgaatttcccgtttcgtcagaaattcaaagtaaaatgcaaaccttttggaaagtacttaaagacaaagacttaatgtcagaaataaaatacacaaatctcaccagaaaaacacatttatcagatgacgaattaggcgactttatagccagacaactcgtcgaaactcgccaaagtactaaagcactcacacaaatactcaaaaacgtatacgcaaactcagatatcgtatacgttaaagcagggatagtctccgaatttcgacaacaatttgatatgctaaaaataagagaactaaacgacttccaccatgctaacgacgcatacttaaatatagttataggaaatgtatataacataaaatttactaaaaacccgcgcaactacgtaaaagaatactataagaaaggcgaacactataatcttaaaatagagaaaatgctagaaaaagatatagcacgaggaggtaactttggatgggacaagaaacacagtatagaaaccgtacagaaaacaatgaagaaacaatccccacttataacttacagaaccttcgaaaacaaaggtgaatttttcaaccaacaaccctctaaagcatcagccaatcttctagccctgaaatcaagcgacaaaagattactagacacagtgcgatacgggggatataaaggaacgcaatatgcacacatgttcttagttgaacatttcaatggaaaaatcataaaagaaataatgggcgtaccaatttacttaagtaaagaaataaaagacgacaaagcaaaactcttagaatattgtaatgacgtactaaaactcaaaaaccccaaaatactattctctaaaataccctacaactcactaatagtatacaacggatatccaattctactaaggggactaaccggagtaagaggagcggcacaattaaagttagatcaaacatcaacacaagtagtgaagaatatagtaaaattatacgactggctttcacaaaaacaaaaagaactctcggacctatccaagaaaatagaatttttccaagaaaacaataagaaagatgaagtaaaagctgccatgctagaagcagacaatatattgttcatactcaacgatcgtttcaaaaataccaaaataggaaaggacataatgaatgacaaccacctaaataacttatacgatacattcataaacaaattggaaaactccatatataaaaacaagccagggggtaaacaagatgtattaatgaaggagaaaagagatctattcctttcatttagcatgtccaagaaatgtataacattatacaaaataatcaaaatattcggatcatgcgaccaaggtgtagactttagcgatatcgcagaaaagataagcaagtcaggaggaataggtggcaaaaacttaggcaaaaatacttttgacctagtatttaaagaaaatagcacctatacgctagtacaaagttcagtgacaggactatacgctaagaaaacagatctacataaactatga

SEQ ID NO: 5419 - RNA, 4104 nt, synthetic construct
  misc_feature 1..4104: note = Cas9 variant
  source 1..4104: mol_type = other RNA
atgaaaaaacagaaattttcagactactatctaggatttgacataggaacaaactccgtcggatggtgcgtaaccgatcttgactacaacgtcctaagattcaataaaaaagacatgtggggatccagattattcgaggaagcgaaaacagctgcggaacggagagtccaacgcaatagtcgaagacgattaaaaagaagaaaatggagactaaatttactagaagagattttctcaaacgaaatactcaaaatagattccaacttcttcaggagactaaaggaatcatcgttatggcttgaagataaatcaagcaaagaaaaatttacactatttaatgatgacaattataaagattatgacttctataaacaatacccaacaatcttccaccttagaaacgaactaataaaaaaccccgaaaagaaagacataagactagtgtacttagcaatacattcaatctttaaaagccgaggacactttttgttcgaaggtcaaaatctaaaagagataaaaaatttcgaaactttatataataacctaatcgcattcctcgaagacaacggcatcaacaaaataatagacaaaaacaacatcgaaaaacttgaaaaaatcgtatgcgactcaaaaaagggattaaaagataaagaaaaagaattcaaagagatattcaacagtgacaaacaattagtagcaatcttcaaacttagtgttggtagcagcgtctccctaaacgacctatttgacacggatgaatacaaaaaaggagaagtagaaaaagaaaagatcagcttcagagaacaaatatatgaagatgataaaccgatatactattcaatcttgggggaaaaaattgaattactcgatatagcaaaaaccttttacgacttcatggttttaaacaacatactcgctgattcacaatatatatcagaagcaaaagtcaaactatacgaagaacataaaaaagacttaaaaaacctaaaatacataatcagaaaatacaacaaaggtaattacgacaagctatttaaagataaaaacgaaaataactacagtgcatacataggactaaacaaagaaaaatcaaaaaaggaggtaatagaaaaaagcagactcaaaatagatgatctaatcaaaaacatcaaaggctaccttccgaaagtcgaagaaattgaagaaaaagataaggccatctttaataaaatactaaacaaaatcgaactaaaaaccatactcccaaaacagcgaatctctgacaatggcactctaccatatcaaattcacgaagccgaactcgaaaaaatactagaaaatcagtcgaaatactatgatttcctaaattacgaagaaaatggaataatcacaaaagacaaactactcatgacattcaaattcaggataccatattacgtcggaccgctgaacagctatcataaagacaaaggaggaaactcatggatagtaagaaaagaagaaggaaagatacttccatggaattttgaacaaaaagtagacatagaaaagtctgctgaagaatttatcaaaaggatgactaacaaatgtacatatctaaacggagaagacgtaattccaaaagacacatttttatactcagaatacgtaatacttaatgaactaaataaagtccaagtaaatgacgaattcctaaatgaagagaacaagcgaaaaatcatagatgaactattcaaagaaaataaaaaagtatcagaaaaaaaatttaaagaatacctcctagtcaaacagattgtggatggcactatcgaacttaagggagtgaaagattcctttaattcgaattacatttcttatataagattcaaagacatcttcggagaaaaactgaatctcgatatatacaaagaaatatcagagaaatcaatcctttggaaatgtctatacggcgacgacaaaaagatttttgaaaaaaaaattaagaacgagtacggcgatattctgaccaaggacgaaataaaaaagatcaatacgtttaagtttaacaactggggaaggctatctgagaaactcttaactggaatcgaattcataaatctagaaactggcgaatgttattcatccgtaatggatgcactaagacgcaccaactataacctcatggaactcctaagctcaaagtttactttacaagaatcgattaacaacgaaaacaaagaaatgaatgaagcaagttacagggacttaattgaagaatcatatgttagcccttctttaaagagagcaatattccaaacgttaaaaatatacgaagagataagaaaaattactggaagagtccctaaaaaggtatttattgaaatggcgagaggcggagatgaatctatgaaaaataaaaaaatacctgcccgacaagaacaactcaaaaaactttacgactcatgcggaaacgacatagcgaacttcagcatagacataaaggaaatgaagaatagcctaataagttacgacaacaatagcttacgccaaaaaaagctatacctatactacctccaattcggcaaatgtatgtatacaggcagagaaatcgacctagaccgactattacaaaacaacgacacatatgatatagatcatatatatcctagatcgaaagtgataaaagacgatagttttgacaacttagtacttgtgctaaaaaatgaaaatgcagaaaagtcaaacgagtacccagtaaaaaaggagatacaagagaaaatgaaatccttctggagatttttgaaagaaaaaaacttcatatcagacgaaaaatacaaaagacttaccggaaaagatgacttcgaactccgaggatttatggcacggcaactggttaacgtccgccaaacaacgaaggaggtaggaaaaatattacaacaaatagaaccagaaataaaaatagtatacagtaaagccgaaatcgcgagtagcttccgggagatgttcgactttataaaagtgagagaattaaatgacacccaccacgcgaaagacgcatacctgaacatagtagctggcaatgtatacaacacaaaatttacggaaaaaccctatagatacctacaagaaataaaagaaaattacgacgtaaaaaaaatatacaactacgatataaaaaatgcgtgggataaagaaaatagcctggagatagtcaaaaaaaacatggaaaaaaacaccgtaaacataaccagattcataaaagaaaaaaaaggccaactattcgatctaaacccaataaaaaaaggagaaacttctaacgaaatcataagtataaaaccaaaagtctacaacggaaaagatgacaaacttaatgaaaaatatggatactataaatcactcaatccggcatatttcttatatgttgaacacaaagaaaaaaacaaaagaattaagtccttcgaacgtgtaaacctagtagatgtaaataacataaaagacgaaaaaagcttagttaagtacctcatcgaaaacaaaaagctcgtagagcctcgtgtaatcaaaaaagtctacaaaagacaagtaatcctcataaacgactacccatattccatcgtaacactcgatagtaataaactgatggactttgaaaatctcaaaccactattcctagaaaataaatacgaaaaaatcctgaaaaacgttatcaaattcttagaagacaaccagggcaaatcagaagaaaactacaagttcatatatctaaagaaaaaggacagatatgaaaaaaacgagactctagaatcagtgaaagatagatacaacctagaatttaatgagatgtatgacaaattcctagagaaattagatagtaaagactataaaaactacatgaacaacaaaaaatatcaagaattacttgatgtaaaagaaaaatttatcaagttgaatctattcgacaaagccttcacgttaaagtcatttttagacctatttaacagaaaaaccatggcagatttctcgaaagtaggactaacaaaatatctcggtaaaatacaaaaaatatcaagcaacgttttgtctaaaaacgagctatacctactagaagaatcagtaacaggcctattcgttaaaaagataaaattatga

SEQ ID NO: 5420 - RNA, 4104 nt, synthetic construct
  misc_feature 1..4104: note = Cas9 variant
  source 1..4104: mol_type = other RNA
atgaaaaaacaaaaattttcagactactaccttggatttgacattggtactaactctgtaggatggtgcgtaaccgatatgaactataatgtacttagatttaacaaaaaagacatgtggggtagtcgcctgttcgaagaagctaaaactgccgcagaaagaagagtacaaagaaacagtagaagacgtcttaaacgaagaaaatggagactcaacttattagaagagatattttctaatgaaatactaaaaattgacagtaatttctttagaagattgaaagaaagttccctctggcttgaggataaaagcagcaaagaaaaatttactttattcaacgatgacaattacaaagattacgatttctacaaacaatacccaacaatatttcacctaagaaacgaactaatcaaaaaccccgaaaaaaaagatataagattggtatatctagcaatccacagcatatttaagtcacgaggccacttcctattcgaaggtcagaacctcaaagaaataaagaactttgaaacgctatacaataatttaatagcgttcctagaagataatggaataaacaaatccatagataaagataacctagaaaaactagaaaaaatagtttgtgacagcggaaaaggacttaaagataaagaaaaagaattcaaagaaatattcaactcagacaaacagctcgtggccatattcaaactaagcgtaggattaagtgtatccttaaacgacttatttgatacggacgaatacaaaaaaggcgaagtagaaaaagaaaaaataagtttccgtgaacagatttacgaagacgacaaacccatatactacagtatcctaggcgaaaagatagaattactcgacatagcaaaaagcttctacgacttcatggtactcaacaatattctagctgatagccaatatatatcagaagccaaagtaaaattatacgaagaacataaaagagacctaaaaaatctaaaatacataattagaaaatacaacagagagaactatgataaactctttaaagataaaaacgaaagtaactacccagcttatatcggattaaataaagaaaaatccaaaaaagaagtaatcgagaaaagcaaattaaaaatcgacgacttaatcaaaagcattaaagggtacctaccaaaagttgaagagatagaggaaaaagataaggcaatcttcaacgaaatcttaaataagatagagctgaaaattatattacctaaacaaagaatatctgacaacggcaccttgccgtatcaaatacacgaagcagaactagaaaaaatactggaaaatcaaagcaaatactacgatttcttaaattatgaagaaaacggtattataaccaaagataaactcctaatgacatttaaatttcgaataccatattacgttggccctttaaactcatatcacaaagacaaaggaggaaactcatggattgtaagaaaagaagaaggtaaaatactaccatggaacttcgagcaaaaagtagacatcgaaaaatcagctgaagaattcataaaaagaatgactaataaatgtacatatctcaacggagaagatgtcataccaaaagacagctttctgtactctgaatatataatattaaatgaattaaacaaagtacaagtcaacgatgaatttctcaatgaagaaaacaaaagaaaaataatagaagagctatttaaaggtaacaaaaaggtatcagagaaaaaatttaaagaatacctattagtgaatcaaataactacaggaaccatagaattaaaaggcatcaaagattcattcaatagtaactatatcagctacataaaattcaaagacatattcggagaaaaactaaatcttgatatatacaaagaaatatccgaaaagagtattttgtggaaatgtttatatggagatgataaaaaaatatttgaaaaaaaaataaaaaacgaatatggagacattttaacaaaagacgagataaaaaaaattaatacgtttaagttcaacaactggggaaggctatccgaaaaactattaaccggcatagaatttatcaatcttgaaacaggtgaatgttattcatcagttatggaagctctaagacgtacaaattataatttgatggaactgttaagctcgaagtttacactacaagaaaacatagacaatgaaaacaaagacatctcccaattcagctacagagatctcgtagaagagtcttacgtctcacctagcctaaaacgtgcaatacttcaaacactaaagatatacgaagaaataaaaaaaatcacgggccgtgtaccaaaaaaagtgtttatagaaatggcaagaggaggggacgaaagcatgaaaaacaaaaaaatcccagcaagacaggaacaactgaaaaaactatacgattcatgcggtaacgacatagctaatttcagcatcgacataaaagaaatgaaatcatcactatctttatacgataataattcattacgtcagaaaaaactctacttatactatctgcaattcgggaaatgcatgtacacagggagagaaatcgacctcgacagacttttacaaaataacgacacttacgatatcgatcacatatacccaagatcgaaagtaataaaagacgactcgtttgacaacttagtattagttctaaaaaacgagaacgccgagaaatccaacgaatacccagtcaaaaaagagatccaagaaaaaatgaaatcgttctggagattccttaaagagaaaaacttcataagtgatgaaaaatacaagagacttaccggcaaagacgatttcgaattacgaggctttatggcgcggcaattagtcaacgtaagacaaacaacaaaagaagtagggaaaatattacaacaaatagaaccagaaattaaaatcgtatactcaaaagcggaaatagcaagttcatttcgcgaaatgttcgacttcattaaagtaagagaattaaacgatacacatcacgcaaaagacgcctatttaaacattgtagcaggcaatgtctacaataccaagttcacggaaaaaccatacagatatttacaagaaataaaagagaactacgacgtgaaaaaaatatacagttacgacataaaaaatgcatgggataaagaaaattcactcgaaatagtaaaaaaaaatatggagaaaaatacagtgaatataacacgctttataaaggaagaaaagggacagctgttcgatctaaacccaatcaaaaagggagaaacatcaaatgaaataatatccattaaaccgaaggtatacaacggaaaagacgataaactaaacgaaaaatatggctattataaaagtttgaatccggcatattttttatacgtagaacataaagaaaaaaataaaagaatcaaatctttcgagagagtaaatctagtagacgtaaataacatcaaagatgaaaaaagtctaatcaaatatctagtcgagaataaaaaattagtagaaccccgcgtaatcaagaaagtatataaacgtcaagtaattttaataaatgactatccttactcaatcgtcgcactcgatagcaataaattaatggatttcgaaaatctaaaaccactattcctagaaaggaaatacgaaaaaatactgaaaaatgttataaaatttctagaagataatcaaggcaaatccgaagaaaattataaatttatttacttaaaaaaaaaagacagatatgaaaaaaatgaaactctagagagcgtaagagaaaggtataacatagaatttaatgagatgtacgataaattccttgagaaactaaactcaaaagattataaaaactatatcaacaataaaaaatatcaagacctattggatgtcaaagaaaagtttataaaactcaacctatttgacaaagcttttacactaaaatccttcctagatttatttaaccgtaaaacaatggcggatttttctaaagtcggattaactaaatacctaggaaagatccaaaaaatatccagtaacgtattaagcaaaaacgagctatacctacttgaagagtcggtgaccggattatttgttaaaaaaattgaattatga

SEQ ID NO: 5421 - RNA, 4104 nt, synthetic construct
  misc_feature 1..4104: note = Cas9 variant
  source 1..4104: mol_type = other RNA
atggtcaaaaagaaatacgcaataggcatcgacatcggaacgaactccgtcggatggtcagtagtgaccgatgattacaaagtcccgtcgaagaaaatgaaagtttttggaaacacagagaaaagatacatcaagaaaaatctactaggaactcttctatttgacgaaggcaatacagcggaaaaccgccgactcaaacgaaccgctagaagacgctacacaagacgacgtaaccgcatactatatttacaagaaatctttgcagaagaaataaacaaaattgatgacagcttctttcaacgtctagacgatagtttcctaatagttgaagacaaacaaggcagcaaacaccctattttcggtacactacaagaagaaaaagagtaccataaacaatttcccactatataccacctaagaaaacaattggcagactcatcacaaaaagctgacataagactaatttatctagcactagctcacattataaaatatcgtggacacttcttatttgaaggcgacctcaaaagtgaaaataaagatgttcaacatctttttaacgacttcgtagaaatgttcgacaaaacagtagaaggatcctacttatcagaaaacttacccaatgtagcagatgtgctagtagaaaaagtctcaaaaagcagacgcctcgaaaacatactccactattttcccaacgagaagaaaaacggtctcttcggtaactttttaactcttgcattaggcttacaaccaaacttcaaaaccaatttcgaattagcagaagacgccaaaatacaattttctaaagaaacatatgaagaagacctcgaagaacttctaggaaaaatcggagacgattacgcagacctattcatagcaacaaaatcactatatgatggcatcttactcgcaggaatattatcaaccacagactcaaccacaaaagcaccactctcctcatccatggtgaatagatatgaagaacatcaaaaagacctagcgctcttgaaaaacttcattcaccaaaacttaagcgacagctataaagaagtctttaacgataaactgaaagatggttatgccggatacatcgaaggtaaaacaacacaagaaaatttctacagatttattaagaaagccatagagaaaatagaaggcagcaattacttcatcgacaaaatagacagggaagatttcttaaggaaacaacgcacatttgataatgggagtataccacaccagatacatctacaagaaatgcacgcaataatacgaagacaagcagaattttatccattcctagtagaaaatcaagacaaaatagagaaaatcttaacatttagaataccatactacgttggccctctcgctcgaggaaaatccgagttcgcttggctcaatagaaaatccgatgaaaagatacgtccatggaacttcgacgaaatggtcgataaagaaacttcagctgaaaacttcataaccagaatgacaaattacgaccagtatttacccgaccaaaaggtcttaccaaaacacagcttactgtacgaaaaattcgccgtttataacgaactaacaaaagtgcgatacgtaacagaacagggtaaaagtttcttctttgacgcaaacatgaaacaagaaatattcgacggcgtattcaaagtatacagaaaggtaacaaaagaaaaacttatggatttcctaggcaaagaatttgatgaatttagaatcgtagacctcctcggcttagataaagacaacaaatcattcaacgcatcactcggcacttaccacgaccttaagaaaatagttagcaaggatctactcgacaatccagaaaatgaagatatattagaaaacgtcgtacttacactgacattattcgaagacagagaaatgataagaaagcgacttgaaaaatacaaagacgtattaacagaagaacaacgtaagaaattagaaagacgacattacactggatggggaagattgtcagcgaaacttataaacggcattcgcgataaagttaccaggaaaaccatcttagattaccttatagatgacggtacatccaaccgaaatttcatgcaactaataaatgatgacacactctcattcgttgacgaaataagactcgcacaaggttcaggcgaagcagaagactaccgtgcagaagtgcaaaacttagctggctctcccgcaataaagaaaggcatacttcaatcactcaaaatcgtagatgaactaattgaagtaatgggatacgacccagaacatatagtagtcgaaatggcacgagaaaatcagttcacaaatcaaggtagacggaacagccaacaacgatataagaaaatcgaaaatgcaatcaaaaatttagattctaatttaaatagcaaaattctcaaagaataccctacaaataaccaggccctacaaaacgacagactattcctctactacctacaaaacggaaaagacatgtacaccgacgaagaacttgacatagaccaactcagtcaatacgatatcgatcacatcatacctcaagcattcataaaagacgactcactcgataataaggtactcactaaaagtgccaaaaaccgcggaaaatcagacgacgtcccgtcgttagaaattgtacataagaagaaaaatttctggaaacaattactagattcgcaattaattagtcaaagaaagttcgataatttaacaaaagccgaaagaggaggactaacaaacgaagataaagcacgcttcatacaacggcagttagtagaaacaagacaaataaccaaacacgtcgccaggattctagacactcgattcaatactaaactggacgaagcaggaaaccgaataagagatccaaaggtaaatatcattactttaaagtcaaacttagtttcacagttcagaaaagattaccaactatataaagtgagagaaataaacaattatcatcatgcacacgacgcatatttaaatgctgtcgtagcgacagcattactaaagaaatatccgcaacttgctcctgagttcgtctacggcgattaccccaaatacaatagttacaaatctagaaaatccgcaacagaaaaggtactattttacagcaacatcatgaacttctttcgacgggtactcgtatattctaaaacaggcgaagtgcgtatacgaccggtcatagaagtcaacaaagaaacaggtgaaatagtctgggataaaaagagcgacttcagaactgtacgaaaagtactatcatatccccaagttaacgttgttaagaaagtcgaaatgcaaacaggaggctttagcaaagaatcaattctacaacacggtgattcagacaaacttattccgcgaaaaacagagaaattctacctcgatacaaagaaatacggaggattcgacagtccaacgatagcatactcagttctactaatagcagacatagaaaaaggaaaagccaagaaattaaaacgggtaaaagaactgattggtataactataatggaaaggatggcgtttgagaaaaatccaatagaatttctagaacataaaggttacaaaaacattctagagaaaaacatcataaaacttcccaaatacagcctcttcgaattagaaaatggccgtagacggttactcgcatcagctaaagaactccaaaaaggtaatgaaatgatacttccccctcacttagtaaccctcttgtaccactcttcaaatatccacaaaattactgaacccatccatttaaattacgtcaataaaaacaaacacgaatttaaagaattactaagacatatcagcgacttctcaacacgatatatactagcacaagatagactgagtaaaattgaagaattgtatgataaaaacgacggtgacgatatatccgacttaacttcatcctttgtaaacctcctcacctttactgcaattggtgccccggcggccttcaaattcctaggtagtgtgatagatagaaaaagatatacatccatagctgagatattagaagcaactctaatacatcaaagcgtaacaggcttatacgaaacacgcatagacctttcaaaattaggtggagactga

SEQ ID NO: 5422 - RNA, 4104 nt, synthetic construct
  misc_feature 1..4104: note = Cas9 variant
  source 1..4104: mol_type = other RNA
atggtcaaaaaaaaatatgcaatagggatagatatcggtacaaacagtgtcggatggtccgtagtaacagacgattacaaagtaccatcaaaaaaaatgaaagttttcggtaataccgaaaaaagatatatcaaaaaaaaccttttgggcacactcctattcgacgaaggcaacactgcagagaaccgcagactcaaacgcacagcgcgcagaagatacactagaagaagaaaccgcatactctatctgcaagaaatattcgcagaagaaataaataaaattgacgattccttctttcaaaggttggacgactctttcctgatagtagaggataaacaaggctcaaaacacccaatattcggtacattgcaagaagaaaaagaatatcacaaacaattcccaacaatatatcaccttagaaaacaactcgccgacagcagccaaaaagcagacataagactaatatatcttgctcttgcgcatattataaaatatcggggccactttctattcgagggagatctaaaaagcgaaaacaaagatgtccaacatctatttaacgatttcgtggaaatgttcgacaaaacagttgaaggaagttatcttagcgaaaacctgccaaatgtcgctgacgtactagtggagaaagtctcaaaatctcgtaggctcgaaaatatattacattattttccgaatgaaaaaaaaaacggattattcggaaacttcctcgcacttgcactcggacttcaacccaatttcaaaacaaatttcgaactagccgaagacgctaaaattcaattttcgaaagagacctacgaagaagacctagaagaattactagggaaaatcggagatgactacgcagatttatttatcgctacaaaatcactatacgatggcattctgctagccggtattctgtcaactaccgactctacaactaaagcacccctaagcagtagcatggtaaatagatacgaagaacaccaaaaagacctagcgcttctaaagaatttcattcatcaaaatctcagcgactcttacaaagaagtgttcaatgataaactaaaagatggatatgctgggtatatcgaaggaaaaactacacaggaaaacttttatagatttataaaaaaagcgatagaaaaaattgaaggcagtaattatttcatcgataaaattgatagagaagacttcctccgaaaacaacgcacgtttgacaacggaagtataccgcaccaaatccatctccaagaaatgcatgcaataattcgaagacaagcagaattctacccctttttagtagaaaaccaagacaagatagaaaaaatactcacattccgaataccttactatgtaggcccactagcaagaggaaaatcagaattcgcctggcttaacagaaaatcggacgaaaagattagaccatggaatttcgacgaaatggtagataaagaaaccagtgcagaaaattttataacccggatgacaaactatgaccaatacctacccgatcaaaaagtattaccaaaacacagcctattatacgaaaaattcgcagtctacaatgaattaaccaaagtccgctatgtgacagaacaaggaaaatcgtttttttttgacgcaaatatgaaacaagaaatttttgacggtgtatttaaagtatacaggaaagtcacaaaagaaaaattaatggacttcctcggaaaagaatttgacgaatttcgtatcgtagatctattggggctagacaaagacaacaaatcattcaacgcgtccctaggcacgtaccacgatttaaaaaaaatagtatcaaaagatttactagacaacccggaaaacgaagatattctagaaaatgttgtcctcacattaaccctatttgaagaccgagaaatgataagaaaaagactcgaaaaatataaagatgtattaacagaggaacagagaaaaaaattagaaaggagacattacacaggatggggtcgattatcagccaaattaataaatggaataagagataaagttacaagaaagacaattctcgactacttaatagatgatggaacaagtaatagaaacttcatgcagttaattaacgatgatacactatcattcgttgacgaaatacgactagcccagggatcaggagaagcagaagactacagagctgaagtacaaaacctagcaggcagtcccgccataaagaagggcatactccaatcactcaaaatagtagacgaactaattgaagtcatgggatacgatccagagcatatagtagtagaaatggccagagaaaaccaatttactaaccagggaagacggaactcgcaacaaagatacaaaaaaatcgaaaacgctataaagaatcttgacagcaatctaaatagcaaaatattaaaagaataccctacaaataatcaggctctacaaaacgatcgactattcctttactacctccaaaacggaaaagacatgtacaccgatgaggaactagatattgatcagttgtctcaatacgatatagaccacataataccacaagcattcatcaaagatgattccctagacaacaaagtcttaaccaaatctgcaaaaaatagaggtaaatcagacgacgttccttcactagaaatagtacacaaaaagaaaaatttctggaagcaactactagattcacaactcatcagtcaacgaaaatttgacaaccttacaaaagcagaacgaggaggtctcacaaacgaagacaaagccagattcatacaacgacaacttgtcgaaaccagacaaataacaaagcacgtagcaagaatattagacacaagatttaacacaaagctagacgaagcaggtaatagaataagagacccaaaagtaaatataataacactgaagagcaatctagtatcacaattccgaaaagattaccaactttataaagtaagagaaataaataactaccaccatgctcatgatgcatacctgaatgcagtagttgcaacggccctactaaaaaaatacccacagctcgctccagagttcgtatacggtgactacccaaagtacaattcatacaaaagcagaaaatcagcaactgaaaaggtactattctacagcaacatcatgaacttctttcgacgcgtattggtctattcaaaaacaggagaggtacgaattagaccagtcatcgaagtgaataaggaaacgggagaaattgtatgggataaaaaaagtgacttcaggaccgtacgaaaagtactaagctatccccaagtaaatgtagtaaaaaaggttgaaatgcaaactggcggattttcaaaagagtcaatattgcaacatggagattcagacaaactaatccccagaaaaacagaaaaattctaccttgacacaaaaaaatatggtggctttgactcgccaactatcgcgtattcagttcttttaatagcagacatagaaaaaggaaaagcaaaaaagctaaaaagagtcaaagaattaataggtataacaataatggaaagaatggcattcgaaaaaaatccaatagaattcctcgaacataaaggatacaaaaacatactagaaaaaaacataattaagttacctaaatattcactatttgaattagaaaatggcagacgacgtctactcgcgtccgcgaaagaactacaaaaaggcaatgaaatgatcctacccccccacctagtaaccttactatatcactcgagtaacatacacaaaataacagaaccaatccacctaaactatgtaaataaaaataagcacgaatttaaagaactgctaaggcacatatcagatttctctacaaggtatatcctagcccaagaccgacttagcaaaatagaagaattatacgacaaaaacgatggagacgacatatcagacctaacctcgtcattcgtcaatcttctgaccttcacagcaataggcgcaccagcagcctttaagtttctcggtagcgttatagaccgaaaacgatacacctcaatagcagaaatactcgaagcaacattgattcaccaatcagtaacgggattatacgagacaagaatcgatctatcaaaactaggcggggattga

SEQ ID NO: 5423 - RNA, 4107 nt, synthetic construct
  misc_feature 1..4107: note = Cas9 variant
  source 1..4107: mol_type = other RNA
atggacaagaaatattcaataggcctagatataggtacatcatccataggctttgttggagttgatgagaacggatggccacttaatataaaaggaaaacgagctataggagcacacctgtttcgagaaggtgaagctgctgcagaaacacgcggattcagaacaacccgccgcagatacaacaggcgaaaatggcgattaagattactaagagaaatattcgacgaacctatatcccgtgtagatcccacattcttcgccagaatgaaagaatcctcagtaagtcccaaagacccaaactacgatggccttgccaaagaaatcttgatcccaagagacaaagatggtaaaatcttataccctacaatataccaccttcgtcatgcattaatgtacgaagaccaccagttcgacatcagagagatatacttggccatacaccatattgttaaatacagaggccatttcctactagacggtgccgctaaaaattttgagtcttcaaatctcgacttaaaaagcgacatccacgaaatcaatgcaattctagtaggaatattcggcaacgaacaggtccagttcaacgaccagtacgtagaaaaattaaaagaggtactattagactctacacaatctcgttccgaccgccaaaaagcagcagcaaaagtcctactaccaactaatgatttagataaagacaccacaaaaatactaaaaactgtgagcacagaaataacaaaagctattacaggcttaaaagctaaattctttgtcataacaggaaacgacatagcaaaagaccaacaaaaagattggacattctcaatagatactttagatgagaaaatgtcagtcatagaaccatcattttcagaaaagaatttctctttaataacaatactccaaaaattatattcatcggttacccttgctggtatagtacccaatggactctccctcagtgaagcaatgattcaaaaatacgacagacacgcatcagacctagttttacttaagaaatactgggacacgaaacccaaagttttaaaacaccaactccaaaacacatatgcagaatacatcgaaatccatcaagtagtagacgaattttactcagatttatcaaaattaatcaaaaacgacgacgacacattagcccaagaaataaagtcgaaaatcacaatcggtaatttcctacccaaacaaagaacaacagaaaatggagtaatcccatatcaacttcaacaaagagaattagacacaataatcaaaaaccaacaagaatattatccttggctagctgaagaaaacccagtggccgatcatcagattgctttcccatataaactagatgaattagtaggatttagaataccatattacgtcggcccaatgatagctaaagaagataccagcaacagtaagaactctaaattcgcatggatgattcgaaaacaaagcggagaagtcacaccttggaactttgacgaaaagatagatagaactgcttccgcaacagctttcatcgatcgcatgacaaccacagacacatatctaatcggtgaagacgtcctaccaaaacaaagtctaatttaccaacgattcgaagtacttaatgaattaaataaaatatctatcgacggacaacctataaccagaaaacaaaaacaatctgtatatactcacgtattcgaaaagaagaaaacagttcaagttaaagatgtacaaaaatttctagtctcatctggtgaagtaatgtctttaccgaaaataggtggacttgcaaacgaaaaacaattcaacagctccctatccacactatatgactataataaaataatacctgatgctctagaagatagaaataaagtcgatgatatcgagaaaatcatcctctggtcaacaatatttgaagacaatagcatatttgttgaaaaacttgactcaatagactggctcaccagcagtcaacgcaaaaggttagcacaaaaacgctatcggggatggggacgattgtcccttcgattgcttacaacattcaaaaacaaagatggatactccatcttagatgaactatggaactctaatcacaattttatggaaattcaagcacagagtgacttttccgaacaaatagctactgctaacaataataacctatctcaagttctacccgctaaatgggaacccggcaggaaaaatttagctagcttggacgagttcatctccaatctttatacaagcccacaaaataagaaagcactccgaaaagcaattagagtagtccaggacatgatgacagcagctggacatatgccagagaaaatattcatagaagtcgccagagatacttccaactcacatcaacaaacaattgcacgacaacggcaattgcaacaattataccaatcagaagcaaaagaagtaatagattcctccgtacgttccgaactagatgatatacttaaaaaccgagctaatataaaagaccagctctttctatattttcaacaaggaggtagagatttgtataccggaaaagcaatcaacatagacaaattaagtctataccacatagatcatattctaccacaaagtctggttaaagacgactccctagacaatcgagtacttgtatcacaaaagacaaatgaagacaaaggagttacgtttgtctcagataaatacatgaataacatgctccctacatggaaacgttggcacgaaatgggacttatctcagcaagaaaactgaaaaacctaacaatgagacctgacgaaatagacaaatatgcacccggttttatacaaagacaattagttgaaaccagacaagtaactaaactcgtaatagaactactagacgcgctattagggaactctcaaacagaaattataacaataaaggcttcattatcacatcaatttcgccaacaatttgacttagtcaaaatacgagaagtaaacgacaaccaccatgccttcgacgcattcctagcagctagaatcggaacatacttatacaaacgctacccaaaacttaggccatattttgtatacggtcaatatatgcaaaaccacaaaaacctaaaaagcattaaccttatcaaaaccctggattcagacaaagctatagtagatgaaggtacaggagaaatcctatgggataagaaatcagacttagccaaaatgataaaaatatataattatcaaagactgctaataacacatgaatcacgcaccagttttggcgcaatgtacaaacaaaagattttaaaagcaacagacgctaaacaaaacggcggaggttttaaactcgtacctacaaaaagaaactggccagtagatatatacggtggttacaccgggcaaactgcagcctacctaacaatagttagagtctacagcaagaaaaccagcgaactccgcgtgttacccatctacacaaataaagtccaacaaattgaaaaagcaatgacgcaaggcgacaaagccacaatgttagccttcaagaaagtaatcgctcctcaattaggaaaagaaaacaagaaaacacatgaaataaaaataccagagttcgatgttgtaatacctaaagtgcttttagatcagctagttattgacgacatagcaggttcaccacaccgcttccgattaggaacagatacatactaccataattcacaacaattatttctgcccttaagtatgcaacgccaattaatggatcgagaaagcgatgataaagtctaccttgacatttttaacgatgtattaaaacaagttgactcatactttaacctctacgacgtcaacggctttagagctgccctacaaaaatccaagaaagcatttgaacaactcccaataaacgactttcctaaagatgtccctgacaacaagaagaagaaaggaaaaagatccatactgaaagaaatattcattggactccatgcaaatgcaactctaggaaatttaaaacaaatgggaattaaaacagacttcggtaaactccagaaatccaacggcttaaggataacagaaaactgcaaaatcattcatcaaagtcctacaggtttattcgaaagaatagtacctattaaatga

SEQ ID NO: 5424 - RNA, 4107 nt, synthetic construct
  misc_feature 1..4107: note = Cas9 variant
  source 1..4107: mol_type = other RNA
atgtcgagaccatacaacataggtttagatatcggaacatcatccataggttggtccgtagttgacgaccaatcaaagctagtatcggtacgaggcaaatatggatacggggtccgcctatacgacgaaggtcaaactgctgctgaaagaagatcatttcgtactacaagaagacgtctaaaacgaagaaaatggaggctaggactcctccgagagatttttgaaccttatataacacctgttgatgatacattcttcctgaggcagaaacaatcgaatctatcaccaaaggaccaaagaaaactatatccgcagactagcttatttaacgatcgcacagaccgcgcattctacgatgactaccctacaatatatcacctacgttataaactaatgacagagaaaagacaatttgatatccgcgaaatctatttagctatgcaccacattgttaaatataggggacactttctcaatgaagcaccagtttcaagttttaagtcaagtgaaatcaatctagtagcgcacttcgatcgtctgaatacaatcttcgctgacctatttagtgaaagtggcttccaactcgaaaccgacaaattagcagaagtcaaagcattactcctggacaatcaacaaagcgcatctaatcgacaaagacaagccctctcactaatctatacaccgagtacaaataaggctgtagaaaaacaaaacaaagccatcgcaacagaattactaaaagctattctaggattaaaagcaaaattcaacgtattaactggaatagaagcagaagacgtaaaagcctggactttgacattcaatgctgaaaattttgatgaagaaatggtaaaactagaaagctctttggatgataatgctcaccagataatcgaaagtctacaagaactatatagcggtgtacttttagctggaatcgtaccagaaaatcagagtctgtcacaagctatgataacaaaatatgacgaccatcaaaaacacctaaaaatgctcaaagctgtacgcgaagctctagcacctgaggacagacaaagactgaaacaagcctacgatcaatatgtcgatggtcaagaaaacacaaaagcatatagcaaagaagatttttacggtgatattacaaaagcactgaaaaacaacccagaccacccaatagtaagtgaaatcaaaaagctaatagagttagaccaattcatgcccaaacaacgaacgaaagataatggcgccataccacaccaactccaccagcaagaattagaccgtataatagagaaccaacaacaatattacccatggttagctgaattaaatcctaactcaaaacgacagacggtagctaaatacaaactagatgaattagtagccttccgcgttccctattatgtaggaccattaataaccgctgaacaacaaagacaatcatcagacgcaaaattcgcctggctgataagaaaagcagaaggacgaataacaccctggaatttcgacgataaagtggaccgccaagcatcagcaaatgaatttattaaaagaatgacaacaacagacacctatttattagccgaggatgtcctcccaaaacaatccctaatctatcagcgatttgaggtacttaacgaacttaacggattaaaaatcgacgaccagcctataacgaccgaactcaaacaggcgatctttacagacctgtttatgcagaaaatttcagtaacagtgaaaaacattcaagattacttagtaagtgagaaaaggtacgcatcacgacctgcaatcacaggactatcagatgaaaacaaattcaatagtagactaagtacctaccatgatttgaaaatgatagtcggtgacgcagtagacgatgtcgataaacaagctgatttagaaaaatgcatcgaatggtccacaatattcgaagatggtaaaatatacagcgcaaaattaaacgaaatagactggctcacagatcaacaaagagtacaactagcggcaaaaagatacagaggatggggaagattaagtgcaaaacttttaacacaaatcgttaacgcaaatggacaaagaattatggacttattatgggacaccaccgacaatttcatgaggatagttcattcagaagatttcgacaaactaataacagaagccaatcaaatgatgctagcagaaaatgacgtacaagacgtaataaacgatctatatacatcaccccaaaataagaaagctctaagacaaattttattggtagtaaatgacattcagaaagcaatgaaaggccaagcacccgaacgaatattaatagaatttgccagagaagacgaagttaacccccgactatcagttcaaagaaagcgtcaagtggaacaagtataccaaaacataagtaatgaactgcttaataacacagaaataagaaatgaactaaaagatttatccaattcagcattgtccaatactagattgtttctctattttatgcaaggaggacgtgacatgtatacaggagactcactaaacattgacagactatctacatacgatatagatcacatattacctcaatcctttgtaaaagataactctctagataacagagtgctagtatcccagaaaatgaatcggtcaaaggcagatcaagtaccaacggatttcacgagcgttgaattaggaaagaaaatgcaactacaatgggaacaaatgctgcgagcaggattaataacgaaaaagaaatacgacaacctgacgttaaaccccgaccacatctcaaaatatgccatgaaaggcttcatcaatcgccaactcgtagagaccagacaagtaataaaattagctacaaatctcctaatggaacaatacggagaagacaatatagaactaatcactgtcaaatccggactgacacatcaaatgagaacagagttcgattttccgaaaaacagaaatctcaacaaccatcaccacgcattcgacgcatacttaactgcatttgtaggactatacctactaaaacggtatccaaaactaaaaccctattttgtatacggagaatatcaaaaagcatcccaacaagataaatggagaaactttaatttcctaaatggactgaagaaagatgagttagtagacgaaaacacagaggcagtaatttgggacaaagaatcaggattagcatacctaaacaaaatatatcaatttaagaaaatattagtgacacgagaagtacacgaaaacagcggagccctctttaaccaaactttgtatgcagcgaaagacgacaaagcatcaggtcaaggtggaaaacaattaattcccgcaaaacaagatagaccaactgcattatacggtggatattcgggaaaaacaagcgcctatctatgcctggtcaaaatcaaaaataaatcagaatatatttatcgcattttcggagtaaacacaagttggtccagtgaattaaaacagatccaagacccagccgaaagacttgtacgcctagaaaaattactaacgccacaattaacaattaacaaaaagaagaaaggcgaaccagtacccgtaaccaaagatttcaaaatcatacttcctaggatattaataaatcaaaaattctattctcgaggccaagacataagtattgcctctgagttctatctacacaatgaacaggagctagtcctggacaaaagtgatatcaaaattctaaatggagcaataaaagtaaacaatagcaataaacaagttataaaccttttcaatcatatactagaacaagtaaaccagtattttccggtttatgatatttataaatccagggaagttctaaactcaagcaaagaaatatttgaaaatcttacctggaacgatcaatggcgtaatcgtaaactaatcaatgtaggacagaaaactatcctcaatcgcatactaataggattacatgccaacgcagctagaataaaaataagtgaactcggatttaaaaacgacttcggtctcttaacacaaacaagtggaatcaccttcaccccagacactcaaattatctaccaaagcccaacgggactatttgagcgaagagtagctttaagagatctatga

SEQ ID NO: 5425 - RNA, 4107 nt, synthetic construct
  misc_feature 1..4107: note = Cas9 variant
  source 1..4107: mol_type = other RNA
atgaaacgatcatataatataggattagatataggaacaaactctataggatgggcaatagttgacgaccaatcaaagttaatatcggtcaaaggtaaatatgggtacggagtaagattatatgacgaaggtcaaaccgccgccgaacgtagaagttttcgaaccacaagaaggagactgaaacgacgcaaatggcgactaggcctactaagagaaatatttgaaccatatataactccaatagattcgacattctttttacgacaaaagcaatctaacttatcacctaaagatcaacgcaagctctaccctcaaacatcactttttaatgatcgaccagacgcagatttttaccaacaataccccacaatatatcatcttcgctatcaactcatgacggaaaaacgccaatttgacatacgagaaatatatttagcaatgcatcacatagtaaaatacaggggtcatttcctaaacgaggcacctgtagcctcgtttaaaagctcagaaattaatttagcagaacacttcgaccaactgaataccatattcgccgatctatttagagaatccggatttcaactcgagacagacgaattagttgccgtaaaagcactcttgatggataaccaacaaagtgcgtcaaaccgacaacgaaaagcattgccaaaactatacacgccatcagcggacaaaagtatagaaaaacaaagaaaggcaatagccacagaaatactaaaggcaattctaggattaaaagcaaaattcaacgttgtgactggaattgaagccgaagacgtgaaagcctgggccctcaccttcaatgcagagaattttgatgaagaacttgcaaaactagagagttcattagacgacaacggccacgaggtaataggaatcttacaagaattatactccggaatattactagccggtatagtcccagaaaatcaatccttatcccaagctatgattactaaatatgaagaacaccaagcacacttaaaaatgctaaaagccgtaagagatgatctagcgacggccgaccaacaaaagttaaagaaagcatacgatcaatatatcgacggccaagaaaatactaaagcatactcaaaagaggctttctacgacgatgtcacaaaagcactaaaagactacagcgaacaacccttagtaagtgaaattcaaaaattaattgaattagaccaattcatgcctaaacaaagaactaaagataacggcgctatacctcaccaacttcatcaacaagaattagaccgaataatagaaaatcaacagcaatattatccttggcttgctgaattaaacccgaatccaaaaagacaaacagtagctaagtataaattagatgaattagtagcctttcgagtcccatactatgtgggaccattaataaccgcggaacaacagcaacaaagctcaaatgccaaattcgcctggatgattagaaagaccgaaggccgcattacaccatggaatttcgatgataaagtcgatcgacaagccagtgcaaacgaatttataaaaagaatgaccacaacagacacatatcttttggcggaagacgtactaccaaaacagtcactaatctatcaacgtttcgaagtactaaatgaacttaatggcctaaagatagatgaccaaccaataacaaacgaattaaaacaagctatttttaacgatttatttatgcagaaaacatccgtatcggtcaaaaacattcaagattacttagtgagtgaaaaacgttacgcatcgcgtccagcgattacaggcctctcagatgaaaagaaattcaacagtagattatccacatatcatgaccttaaagtcattgtaggagatgctgtagacgacgtagacaagcaagctgacctagaaaagtgtatcgaatggagcacgatcttcgaagatggaaagatatatagcgcaaaactaaatgaaattacatggttgaccgaacaacaaagaggacaactcgcaacgaaaagatatcgcggatggggcagactttccgcaaaattattaacgcaaatcgtgaatgcaaacggacaacgaattatggatctcctgtgggacacaactgacaacttcatgcgcatagtgcactttgaagacttcgacaaattaataaccgaagcgaatcaaatggttttggcagaaaacgacgtacaagacgtaataaacgatctatatacaagtccccaaaataagaaagccctgagacaaattctattagtcgttaacgacatacaaaaagccatgaaaggtcaagctcccgaacgtatcctaatcgagttcgcccgcggggctcaaaaagacaaatcactaacggtgagacgaaaacggaaactagatgaaatgtattcccaaatatcagacgctgttctagccgatgaatccgtaagacaagaactaaaatcaagcaaccaagatgacctagtaaaagaaaaagtttatttgtattttatgcaaggaggaagggatctatataccggaaatgctctaaatattgatcgattatcagattatcacgtagatcacataataccacaagcatacatcaaagatgacagcctagataataaagctctagttagctcaagaatgaatgaaatcaaagcagacagggtccccctacaagtcgtacaaaaacaatttggtaaaaacatggcaagtgaatggggatacatgcaccgagcaggactcatatctagaaagaaatatgataatctaatgttcaacccagaaaatctaaataaatatcaaattaatcgcttcatatctcgacaattagtagaaactcaacaggtaataaaattagttgcaaacttattatcaaatcagtacgaaggagacaatgtcaaaattataaccgtaaaatcaaaacttacacaaacaataaggtcagaatttgactttcccaaaaatagggaggtaaataactaccaccatgcatttgacgcatatttaacagcattcgttggaatgtaccttctaaaaagatacccaaaattatcatcatatttcacatacggagaatatctcaaaggaaaccaacaagataaatggagctcattcaatttcctaaacgatctcaaaagagccaaactcgaagataaaactaacaaagaaatcttttggcacaaggagtcaggtctagcataccttaacaaaatttaccagtttaagaaaattctagtaacacgagaagttcatgaaaactcaggagcattatttaaccaaacactatatgccgcaaaagatgacaaagcctccggacaaggaggaaaacaactgataccagctaaacaagccagaccaaccgccttatacggcggatatagcggcaaaactgtggcttacatgtgcattgtcagaataaagaacaagaaaggagatctctataaagtctgcggagtagaaacaagctggttagctcagcttaaacagttgaaagacgaagattcacaaaaagcgttcttaaaacagaaaataagcccacaattcaccaaagcaaagaaacaaaaaggaacaatagtaaaagtcgtcgaggacttcgaagtaatagcgccacatatactaataaaccaacgactatttgacaacggacaagaactcacattaggtagcgcaacgtacaaacataacgaacaagaacttatactagataaaactgcggtaaaactgttgaacggagagctccccctcgcacaaagcgaagaactagccgaactggtatacgatgaaatactagatcaagtaatgcactacttcccattatatgacacgaatcaattcagagcaaaattactcgctggcaaaacagcctttatgcagttaccttggaaaagcaatccagacgataacaaaacagtgcaaattactcaacccatagtgctcaagaaaatcttacaaggattacatgcagatgcaggcagagtctcactcaaagaacttgggatgacaaccgatttcgggatgctacaaaaagcaactgggataacatttacacctgacacccaaatcatataccaaagtcctacaggattattcgagagaagagtagccctaagggatctatga

SEQ ID NO: 5426 - RNA, 4107 nt, synthetic construct
  misc_feature 1..4107: note = Cas9 variant
  source 1..4107: mol_type = other RNA
atggataaaaaatatagtataggtctagacattggaactaactctgttggctgggcagtaataaccgatgactataaggtcccatcaaaaaaattcaaagttcttggaaacacagataggcacagtataaaaaaaaatctcataggagcattactatttgactcaggagagacggccgaagctactagattaaaaagaacagcaaggagaagatataccagaagaaagaatagaatatgctacctacaggagattttctccaatgaaatggcaaaagtagacgatagtttctttcacagattggaagaatcattccttgtcgaagaagacaagaaacacgaacggcatccaatcttcggcaacatcgttgacgaagtggcataccatgaaaaatatccaacaatataccacctaagaaaaaaattagtagactcaactgacaaggccgacctccgactaatatatctcgctctcgctcatatgataaaatttcgaggccacttccttatagaaggcgacctaaacccagataattctgatgtagacaaactcttcatacaactcgtacaaacttataatcaattgtttgaagagaacccaatcaatgccagtggtgtagatgcaaaggctatcctatcagcaagattgtcaaaatcccggagactagaaaacctaatagctcagctccccggcgaaaaaaaaaacggactatttggtaaccttatagccctatcattaggtctaacaccaaactttaaatcgaattttgacctagctgaagatgcaaaactacaattatcaaaagacacctatgacgacgatctagataacttactcgctcaaataggcgaccagtatgcggatttatttctcgcagctaaaaatcttagtgatgccatcctgttatcagatatactcagggtcaatacagaaataacaaaagcacccctaagcgcaagcatgattaagagatacgacgaacatcatcaagacttaacattactgaaagccctagttagacaacaattaccggagaaatacaaggagatattctttgatcagtctaaaaacggttatgcaggctacatagacggaggcgcttcccaagaagaattttataaattcattaaaccaatccttgaaaaaatggacggaacagaagaattactagtaaaactgaacagggaggaccttttaagaaaacaaaggacatttgacaacggaagcatcccccaccaaatacatcttggagaactacacgcaatactacgaagacaggaagatttttacccatttttgaaagacaatagagaaaaaattgaaaaaattctaacatttagaatcccatactacgtcggacccctagcaaggggcaactctaggtttgcgtggatgacaagaaaatcggaagaaaccattacaccatggaacttcgaggaggtggtagataaaggagcaagtgcacaatccttcattgaaagaatgaccaattttgataaaaatctaccaaacgagaaagtcctaccgaaacactcattactttacgagtatttcactgtttataatgaactcacaaaagttaaatacgtaacggaaggcatgagaaaaccagcattcttatcaggtgagcaaaagaaggcaatagtagacttattatttaaaacaaaccgaaaagtaaccgtaaaacaattgaaagaagactacttcaaaaaaattgaatgctttgattcagtcgaaatatcaggagtagaggacaggttcaacgcctcactagggacatatcacgatcttctaaaaataatcaaagacaaagacttcctcgacaatgaggaaaatgaagacatattagaagacatagtattaacgttaacactctttgaagatagagagatgatagaagaaagactaaaaacctatgcgcatttattcgacgataaagttatgaaacagctgaaaaggagaagatatacaggttggggaagactatctagaaaattaataaacggaattcgcgacaaacagtcaggcaagacaatccttgattttctcaaatctgatggtttcgcaaatcgcaattttatgcaattaattcacgatgacagtctcactttcaaagaagatatccaaaaggcacaagtcagcggacaaggcgatagcttgcacgaacatatcgccaatctagcaggaagcccagcaataaagaaaggcattctacaaacggttaaagtagtcgatgaactagtaaaagttatgggacgacacaaaccagaaaacatagtcatagaaatggctcgggaaaatcaaacaacacaaaaaggacagaaaaactcacgcgaaagaatgaaacgtatagaagaaggaattaaagaactgggatcccaaattctcaaagaacacccagtagaaaacactcaacttcaaaacgagaaattatatctatactatttacaaaacggcagagatatgtacgttgaccaagaattagacatcaacaggctctccgactacgacgtagaccatatagtaccacaaagctttcttaaagatgactcaatcgataacaaagtactcacccgttctgacaaaaacagaggcaaaagcgacaacgtaccgtcggaagaggtagttaaaaaaatgaagaactattggagacaactacttaacgcaaaactaataacacaacgaaaatttgataacttaaccaaagcagaaagaggcggactatcagaattagacaaagccggctttataaaaagacaattggtagaaaccagacaaattacaaaacacgtagcacaaatactcgactcacgtatgaacacaaaatatgacgaaaatgataaactaatcagggaagtcaaagtaataacattaaaatccaagctagtatcagattttagaaaagattttcaattctataaagtcagggaaattaacaactaccatcatgcacacgatgcctatttaaacgccgtcgttgggacagccttaataaaaaaataccccaaattagaaagcgaattcgtttacggtgattataaagtctacgacgtacgaaaaatgatagccaagtcagaacaagaaataggaaaagcaacagctaaatactttttttattccaacataatgaattttttcaaaacagaaattaccctagccaacggtgaaataagaaaaagaccattgatagaaacaaacggagaaactggagaaattgtatgggacaaaggaagggactttgcaacggttcgcaaagttctaagtatgccacaagtcaacatagtaaaaaaaaccgaagtacaaacaggaggcttttcaaaggagtcaatactacccaaaagaaactcagacaaattaatcgctcgaaaaaaagattgggatccaaaaaaatacggcggattcgactcccctaccgttgcatattcagtcttagtcgttgcgaaagtagaaaaaggtaaatcaaaaaaattaaaaagcgtaaaagagttactaggaataaccatcatggaacgaagcagtttcgagaaaaaccctatagacttcttagaagcgaaaggatacaaagaggtaaaaaaggacttgataatcaaacttccaaaatactctctctttgaacttgaaaatggcaggaaaagaatgttagcatcagcaggtgagcttcaaaaaggcaacgaattagcactcccttcgaaatatgtgaacttcctctacctagcttcccattatgaaaaattaaaaggaagtccagaagacaacgaacaaaaacaactatttgtggaacaacacaaacattacctagacgaaattatagaacagatatcagaattttcaaaaagagtaatacttgctgacgccaatctagataaggttttgagcgcatataataaacacagagacaagcctataagagaacaagcggaaaatataatacatctattcacactaacgaatctcggtgcacctgcagccttcaaatacttcgacacaacaatagaccgaaaacgatacacatcaacgaaagaggttttagatgctacacttattcaccaatctataacaggactatatgaaactcgtatagacttatcgcaactcggcggcgactga

SEQ ID NO: 5427 - RNA, 4107 nt, synthetic construct
  misc_feature 1..4107: note = Cas9 variant
  source 1..4107: mol_type = other RNA
atggacaagaaatatagtataggtcttgacataggaacaaactcagtagggtgggcagtaattacggatgactataaagttccatccaagaaactaaaaggcctgggaaataccgataggcatggtataaagaaaaacttgataggagctctactcttcgattccggagaaacagctgaggcgacccgtctaaaaagaacagcaaggagaagatatacacgaaggaaaaacagaatttgctatctacaagaaatattctccaatgaaatggcaaaagtcgacgattcattctttcacagactagaagagagctttcttgttgaagaagataagaaacatgaacggcatccaatattcggaaatattgtagatgaagttgcttatcatgaaaaataccccacaatttatcatctgcgtaagaaactagcagacagtaccgataaagtagatctccgccttatatatctcgcactagctcacatgataaaattcagaggtcacttccttattgaaggagatctaaatcctgataactcagatgtcgataaactattcatacagctagtacaaacttacaatcaactctttgaagaaaaccccattaacgcatctcgagtagacgcaaaggctattctttcagcgagattatctaaatcaagacggttagaaaaccttatagcgcaacttcctggtgaaaagaaaaacggcctattcggtaatctaatagctctatcactgggactaacgccaaattttaaatccaactttgatctagccgaagatgccaaactccaactatcaaaagatacatacgatgacgacctagacaatctactcgcacaaataggagaccaatacgcagatttattcctagcagcgaaaaacttatccgacgcaacactactatctgacattttaagagtaaactctgaaataacaaaagcacctctctcagcatccatgattaaaagatacgatgaacaccatcaagatttaacactcctaaaggctctagtaagacaacaattacccgaaaagtacaaggaaatattctttgaccaatcaaagaacggatatgcggggtacatagacggtggcgcctcacaagaagaattttataaatttataaaacccatcttagagaaaatggacggtacagaagaattattagctaaattaaaccgagaagatcttttaaggaaacaaagaacttttgacaacgggtcaataccctatcaaatccacttaggagaactacacgcaatcttaagaagacaagaagacttttacccctttttaaaagacaatagagagaagatcgaaaagatattaacctttagaataccttattatgtcggaccactcgcaagaggaaactcaagattcgcatggatgacccgaaaatccgaagaaacaataacaccttggaattttgaagaagtagtagacaaaggagcatccgcacaatcatttatcgaacgaatgactaattttgacaaaaatttgcccaatgagaaagtcttacccaaacattcattgctatatgaatattttacggtatacaatgaacttacgaaagttaaatacgtaaccgaaggaatgagaaaaccagcatttctatccggggaacaaaagaaagcaatagtagatctactatttaaaactaatagaaaagttaccgtgaaacaattaaaagaagattattttaagaaaatcgaatgctttgactcggtagaaatatctggcgtagaggaccgcttcaacgcctcattaggcacataccacgacctacttaaaataataaaagataaagactttctggacaatgaggaaaatgaagatatactagaagatattgtccttacccttacactcttcgaagacagagaaatgatagaagaaagactgaaaacttacgcccatctcttcgacgataaagtaatgaaacaattaaaaaggagaagatacacaggatggggacgtttaagtagaaaacttattaacggaatcagggataaacaaagcggtaaaacaatactagatttcctaaaaagcgatgggttcgctaatagaaatttcatgcaactgatacatgacgactcattaacgtttaaagaagatatacaaaaagcacaagtatcaggtcaaggagactcgttacatgaacacatagcaaacttagcaggatctcctgcgataaagaaaggcatactacaaacagtaaaagtggtagacgaattagtcaaagtcatgggccgtcacaaaccagagaacatagttatagaaatggctagagaaaatcaaacgacacaaaaaggacagaaaaattcacgcgaacgaatgaaacgtatcgaagaagggataaaagagttaggctcagacatactaaaagaatatccagtagaaaacacacaattacaaaatgagaaactatacctatattatttacaaaatggaagagacatgtatgtcgatcaagaacttgatataaatcgactatcagattacgatgtagaccacatagtaccacagagcttcttaaaagatgactccattgataataaagtcttgactcgatcagataaaaacagaggaaaaagcgataatgtcccaagtgaggaagtagtaaagaaaatgaagaactattggcgacaattacttaacgcgaaacttatcacccaaagaaaattcgacaatcttactaaagcagaaagaggaggcctatccgagttagataaggttggattcataaaaagacaactggtagaaacaagacaaataactaaacacgtcgcccaaatactagactcacgaatgaacactaaatatgatgaaaacgataaattgatacgcgaagtcagagtaataaccctaaaatcgaaacttgtatcagactttagaaaagatttccaattctataaagtacgagaaataaacaactatcaccacgctcatgatgcatacctaaacgcagttgtaggaacggcattaataaagaaatatccaaaactagaatctgaatttgtatatggtgattataaagtatatgacgtacggaaaatgatcgctaaatcagaacaagaaataggtaaagctacagcaaaatacttcttttatagtaatataatgaactttttcaaaacagaaattacattagcgaacggggaaataagaaaaagaccgttaatagaaacaaacggtgagactggcgaaatagtatgggataaaggacgggattttgcaacagtgagaaaagtcctatcaatgccacaagtcaatattgtgaagaaaaccgaggtacaaacaggaggattctctaaagaaagtattttacctaaaagaaatagtgacaaacttatagctagaaagaaagactgggatccaaagaaatacggaggttttgatagccctacagtagcttacagtgtcttagtagtcgcaaaagtagaaaaaggaaaatccaagaaattaaaatcagtaaaagaactcttaggaattacaataatggaacgtagttcatttgagaaagatccaatagacttcctggaagccaaaggatacaaagaagttagaaaagatctaataatcaaattacctaaatacagtctctttgaactcgaaaatggcaggaaaagaatgctagcaagtgccggggaactacaaaaaggaaatgaactagccttaccctcaaaatatgtaaactttctttatctggcaagccactatgagaaacttaaaggatcaccagaagataatgaacaaaaacaattattcgtagaacaacacaaacactatctcgatgaaataattgaacaaataagtgagtttagtaaacgagtaatattagcggatgcaaatctagataaagtcctatcagcgtataataaacaccgagataaaccaataagggaacaagccgaaaacataattcacctcttcacactaaccaatctcggggcgccagcggcctttaaatatttcgacactacaatagatcgaaagaggtatacaagcacaaaagaagtactcgacgccactctcatacatcaatcaatcaccggattatatgaaaccagaatagacttatcgcaactaggtggcgattga

SEQ ID NO: 5428 - RNA, 4107 nt, synthetic construct
  misc_feature 1..4107: note = Cas9 variant
  source 1..4107: mol_type = other RNA
atggacaagaaatattcaattggtttagacattggtacaaatagcgtaggatgggcagttataacggacgactataaagtcccttcaaagaaattcaaagtcctaggaaacacagacagacatagtattaagaaaaatctcatcggtgcattactatttgatagtggcgaaactgcggaagctacgcgactcaaaagaacagcgcgacgaagatacactagaaggaaaaacagaatttgctacctacaagaaatatttagcaacgaaatggcaaaagttgacgatagctttttccacagactagaagaaagttttcttgtagaagaagacaagaaacatgaacgacatccaatattcggcaacatagtagacgaagtggcatatcatgaaaaataccccactatctatcatttaagaaagaaactggcagactcaacggataaagcagacttaagactcatatatttggcgttggcacatatgataaaattcagaggacactttttaatagagggcgacttaaacccagacaacagtgacgttgataaactattcatacaattagtccaaacatataatcaattattcgaagaaaaccccatcaatgcatcaagagtagatgccaaagctatactctcagctagactatctaaaagtagaagactagagaacctaatcgcccaattaccaggagagaaacgaaacggattatttggaaatctcatagccttatcattaggactaacgccaaatttcaaaagtaacttcgacttagcagaagatgcaaaactacaattgtccaaagacacatacgacgatgatttagataacctgcttgcacaaataggagatcagtacgccgacttatttcttgcagcgaaaaatttaagcgatgcaatattactttcagatatactacgggtaaactccgaaattactaaagcccctcttagcgcgagtatgatcaaaagatatgatgaacatcatcaagacctaacactattaaaagcccttgtacgacaacagttacctgaaaagtacaaagagatcttctttgaccaatcgaaaaatggatacgcaggatacatcgatgggggagcatcacaagaagagttttataagtttataaagccaattctagagaaaatggacggtacagaagaattactagccaaattaaacagagaagatctactaagaaaacaacgaacatttgataatggttcaataccacatcaaatacatttaggagaattacacgcaatacttcgccgacaagaagacttttacccatttcttaaggataatcgagagaaaatagaaaagatcttaacattccgaataccatactacgttggtcccttagccagaggaaattcaagattcgcatggatgacaagaaaatccgaagaaacgattacaccgtggaatttcgaagaagtagtcgacaaaggagcctccgcccaaagttttatagaaagaatgacaaatttcgataaaaatttacccaacgaaaaggtcctaccaaaacacagtctactatatgaatatttcacagtatataatgaactaacaaaagtgaagtatgtaacagaaggaatgaggaaacctgagttcctatcaggagaacagaagaaagccatagtagatctattattcaaaacgaatagaaaagttaccgttaaacaactaaaagaagactatttcaagaaaatagaatgtttcgattcagtagaaataagtggagttgaagataggttcaacgcttctctaggaacttaccacgaccttctcaaaataataaaagacaaagacttcttggacaatgaagaaaacgaagatatactagaagacatagttctaactctcacactatttgaagaccgggaaatgatagaagagaggctcaaaacatatgcacacttattcgacgacaaagtaatgaaacaattaaaaagacgtagatacacaggctggggtaggctttcaagaaaactaattaacggtataagagataaacagtcaggcaaaacgattctagatttcttaaaaagtgatggtttcgcgaatagaaattttatgcaattgatacatgacgatagcctaacttttaaggaagatatacaaaaggcccaagttagtggacaaggagactcactacacgaacacatagcaaatttagcaggttcaccggcgatcaagaaaggaatcttacaaacagtgaaagttgtcgatgaattagttaaagtaatgggtagacacaaaccagaaaacatagtcattgaaatggcaagagaaaatcaaacgacacaaaaaggacagaaaaactcacgggaaagaatgaaacggatagaagaagggataaaagaacttggatcagacattctcaaagaataccccgttgaaaatacacaactccaaaacgaaaaactatacttatattatctacaaaacgggcgtgatatgtatgtagaccaagaattagacataaacaggttaagcgactacgatgtcgaccatatagtaccacagagctttataaaagacgactcaatagacaacaaagttctaactcgaagtgacaaaaatagaggaaaaagtgacaacgtaccatcagaagaagtagttaagaaaatgaaaaattactggaaacaacttttaaatgcaaaactaatcacacaaagaaaatttgacaatttaacaaaagcagaaagaggaggcctatcagagctggacaaagcaggctttataaaaaggcagctagttgaaacgagacaaattacaaaacatgttgcgcaaatcctagatagccgtatgaacacaaaatatgatgaaaatgacaagttaataagagaagttaaagtgataactctcaaatccaaactcgtatcagatttccgaaaagactttcaattttacaaagtcagagaaatcaataattatcatcatgcacacgatgcatatttaaatgccgtagttgggacagcgttaattaagaaatatccaaaattagaaagtgagtttgtttacggcgactataaagtgtacgatgtgcgaaaaatgattgccaaatcagaacaagaaataggaaaagccacagctaaatacttcttctactcaaacatcatgaatttcttcaaaactgaaattacgcttgcaaacggagaaataagaaaacgacccttaatagagactaacggagaaacaggtgaaattgtttgggacaagggcagagattttgctactgtaagaaaagtactaagcatgccccaagttaatattgtcaagaaaaccgaagtacaaacaggagggttttccaaagagagtatacttccaaaaagaaattcagacaaattaatagcgagaaagaaagattgggacccgaagaaatacggtggattcgacagcccaacagtagcatattcagttctagttgtagcaaaagtagaaaaaggaaaaagtaagaaactcaaatcagtaaaagaattactaggtattacaataatggaaagatcatcatttgagaaaaaccctatagatttcttggaagctaaaggttataaagaagtaagaaaagacttaatcataaaacttccaaaatattcactcttcgaattggaaaacggcagaaaaagaatgttagcatcagcaggagaattgcaaaaaggaaacgaattggcactgccaagtaaatatgttaattttctatacctagcaagtcactacgaaaaactaaaaggaagccctgaagataatgaacaaaaacaactttttgtagaacagcataaacactacctagacgaaataattgaacaaataagtgagttctcaaaaagagtaattctagcggatgcaaacttggataaagtactatctgcttataacaaacacagagacaaaccaataagagaacaggccgaaaacataatccatctctttactctaactaacttcggagcaccagcagcatttatatatttcgatacaacaataggaagaaatagatataaaagtataaaagaagttcttgatgctactttaatccatcaaagtatcaccggactgtacgaaacaagaatagatctaagccaactaggaggagattga

SEQ ID NO: 5429 - RNA, 4107 nt, synthetic construct
  misc_feature 1..4107: note = Cas9 variant
  source 1..4107: mol_type = other RNA
atgaagtatgaatctgaagaatattacattggacttgacatgggaacatcatcagtcggatgggcagtaaccgatccgcattaccatctaatccgaaaaaaaggaaaagatctctggggagcacgcctctttgaaaaagcaaacactgctcaagagaggcggaccaaccgaatcaacagacgtcgaaatcaacgcaggaaacaacgcatcgcattcatacgagaagcttttagaaaagaagtagaaaaagtagatgtaaatttttttcgaagacttgacgaatctcaattatatttagaagataaatcaataaaggaaccatatctactttttaacgacttaaattatacagacaaggacttttaccatcaatacccaacggtgtttcacctaataacagacctattaacatcagaccgcaaattcgatattcgagaaatctacatagcagtttcaagtctatacaaccacagaggcaacttcctaaacaaaagtttaggaaatgaaactcaggacgaagaccttgtattcaaaaatttagatgaagctttctccgcctgcggtatgaactggaacaccaaagcagaaaatatcgaagtagtaaaacaaattctttgtgacagaagcctaaataaaaaggaaaaacaagaccaactagcacactgccttgagattaacaaaaaaaccgaaaaagaaaaaatcgaatttctcaaactactaacaggaggaaaagcagattccaaaaaaatgttcccacagtaccactatgaacgagacgaaaaattatccttcgcgtttgcagatgaaaacggcgacgaaaattgggaagaaacattaaacgcaattgaagaaagactaacttcagatgaatacgggctaatcttagcactcaagagcgtttatgattggtccatattagccgacctaatgaaaaatgaaaaaacgggagaaacatacccatacctatcaatggcaagaaaagactcctatgaaaaacacaaagctgatctaaggttgctaaaaagtgtaataaagagactcatacctaacgaatacaaccacttctttcggcaatatgacggtaaaggcaaaacgtacacaaactatataggctcagttcagtaccatgaaaaaagacatagattcaagcatataacaacaaaagaattttatgatggattaaagaaactacttaaaccttattcagaagatgaagaaattaaacaaatcctacaagatatagagtcagaaactttcttgccgaagcaaataactaatatgaacggagtaatcccaaatcaagtccatgccaaagaacttaaagtaatattagagaaagcctctcaacattatgatttccttaatgaaacaaacgaatctggattgacagtaaaagaacaaataatgcaaatgtttacatttcagataccttactatgtagggcctcttgcaaatctcaatggcaaaggcaatggatgggctgtaagatacgtagggaaagaaagaacaaaagtctatccatggaatatggacgaagtcatagacgaaaaagaaacagcagatcaatttataaaaaggatgatatcaacctgtacttatctaggagacgaatacgtactaccaaaatcatccattctatatgaaaagttcgcagtcttaaacgagttaaactcacttaaaatcaatggacaaccagtctcggttgacttaaaacaaaaaatatacagagatttattcacaaaaggcaaacgcgtaacacaaaagggacttttactttacctaaaaagggaaggagtcatatcaaaaagtgaagagacaatattgagtgggtttgatattgacttcaaaaatactctatcatcttatcgcaaattctgtgaagtctttgcaacaaacgaacttaacgacgaacaaatccgcatggcagaagacataatagaatggctaaccgtcttcggagattctaagaaattcgtaagggaaaaaatacatggaaattacccacaaataacagcaaatcaactaaaaagaatactatcatttaatttcaaagactggggaaaactatcaaaacaatttctggaattagaaggagaagatagagaaacgggtaaaagctgttctctcatacaagcgctctgggacacaaataacaacttaaaccaactattatcatccagatttacatataaagaaaatctagaaaagaaacgtaaaaaaatagagatggatctatttgaattcactcatgaggatttagacgacctttatatttcagcaccagtaaaacgaatgatatggcaagcattaaaaataatgaaggacatagtaatagtaatgaaagaatccccaactaaactcttcattgaaatgacaagaaacaacgaaaatgaaaaaacccgaacagtatcaagaaaaaacaaacttgtcgacttatataagaaaataaagggagaatcacgagattggataaaagaactagaacgttatgaagaaaaagattttcgaagtaaaaaattatacttatactatacacaaatggggaaaagtgcttattcaggagaacctattgacatggataaactcttcgataaaaacgtctacgacatagatcacatatacccaaaatcaaaagtaaaggatgatagtctattgaacaattgcgttctagtaaagagaaaagaaaacatggataaaggaaacaattttcctattgacccagacatacagacaaaacaagaacatctttggaaattctggctagaaaagggactcataacccaagaaaaattcaacagactaaccagaaagaaaccctttactaatgacgaacttgctgactttgtcaaccgacaactagtagagacaggacaagccaccaaaaccattgcggatctgttcaaaatgacatttccaaacagcgacatcgtatatgtaaaagcaggaaacgtaactgatttcagacaatacatagaagtctacaaatgccgagaagtaaataacctgcaccacgcatatgatgcttacttaaatgtagtagtcggcaacgtttacgataccaagttcacaaaaaaccctatgaactacatcaaagaacaaaggaaagaaaactcaaatgaacggtatcatatggacaaaatattcgaatttcccgtgatacgcaacggcaaagaagcatggataacaaaaaaagatgaaagtataaacattgtaagaaaaacactagcaagaaaaacgcctttagtaacaaaacgaaatttcgaagcaaatgggacaatagccaaagcaactatctacccaaaaggcaacgtcaaagaccagggatacctaccaagaaaaacctccattccagcactaagagacatgaaaaaatacggtggtgtaaccagcatacaaatagcatacttttttcttgttgaacacgaagttaagaaaaaacgcatccggacaattgaatgtgtaccgatctatcgaaaagaagaactgaagacaaaagaacaactagaacgatattgtagagaggaactaaaacttataaacccatcgattaggcttgaaaagataaaaccatactcactacttaaaatgaacggaaactttttctacataacaggaaaaaccaacgatagattcagtcttgccaatgcaatggagttatatgtggacaaagtttctgaaaaccacataagagacctagtaaaatataaaaattgcggatactttaacgtcgacgataaagaagccagaaaacgaaatgaacgtctatacacaatacttacaaaaaaacatttaactgtcttcaaaggcagccccaaaccaatgggagaaaaacttcaacaatatcaacaactctttctagaactcgaggttagcaaacaagtatacgtccttctacaaatattacaacttaccgctactaacgtgaaaaccaaagctgacctcaccgcgatcggaggaaaagcgaacgaaggcacaatggatataagcaaaaatctagaaaacgtcataaaaaatcaaattaaaaaaggactcgtaccagagctaatgctgatcaatcaatcaccaacaggactctttgaatccgaaatcgacctattaacgatctga

SEQ ID NO: 5430 - RNA, 4107 nt, synthetic construct
  misc_feature 1..4107: note = Cas9 variant
  source 1..4107: mol_type = other RNA
atgagcaggccatacaacataggtctggacatcggaacaagcagcataggatggtcagtagtggatgatcaatccaaattagtctcagtacgtggaaaatacggctacggagttcgcctatacgatgaaggccaaacagcagcggaaagacgctccttcagaacaactagaagaagactaaaaagacgaaaatggcgactcggattactaagagaaatatttgaaccttacataacaccagtagatgatactttctttttacgaaagaagcaatcaaacttatcacctaaagaccaaagaaaattatacccacagacgtccctcttcaatgacagaaccgatcgagccttctacgatgactacccgacgatctaccacctacgctataaactaatgactgagaaaagacaatttgacatacgagaaatatatctagcaatgcatcacatagtcaaatatcgcggacacttcctaaatgaagcacctgtatcgtcatttaaaagctcagaaataaatctcgtagcccacttcgacagattaaatactatattcgcagacctatttagcgaatcagggttccaactcgaaactgataaactagcagaggtaaaagcattactactcgacaaccaccagtctgcaagtaatcgccaaagacaagccctattactaatatatactccttcaaccaataaagctgtagagaaacagaataaagcaatagccacagaactacttaaagcaatactaggtctcaaagccaaatttaacgttctaacagggattgaagcagaagacgtcaaaacttggactctaacattcaacgcagagaacttcgatgaagaaatggtcaaacttgaaagtagcctagacgacaatgcacaccaaataattgaatcattacaagagttatattctggcgtcttacttgccgggatagttccagaaaatcaaagcctttcccaggcaatgataaccaaatatgacgaccatcaaaaacacctcaaaatgttaaaagcagttcgagaagcacttgcacctgaagaccgtcagagacttaaacaggcttatgatcaatatgtagacggccaagaaaacactaaagcctattcaaaagaggatttttatggggatataacaaaagcgctcaaaaataaccccgatcacccaatagtgagcgaaattaaaaagctaatagaattagatcaatttatgccaaaacaacgcactaaagacaatggagcgatacctcatcaactacatcaacaagaattagatagaataatcgaaaaccaacaacaatactacccgtggctagcagagctcaacccaaatagcaaaagacaaactgtcgccaaatacaaactagacgaattagtggcatttcgtgtaccatactatgtaggtcccctaataacagccgaacaacaacaacaaagtagtgatgcgaaatttgcttggatgatcaggaaggcagaaggacaaataactccatggaatttcgatgacaaagtagaccgacaagccagtgcaaacgaatttataaaaagaatgacaacaacagatacttatctcttagctgaagacgtcctgcccaaacaatcgctcatatatcaacgattcgaagtcctaaacgaactaaacggcttaaagatcgatgaccaacctataaccacagaactaaagcaagctatattcacagatctttttatgcagaaaacatcagtaactgttaaaaacattcaagattatttagtatccgagaaaagatacgcctcacgcccagcaattacaggacttagtgacgaaaataaatttaactcaagactatcaacatatcatgatttaaaaacaatagtcggagatgcagtagatgatgtagacaaacaagcagacctagaaaaatgcatcgaatggagcacaatattcgaagacggcaaaatctactcagctaaacttaacgaaattgattggctcacagatcaacaaagagttcaactagcagcaaaaagatacagaggttggggaagactaagtgcaaaactactaacacaaatagttaatgctaatggtcaaagaattatggacttattatgggacaccacagacaattttatgagaatcgtacattcagaggactttgataaacttatcacagaagcaaatcaaatgatgctagccgaaaacgacgtacaagatgtaataaacgacctatacacaagcccacaaaataagaaagctctacgacaaatccttttagtagtaaacgacatacaaaaagccatgaaaggtcaagccccagaacggattttgatagagttcgcacgcgaagacgaagtcaaccccagactaagcgtacaacgaaaaagacaagtagaacaagtatatcaaaacatatccaacgaactattaaataataccgagatccgaaatgaattaaaagacctatctaattccgctctatccaatacccgtctatttctttattttatgcaagggggccgtgatatgtatacaggtgatagcttaaatatagacagattatccacatatgacattgaccacatactaccacagagcttcataaaagataacagccttgataatcgcgtgttagtaagccaacgtatgaatagaagcaaggcagatcaagtacctactgatttcacaagcgtagagctaggccagaaaatgcaaatacaatgggaacaaatgttaagggctggactaataactaaaaagaaatatgacaatttaacactaaacccggatcacattagtaaatacgcaatgaaaggtttcatcaacagacaactggtcgaaacaagacaggtaatcaaattagccactaatctactaatggaacaatacggagaagataatatagagctcatcactgtaaagagtggactaacccaccaaatgcgtactgagttcgatttccccaaaaaccgtaatctgaataatcatcaccatgccttcgatgcatacctaacagcatttgttggactatacttacttaaacgatatccaaaactaaaaccttacttcgtttatggtgaataccaaaaagcgtcccaacaggataaatggcgaaattttaactttttaaacggattgaagaaagatgaacttgtagatgaaaacacagaagcagttatttggaataaagaaagcgggctggcgtatctaaacaaaatatatcaatttaagaaaatattagtgacaagagaagtacatgaaaattcgggtgcacttttcaatcaaaccctctacgcagccaaagacgataaagcatccggacaaggaggtaaacaactaataccggcgaaacaggacagacctactgcattatacggaggatatagcggaaaaacagttgcctacatgtgcattgtaagaatcaaaaacaagaaaggggacctatacaaagtatgcggtgtcgaaacttcatggctggcacaattaaaacaactaacagacgaagactcgaagaaagccttcctaaaacagaaaatttcacctcaatttaccaaagtaaagaaacaaaaaggaaccatagtgaaagtagtagaagactttgaagtcatagcaccccacattctcattaatcagcgcttctttgataacggccaagaacttaccctaggttctgccacgtataaacataacgaacaagaactgatactggacaaaacagcagtaaaattactaaacggagccttaccattaactcaatcagaagaattggctgaacaagtttatgatgaaatactcgaccaagttatgcattattttcccttatatgatacaaatcagttccgggcaaaattatccgcaggcaaagctgcctttatgaaattgccttggaaatcccaatgggacgggaacaaaatggtacaggtaggacaacaagtaatcttagacagagtactcattggattgcacgcaaatgcagctgtctctgacttaggagtattaaaaatatctactccattaggtaagatgcaacaacccagtggcatatccctttcaccagacactcaaataatataccaatcaccaactggattattcgagagaagagttgcactaagagatttatga

SEQ ID NO: 5431 - RNA, 4107 nt, synthetic construct
  misc_feature 1..4107: note = Cas9 variant
  source 1..4107: mol_type = other RNA
atgagtaggccatataatattggtttagatataggaacaagttcaataggttggtcagtagtcgatgatcaaagcaagctagtatccgtacgtggaaaatacggctatggtgtccgattatacgatgagggacagaccgctgcagaaagaagatcatttagaacaacaagacgaagactaaaaagaagaaaatggagactcggcctcttgcgagaaatctttgaaccctacatcaccccagtcgacgatactttctttcttaggcaaaaacagagcaacctctcacccaaagaccaaagaaaattatatccccaaacttctctatttaatgaccgaacagatcgtgcattttatgatgattatcccacaatctaccatttacgatacaaattgatgactgagaaaagacaattcgacatcagagaaatatatttagcaatgcaccatatagtcaaataccgtggacatttcctaaatgaagcccctgtaagctcatttaaatcatccgagataaatttagtagcacattttgatagacttaatactatatttgccgatttattctcagaatcaggcttccaactagaaaccgataaattagcagaagtgaaagccttattactcgataatcaacaatctgccagcaacagacaaagacaggcattatcactaatatataccccctctacaaacaaagcagtagagaaacaaaataaagccatagcgacagaacttttaaaagccatactcgggctgaaagcaaaattcaatgtccttacacgaatagaagcagaagatgttaaagcatggacattaacttttaatgccgaaaacttcgatgaagaaatggttaaattagaaagctcattagatgacaatgctcaccaaattatcgaatcattacaagaattatactcaggaatcctactagcgggaatagttcccgaaaaccaatccttatcacaagctatgatcatgaaatacgatgaccatcaaaaacacctgaaaatgctaaaagcagtaagagaagcattagcgccagaagatcgacaacgactcaaacaagcatacgatcaatatgtagatgggcaagaaaatacaaaagcatattctaaagaagacttctacggcgatattacaaaagcattaaagaataatccagaccacccgattgtatccgaaataaagaaattaatcgaactagaccaattcatgcccaaacagagaacaaaagataatggagcaattccacatcaactgcaccaacaagaactggacagaataatagaaaatcaacaacagtattacccatggttagcagaattgaacccaaatagtaaaagacagacagtggccaaatacaaacttgatgaactcgtagcattcagagtaccatattacgtaggaccattaattaccgctgagcagcaacggcaaagctcagacgcaaaattcgcttggcttataagaaaagctgagggacgcatcactccatggaatttcgacgataaagtcgaccgacaggcatcagcgaatgagttcatcaaacgcatgactaccacagatacctatctactagcagaagacgttctaccaaaacagagccttatatatcaacgatttgaagtgctaaatgaacttaatgggcttaaaatcgacgatcagcctataaccacagaactaaaacaagctatattcacagatttattcatgcaaaagacatcagtatcggtcaaaaacatacaagactaccttgtaagcgagaaaaggtatgcatcacgcccagctataacaggtctatcagacgaaaacaaatttaacagtcgcctaagcacctatcatgatctaaaagccatagtaggcgacgctgtagaagatgttgataaacaagtagatcttgaaaagtgcgttgaatggtctaccatcttcgaagatggtaaaatatattcagcaaagctaaacgaaatcgactggctaacagatcaacaacgagtacaattagccgcaaaacgctaccgaggatggggccgtttgagtgcaaaattactaacacaaatcgtaaatgcaaatggacaacgtattatggacttactttgggatacaacagacaatttcatgaggatagtccacagcgaagatttcgacaaattaattacagaagccaaccaaatgatgctagctgaaaacgacgttcaagatgtaataaacgatctctatacaagcccacaaaacaagaaagccctaagacaaatattgctagtagttaacgacatacaaaaagccatgaaaggacaagcgccggaaaggatactaattgagttcgcaagagaagacgaagttaacccgagactatccgtacaacgaaaacgacaagtagaacaagtatatcaaaacattagtaatgaacttctaaacaatacagaaataagaaacgaattaaaagatctatcaaactctgctctctcaaacaccagactatttctatactttatgcaaggtggaagggacatgtataccggagacagtctcaacatagatagattaagcacatacgacatagaccacatactcccccaatctttcataaaggacaattcattagacaaccgtgtattagtctcccagaaaatgaatcgttcaaaggcagatcaagtccctacggacttcacttcggttgaattaggaaagaaaatgcaactacaatgggaacaaatgttacgagcagggttaataactaaaaagaaatacgacaatctaacacttaatcctgaccacatttctaagtatgcaatgaaaggatttattaaccgacaacttgtagaaacccgtcaagtaataaaactcgcaacaaatcttctcatggaacaatatggagaagacaacatagaattaatcacagttaaatcaggcttaacacatcaaatgagaaccgagttcgacttccctaaaaacagaaatttgaataatcaccaccacgcatttgatgcttatttaactgctttcgtagggttgtacttactaaaacgatacccaaagttaaaaccttactttgtatacggagaatatcaaaaagcgtcccaacaagacaaatggagaaatttcaactttctaaacggtctaaagaaagacgagctagtagacgaaaacaccgaagctgtaatatgggacaaagaatcaggtttagcatatttaaacaaaatttatcaattcaagaaaatactcgtaacaagagaagtacacgaaaactctggagcactatttaatcaaacgctctacgccgccaaagatgataaagcaagtggtcaaggcgggaaacaattaattccagctaaacaagacagaccgaccgcattatatggcgggtactccggaaaaacagtagcatacatgtgcatagtaagaattaaaaacaagaaaggagatctatataaagtatgtggcgtagaaacgtcatggctagcacaactaaaacagcttaccgatgaggacagccaaaaagcatttctaaaacagaaaataagcccacaattcactaaagtgaagaaacaaaaaggtaccatagtcaaagtagtagaagacttcaaagtcatagcaccgcatatactaataaaccaaagattctttgataatggacaagaactaaccctcggaagtgcaacttataaacataacgaacaagaacttatattagataaaacagcagtaaaactgttgaacggcgcacttccattaacacaatccgaagaactagctgagcaagtatatgacgaaatattagatcaagtaatgcattattttcctctttacgacaccaaccaatttagagcaaagttgtcagcaggaaaagcagccttcatgaaactgccttggaaatccatctgggacggtaacaaaatgacacagattggacaacagataatcctagaccgtatactaatcggtttacacgcgaacgctgctgtaagtgacctaggagtccttaaaataagtactccattaggaaaaatgcagcaacccagtggaattagcttatctccagatacccaaataatataccaatcacccactggattattcgaaagacgcgtagccttgagagatttatga

SEQ ID NO: 5432 - RNA, 4107 nt, synthetic construct
  misc_feature 1..4107: note = Cas9 variant
  source 1..4107: mol_type = other RNA
atggttgaaaagaaaagctattctattggcttagacataggaacaaactccgtaggatgggcagtaataaccgatgattataaagtccctgccaagaaaatgaaagttcttggaaacacatccagacaatcaattaagaaaaatatgataggagctctcctctttgatgaaggtggacctgcagcatcaactcgagtaaaacggacaactcggcgaagatatactaggaggaaaaacagactttgttatttaagagatatatttgagtctgagatgcacacgatcgacaaacacttctttttacgcctcgaagattcatttttacataaaagcgataaaagatatgaagcacacccaatttttggaactctacaagaagaaaaagcgtaccacgataactacccaaccatttatcacttaagaaaagccctagctgataatactgaaaaagcagacctacgcttaatatacttagcattagcacacattatcaaatttagaggacattttctgatcgaaggagcattaagcgcaaataacactgacgtgcaacaattggtccatgctctagtagacgcttacaatataatgttcgaagaagaccaattagacatagaagccatcgacgtaaaagcaatcttaacagagaaaatatctaaaacgaggagattagaaaatctaatatctaatattcctggacaaaagaaaaacggactgttcggtaacctcatagcactaagtctaggattaacacctaatttcaaaagtcattttaaccttcctgaagacgctaaactacaattagccaaagatacatacgatgaagaacttaacaatttactaacacaaataggcgatgaatatgcagatttgttcctaagcgccaaaaacctcagtgacgcaattctcttatcggatatactaacggtcaacggtgacggcacacaagctccactatccgcatctttaattaaaagatacgaagaacacagacaagacttagccctactaaaacaaatgttcaaagaacaactccctgacctctatagagacgtatttaccgacgaaaataaagatggatacgcaggttatataagcggaaaaacaagtcaagaagcattctacaaatatatcaaaccaattttagaaaccctagacggagccgaagacttcttaaccaaaattaaccgtgaagactttttacgaaaacaacgaactttcgacaatggaagtataccacaccaaatccacctaggagaactccaagctatattggaacgccagcaagcctattacccatttctcaaagataaccaagagaaaatagagaaaatactgaccttccgaataccatactatattggacccctcgcaagaggcaacagcaggttcgcctggctaacaagaacatcagaccagaaaatcactccatggaatttcgacgaaatggtagatcaagaagcctcagcgcaggcttttattgaaagaatgaccaattttgacgaatatttaccacaagaaaaagtactcccaaaacactcactaacatatgaatacttcacagtatacaatgaactaacaaaagtaaaatatgttactgaaggaatgaccaaaccagaatttttatccgcagggcaaaaagaacaaatagtagagttactcttcaagaaataccgcaaagtaacagttaaacaactaaaagaagacttcttttccaaaatcgaatgctttgataccgtagatatatcaggagtagaagataaatttaacgcgtcactgggaacataccacgatttattaaaaattatcaaagataaagcattcttagacaactcagaaaatgaaaatataatagaagacattatattaacactcaccttgttcgaggataaagaaatgatagccaacagactcgcagtctacgaggatttatttgaccaaaacgttctaaaacaattaaaacgtcgccattacaccggctggggacgactatcaaaacaattaataaacggcatgagagacaaacatacaggcaaaacaatattagacttcttgaaagcggacggattcataaatcgaaactttatgcaattaataaacgatgataatctatcttttaaagaagagatcaagaaagcacaagaagggggattaaaagactctataaatgaccaaataagagacctcgctggatctcctgctattaagaaagggatcttacaaacaattaacatagtcgacgagattgtcaaaataatgggaaaagcaccccaacatatcgtagtagaaatggctcgagacgtgcagaaaaccgacataggagtaaaacaatctagagaacgaatgaaaagagtacaagaagtactcaagaaattaggaagtcaactgctaaaagaacacccagtagaaaactttcaattacaaaacgaaagactatatctatactaccttcaaaatggaaaagatatgtacacaggagaagaattatctatatcaaatttatcgcactatgatatagaccatataatcccacgcagcttcataaaagacgactctattgataacaaagtactaactcgctcagaacacaatcgaggaaaaaccgacaatgtacccagtatcgaagttgtaaaaagaatgaaaccatactggcaaaaattgctagacacaaaagtaatatcacaacgaaaatttgacaacctaaccaaagcagaacgcggtggcttacaagaatcagacaaagctaactttatccagcgccagctagtagaaacaagacaaattaccaaacacgtagcccaaattctagatagtagattcaatacagaaagagacgaaaaagatagaccaataaggagagtaaaagtcattaccctcaaaagtaaattcgtatcagattttcgacaagacttcggcttttataaactccgagagataaacgactaccatcatgcacacgatgcatatctcaacgcagttgtaggcacagcgctactaaaaatgtatcccaaactagcctcagaatttgtatatggggactaccaaaaatatgatctaaaacgcatggtaggtaaaagcggcaaagcaagcggccacgcaacagcaaagtacttcttttattctaatttaatgaacttctttaaaagtgaagtaaaactagcaaatggaaacataataaaacgtagccccatcgaagtaaatgaagaaactggcgaaatagtatgggataaaaccaaagatttcggcactgtcagaaaggtactgtcagcaccccaagtaaacattgtcaagaaaactgaaatacaaacaggaggttttagcaatgaaactatactaagcaaaggaaaatcaagcaaattaataccgagaaagaataaatggcgagacactacaaagtatggaggattcaatacacccaccgtcgcctactctgtattagtcgtagctaaagtagaaaaaggcaaagccaagaaacttaaacctgtaaaagagctagttggtattactataatggaacgcacaaaatttgaagcaaatccaatagcatttctagaaagcaaaggttatcatgacatccaagaacatctaatgatcacactcccaaaatattcattgttcgaactagaaaatggtagaagacgactacttgcatcagctaccgaactacaaaaaggtaacgagatggtactaccgcaacatttagtcaccttcttatacagggtatcaaaacgagacaaaggtacccaaagtgaaaatatggaatatatcagtaaccataaagaaaaatttatcgaaatatttcattatataatacgatacgcagagaaaaatgtgattaaaccaaaagtaattgagagattaaacgatacatttaatcaaaaattcaatgacagtgatctcacagaactatcaatatcctttcttaacttattcaaattcacatcgttcggggcaccagaaaaatttacgtttctaaattcagaaatcaaacaggacgatgtcagatatagatcaacaaaagaatgcctgaacagcacattgattcatcaaagcgtcactggcttatatgaaacaagaatcgatttatcacaatttgggggagattga

SEQ ID NO: 5433 - RNA, 4107 nt, synthetic construct
  misc_feature 1..4107: note = Cas9 variant
  source 1..4107: mol_type = other RNA
atggataaaaagtacagtattggactcgatattgggacaaactcagtaggatgggcagtcataacagacgactataaagtaccatctaaaaagttcaaagtgcttggaaacacggacagacacagcatcaagaaaaatctaataggcgcattattatttgattctggagagacagctgaagcaacaaggttaaaacgaacagctagacgacgatacacacggaggaaaaacagaatttgttacctacaagagatattttcgaatgaaatagcaaaagtagatgattccttctttcaccgactagaagaatcattcctagttgaagaagataagaaacatgaaagacatcctatcttcggaaacatagtagatgaagtagcatatcatgagaaatacccaactatttatcatctaagaaagaaattagcagatagtacggacaaagcggacttaagactaatatatttagcattagcacatatgatcaaattcagaggacacttcctaatcgaaggagatcttaatcccgacaactcagatgtggacaaactgttcatacagctagtgcaaacgtataatcaattatttgaagaaaatcctataaacgcaagtcgtgtagatgccaaagcaatactatctgctagactatcgaaatcaagaagactcgaaaatctaattgcacaactaccaggcgagaaaaggaacggcttattcggtaatctgatagcattaagcctaggactaacaccaaacttcaaatcaaacttcgatctagccgaagatgcaaaactacaactaagcaaagacacatacgatgatgacttggacaatttactagctcaaatcggcgatcaatacgcagacctgtttctcgcagctaaaaatctgtccgacgccatcctactatcagatattttacgagtcaatacagagataacaaaagctccactctcggcttcaatgattaaaagatatgatgaacatcaccaagatctaaccctactcaaagccctagtacgacaacaactaccagagaaatataaagaaatatttttcgatcaaagtaaaaatggatatgctggatatatagatggtggagcatcacaagaggagttctataaatttataaaacctattttagagaaaatggatggaactgaagaattattagcaaaacttaatcgagaagacctactccggaaacaacgaacatttgacaacggatctatacctcaccaaatacacttaggagaactacacgcaattcttcgtcgccaagaagacttttatccttttcttaaagacaatagagagaaaattgagaaaatactgacattcaggataccatactacgtaggtcctctcgcaaggggcaacagtagattcgcttggatgacaaggaaatcagaagaaactataacaccatggaatttcgaagaagtcgtagacaaaggcgctagcgctcaatcgttcatagaaagaatgacgaattttgataaaaatctgccaaacgaaaaagtgctccctaaacatagcctcctatacgaatattttaccgtttataacgaacttacaaaagtaaaatatgtaacagaaggtatgagaaaaccagcatttttatctggagaacaaaagaaagcgatagtagatctattatttaaaacgaatcgcaaagtaacagtcaaacaactaaaagaagattatttcaagaaaatagaatgttttgatagtgtagaaatatcaggggtagaagaccggttcaatgctagcttaggaacttaccacgacttgttaaaaattattaaagataaagacttcctggataacgaagaaaacgaagacatacttgaggacatagtcctaaccttgacactgttcgaagatagagaaatgatagaggagagactaaaaacatatgcacacctatttgacgacaaagtgatgaaacaactcaaaagaagacgatacaccggatggggcaggctatcaagaaaactaattaatggaataagagacaaacaatctggtaaaacaattctggatttcctaaaaagcgacggatttgcaaatagaaactttatgcagttaatacatgacgacagcctcactttcaaagaagatctgcaaaaagcacaagttagcggccaaggggacagtctacacgaacatatagcaaacttggccggatcacccgcaattaagaaagggatactgcaaaccgtcaaagtagtagatgaattagtaaaagtaatgggacgacataaaccagaaaacattgtaatagaaatggctcgagagaaccagacgacccaaaaaggtcagaaaaatagtagagaaagaatgaaaaggatagaagaagggataaaagagcttggaagtgacatacttaaagaataccccgtcgaaactacacaactacaaaacgaaaaactttacctctactacctacaaaacggccgtgatatgtatgtagatcaagaactagatataaatagattatcagattatgacgtggaccatatagtaccacaatcatttttaaaagatgacagcattgataacaaggtccttaccagaagcgacaaaaatcgtggaaaatcagataacgtcccgagcgaagaggttgtaaagaaaatgaaaaactactggaaacaactactcaatgctaaattaataacacagcgaaaatttgacaatttaacaaaagcagaacgcggtggcctaagcgaactagacaaagcaggatttatcaaacgacagctagttgaaaccaggcaaatcacaaaacacgttgcccaaatactagatagccgaatgaatacaaaatatgacgaaaacgacaaattaattcgagaagttagagttataaccctgaaatctaaacttgttagcgattttcgaaaagatttccaattctataaagtaagagaaataaacaactatcaccatgcacatgatgcatacctaaacgctgtagttggcactgcactgataaagaaatatccaaaacttgaaagtgaatttgtatatggagattacaaagtttacgatatacgtaaaatgatagcaaaaagtgaacaagaaatcggaaaagcgacagcaaagtactttttctatagtaatataatgaactttttcaagacagaaataacattagccaacggagaaatacgaaaaagacctctaatcgaaaccaacggagaaacaggggagatagtatgggataaaggcagagacttcgctactgtccgaaaggtactttctatgccacaagtcaacatagtcaagaaaacagaagtacaaacaggaggcttttctaaagaatcaatattaccaaaacgaaactcggataaattaattgcaagaaagaaagattgggatcccaagaaatatggaggatttgatagcccgacggtagcatacagcgtattagtcgtagccaaagtagaaaaagggaaatcaaagaaattaaaatccgtcaaagagctcgtaggcattacaataatggaacgctcaagtttcgaaaaagatccggttgactttttggaggccaaaggatacaaagaggtacgaaaagatcttattattaaattaccaaaatacagtttattcgaactagaaaatggacgaaaaagaatgttagctagtgcaggcgaacttcaaaaaggaaacgaactcgcactcccgagtaaatatgttaacttcctatatttagcatcacactatgaaaaattgaaagggagtccagaagacaatgagcaaaaacaactatttgtagaacaacacaaacattatctagacgaaattatagaacaaataagtgagttcagcaaaagagtaatattagcagacgcaaacttagacaaagtattatcggcctataacaaacacagagataaaccaatacgtgaacaagctgaaaacataatacatctttttacactaacgaatttaggagcacccgcagcttttaaatgtttcgacacaacaatcggaagaaacagatacaaaagtatcaaagaagtactagacgcaacactcattcatcaatccattacaggcttatatgaaacaagaatcgatctttcccaattaggaggtgattga

SEQ ID NO: 5434 - RNA, 4107 nt, synthetic construct
  misc_feature 1..4107: note = Cas9 variant
  source 1..4107: mol_type = other RNA
atggataagaaatattccattgggttagatataggaacaagttcaataggatttgtcggagtagacgaaaatgggtggcctttaaacataaaaggcaaaagggcaataggagcgcatttgttcagagaaggcgaagcagctgcagaaactcgaggtttccgaaccacccgaagacgctacaaccgaaggaaatggagactaagattattaagggaaatattcgacgaaccaatctcaagagtcgaccccacgtttttcgcaaggatgaaagaaagttctgtatcaccgaaagatccaaactacgacggattagcaaaagaaatattgatcccaagagataaagacggcaaaatattatatcccactatatatcacctaaggcacgcattaatgtatgaagaccaccaatttgacataagagaaatatatctcgcaatacaccacattgtaaaataccgaggacatttcctactagatggagccgctaaaaatttcgaatcgtcaaatttagaccttaaatccgatatacacgaaattaacgcaatattagtcggtatatttggaaatgaacaagtccaatttaatgaccaatacgtagaaaaactgaaagaagtgttattagattcaacccaaagtcgaagtgatagacaaaaagccgcagcaaaactgctcttacccacgaatgacttagacaaagataccacaaaaatcttaaaaacagtctctacagaaattacaaaagcaattacgggactaaaagccaaattctttgttatcacaggcaatgatatcgcgaaagaccaacaaaaagactggacgttctcgatcgatacattagacgagaaaatgtccgtaatagaaccctcgttctcagagaaaaattttagcctgataacaattttacaaaaactctactcttctgtaacccttgccggaatagtccccaacggactatctttaagtgaagcaatgattcaaaaatacgaccgccacgcaagcgatttagtactcttgaagaaatattgggataccaaacccaaagtactcaaacaccaactccaaaacacttatgccgaatacatcgaaatacaccaagtagtagatgagttctatagtgacctgagcaaactaattaaaaacgatgatgacacactcgctcaagaaataaaatcaaaaataacaataggcaacttcttacccaaacaacgtactacagaaaatggtgtcataccataccaactacaacaacgggaattagacaccatcatcaaaaaccaacaagaatattacccatggctagcagaagaaaacccagttgctgaccaccaaatcgcattcccctataaactagacgaactcgtcggatttcgcataccgtattacgtagggcccatgatcgcaaaagaagatacatcaaacagcaaaaacagcaaatttgcatggatgataagaaaacaatcaggcgaagtcacaccatggaatttcgacgagaaaatagaccgcactgcgagtgctacagcatttatagacagaatgaccacgaccgatacatatctgataggagaagacgtacttccaaaacaatctctcatataccaacgatttgaagtcctgaacgaactaaacaaaatatctattgatggccaaccaattacacgaaaacaaaaacaaagtgtctacactcatgtctttgagaaaaagaaaactgtacaagtaaaagacgtccaaaaattcttagtatcttcaggagaagtaatgagtttacccaaaattggagggctggcaaatgaaaaacaattcaactccagtctaagtacgctatacgattacaacaaaataatacccgatgcattagaagacagaaacaaagtagatgatatagagaaaataatactctggtcaacaatttttgaagacaacagtatcttcgttgaaaaactggattctatcgactggctcactagcagccaacggaaacgtttagcacaaaaacgatataggggatggggccgactaagtctaagattattaacaacattcaaaaacaaagatggatactcaatcctcgacgaattatggaactcgaatcacaactttatggaaatacaagcacaatctgacttttcagaacagattgccactgccaacaacaacaacctatcccaagttctaccagcaaaatgggaaccaggacgcaaaaacctagcttccctagacgaatttatatctaacctctatacatcaccacagaataagaaagcattaagaaaagcgataagagtcgtacaggacatgatgaccgctgccgggcacatgccagagaaaatattcatcgaagtggccagagatacgtccaattcacaccaacaaacaatagcaagacaaagacagttgcaacaattataccaatcagaagacaaagaagtcatagattcatcagtaagatccgaactagacgacatactaaagaacagagcaaacatcaaagatcaactattcttatacttccaacaaggaggacgagatttatacactggaaaagcaatcaatatcgataaattaagtctataccacatagaccacatacttcctcaaagcctagtcaaagatgatagtctagacaatcgagttctagtttcacagaaaacaaatgaagacaaaggcgtaaccttcgtgagtgacaaatacatgaataacatgctgcctacgtggaaaaggtggcatgaaatgggacttatatctgccagaaaactgaaaaacttaaccatgcggcctgatgaaatcgacaaatatgcaccaggattcatacaacgacaattagtggaaacacgccaagtaaccaaattagttatcgaacttctcgatgccctattaggaaatagccaaaccgaaattattacaataaaagcctcactaagtcaccaatttagacaacaattcgacttagtaaaaattagagaagtgaacgataaccaccacgcctttgatgcattcttggcagcaagaattggaacatacttatataaaaggtatcctaaactcagaccatattttgtgtacggacaatacatgcaaaaccacaaaaacttaaaatccattaatctgataaaaacattagattccgataaagcaatagtcgatgaaggcacaggagaaatcctgtgggacaagaaatcagacttagcaaaaatgatcaaaatatacaattatcaacgacttctcataacacatgaatcaagaacatcctttggagcaatgtataaacagaaaatactaaaagcaacagacgcaaagcagaacggaggtggattcaaattagtcccaacgaaaagaaacagacccgtagatatctatgggggctacacaggccaaacagcagcttacctaacaatcgtacgcgtatactctaagaaaacttccgaattaagagtattgcccatatacaccaacaaagtccaacaaatagaaaaagcaatgactcaaggggacaaagctacaatgttagcctttaagaaagtcatcgcaccgcaattaggaaaagagaataagaaaacccacgaaataaaaatccccgaatttgacgttgtaatccccaaagtattgttagaccaactggtaattgacgatatagccggaagccctcacagattcagattaggaacagatacatactaccacaactctcaacaactttttcttccactatctatgcaacgtcaactaatggatcgagaatcagacgacaaagtgtacctagacatcttcaacgatgtcctaaaacaagttgactcctactttaacttatacgatgtaaacggctttcgcgcagcacttcaaaaatctaagaaagcattcgaacaattaccaataaatgattttcctaaagacgtcccagacaataaaaagaagaaaggaaaaaggagcatcctaaaagaaatttttattggattacatgcaaacgccacgctaggaaacctaaaacaaatgggaataaaaacggatttcggcaagctccaaaaatcaaacggtttaagaataacagaaaactgcaaaattattcaccagtcccccacaggactatttgaaagaatagtcccaataaaatga

SEQ ID NO: 5435 - RNA, 4107 nt, synthetic construct
  misc_feature 1..4107: note = Cas9 variant
  source 1..4107: mol_type = other RNA
atggataagaaatatagcattggcctcgatataggtactaacagcgtaggttgggccgttattacagacgattacaaagtaccatcgaagaaattcaaagttcttggtaatacagatagacattcaataaagaaaaacttaataggagcactgttattcgattcaggcgaaattgccgaagcaactagactcaaaagaacagcgagaaggagatatacccgacgcaaaaaccgaatatgctatctacaggaaatattttctaacgagatggccaaagtggacgactcctttttccatagactcgaagaaagtttcttagtcgaagaagacaagaaacacgaaagacacccaatattcgggaatatagtggatgaagtagcttatcacgagaaatatcctacgatatatcacctaagaaagaaattagtagattccaccgacaaagcagacttacgactaatttacctagcgctcgcacatatgattaaattccgcgggcacttcctgatagaaggagacttgaatccagataattcggatgttgacaaactattcattcaactcgttcaaacatacaatcaacttttcgaagaaaaccccataaatgcatcaggagtagacgccaaagcaatcttgagcgcgagactatccaaatcaagaagactggaaaacttaatagcccagttgccaggtgaaaagaaaaatggtctatttgggaatctaatcgcactaagcctaggtttaactccaaatttcaaatcaaatttcgatcttgcagaagacgcaaaactacaactaagtaaagacacttatgatgatgaccttgataacctactcgcacagataggtgaccaatatgccgacttatttttagcagcgaaaaatttaagtgacgctatcctgttaagcgatatattacgactaaacagcgaaataacaaaagccccactttcagcatctatgataaaaagatacgacgaacatcatcaagatttaacactactaaaagcacttgtacgccaacaattacctgagaaatataaagaaatcttcttcgatcaatcgaaaaatggctatgctggatatattgatggaggggcctcacaagaagagttctataaatttataaaaccaatacttgagaaaatggacggtaccgaagaactgctagctaaattaaatagagaagatctgctcagaaaacaacgtaccttcgacaatggttccatacctcaccaaatccacttaggtgaattacacgcgatactcagaagacaggaagacttctacccatttctcaaagacaaccgagagaaaatagagaaaatactcaccttcagaataccctactatgttggaccattagcaagaggaaattctagattcgcgtggatgacacgaaaatctgaagaaacgataacaccttggaacttcgaagaagttgtagataaaggagcttcagctcaatccttcatagaaagaatgacaaacttcgataaaaatttgccaaacgaaaaagttctccccaaacacagcttactatacgaatatttcacagtatataatgaactcaccaaagtaaaatacgtcacagaaggaatgcgaaaaccggcatttctctccggagaacagaagaaagccattgttgacttattatttaaaacgaacagaaaagtaacagttaaacaactaaaagaagactactttaagaaaatagaatgttttgattctgtcgaaatctccggtgtagaagaccgatttaatgcaagcctaggtacatatcacgatttactcaaaataattaaagataaagactttttagacaacgaagaaaatgaagacatcctagaagacatagtattgaccctcacattattcgaagacagagaaatgatcgaagaacgattaaagacctacgcacatttattcgatgataaagttatgaaacagctgaaacgccgcagatacacagtatggggaagactatcgcgaaaactcataaatggaattagggacaaacaaagtggaaaaaccatcctagatttcctcaagtcggatggatttgccaatcgaaactttatgcaactcatacatgacgacagccttaccttcaaagaagatatacaaaaggcacaagtaagtggtcaaggagattcgttacatgaacatatagctaacttagctggttcgccggcaataaagaaaggaatactccaaaccgtaaaagtagtagatgaattggtaaaagtaatgggaaggcacaaaccagaaaatatagtaattgaaatggccagagaaaaccaaacaactcaaaaagggcagaaaaatagtcgagaaaggatgaaacgaatagaagaaggaataaaagaactcggcagtcaaattctaaaagaacatcccgtagaaaacacccaactacaaaatgaaaaactatacttatattatttacaaaatggccgcgacatgtatgtagatcaagaattagatataaaccgactgagcgattatgacgtcgaccacattgttccacaatcgtttataaaagacgactcaatcgacaataaagtactaacaagaagcgataaaaacagaggtaaatccgacaacgtaccttcagaagaagtagtgaagaaaatgaaaaattattggagacaattattaaacgctaaactaataactcaacgaaaatttgacaatcttacaaaagcggaaagaggcggtctctccgaactagataaagcaggtttcattaaaagacaattggttgaaacgcggcaaataactaaacacgttgcacaaatcttagactcaaggatgaatacaaaatatgacgaaaacgacaaactcattagagaagtaaaagttattacactaaaaagcaagctagtaagcgacttccgaaaagattttcaattttacaaggttagagaaattaataactaccaccacgcacatgacgcatatcttaatgcagtagtcggaaccgcacttataaagaaatacccgaaattagaatccgagttcgtatatggagactataaagtgtatgacgttagaaaaatgctagcaaaatcagaacaagaaattggcaaagcaacggctaaatacttcttttattcaaatataatgaactttttcaaaacagaaataactctagcaaatggagaaatcagaaaacgtccattgatagaaacaaatggagaaacgggagaaatagtatgggataaaggtcgagatttcgcaaccgttagaaaagtgttatcaatgccacaagtaaatatagttaagaaaacagaagtacaaacaggaggcttctctaaagaatcaatactgccaaaaagaaactcggacaaattaatagctcgcaagaaagattgggaccccaagaaatacggaggatttgactcacccaccgtagcttactccgtgctagtagtagcaaaagtagaaaaaggcaaaagtaagaaattaaaaagcgtcaaagaactcctaggaataacaataatggaaagatcctcattcgagaaaaaccccattgatttccttgaagccaaaggatacaaagaagtaagaaaagatttaataatcaaactaccaaaatatagcttattcgaactagaaaatggacgaaaacgcatgctggccagcgcaggggagctccaaaaagggaacgaactagcacttcctagtaaatatgtaaacttcctctaccttgcatctcattatgaaaaactcaaaggtagtccagaagacaacgaacaaaaacaattatttgttgaacagcataagcactatctcgacgagataatagagcaaatatcagagttttcaaaaagagtaatcttagcagacgcgaatttagataaagtcctcagtgcatataataaacacagagacaaaccaattagagaacaggcagaaaacattatccacctctttaccttaacaaacttaggggcgccaactgcattcaaatacttcgatacaacaatcgaccgcaaaaggtataccagcactaaagaagtacttgacgcaacctttatccaccaatcaattacaggactatacgaaacacgaatagatttatcacaattaggcggagactga

SEQ ID NO: 5436 - RNA, 4107 nt, synthetic construct
  misc_feature 1..4107: note = Cas9 variant
  source 1..4107: mol_type = other RNA
atggacaagaaatatagtataggactagacataggaacaaactcagtaggatgggcggttatcacagacgattacaaagtcccttcaaagaaatttaaagtattaggaaatactgatcgacattcaattaagaaaaatttaataggggccctattatttgatagcggagaaactgctgaagccacaaggcttaaaagaactgcacggagaaggtataccagaagaaagaatcgtatttgttatctacaagaaattttctctaacgaaatggcaaaagttgacgattcatttttccatcgattagaagaaagtttccttgtagaagaggataagaaacacgaaagacacccaatcttcggtaatatagtagatgaagttgcttaccacgaaaaatatccaacaatatatcacctaagaaagaaattggtggattctacagataaagctgatctcaggctaatatacctagctttagctcacatgataaaatttaggggtcacttccttattgaaggagacctaaatcctgataattcagatgtagataaactatttatacaattagtgcaaacatacaatcaactatttgaagaaaaccccataaacgcttcaggggtcgatgctaaagcaatactcagcgcacgactaagtaaatcacgaagactagaaaatttaatcgcccaattacccggggaaaagaaaaacggactcttcggaaacttaatcgctctttcactaggacttacaccaaatttcaaatcaaatttcgacctcgcggaagatgctaaactccaactctcaaaagacacatatgatgatgacctcgataatttattggcacaaataggagatcaatacgccgacctctttttagcagctaaaaacctctccgatgcaattctgttaagcgacatacttcgacttaattcagagatcaccaaagcacctttatctgcatccatgattaaacgatatgacgaacaccatcaagatctaacattactgaaagccttagtaagacaacaactaccagaaaaatacaaagaaatatttttcgaccaaagcaaaaatggatacgcagggtacattgatggcggagcgtctcaagaggagttctataaattcatcaaaccaatattagagaaaatggacgggacagaagaacttctcgcaaaattgaacagagaagacttactacggaaacaacgtacattcgataatggaagtataccacaccaaattcatctgggagaattgcacgctatccttcgtagacaggaagacttttatccattcctaaaagataatagggagaaaatagagaaaatattaacattcaggataccttattatgtgggaccattagcacgaggaaactcacggttcgcatggatgacccgtaaaagtgaagaaaccataacaccttggaacttcgaagaagtcgtcgataaaggcgcaagcgcacagagcttcatagaaagaatgacaaattttgacaaaaatctccctaacgaaaaagtattgccaaagcactcattattatacgaatatttcactgtgtataacgaactaacaaaagttaaatacgtaacggaaggaatgagaaaaccagcattcctctcaggcgaacaaaagaaagcgatagtcgatttgcttttcaaaacaaatagaaaagtcacggtaaaacaacttaaagaggattactttaagaaaattgagtgctttgactccgtagaaataagtggtgtcgaagatcgttttaacgcgagtctaggtacataccacgatctcctaaaaataataaaagataaagactttttggataacgaagagaatgaagatatactcgaagatatcgtccttacattaacactgtttgaagaccgggaaatgatcgaagaaagactaaaaacatatgcacatttatttgacgacaaggtaatgaagcaactaaagagaagaagatacacgggatggggaagattaagtaggaaacttataaatgggataagagataaacaatctggaaaaaccatattagactttttaaaatctgatggatttgcgaacaggaacttcatgcaactcatacatgatgattccctcaccttcaaagaagatatccaaaaagcacaagtaagcggtcaaggcgacagcctacatgaacatatagcaaatttagcgggatcaccggccataaagaaaggaatactccaaacagtaaaagtcgttgacgagctagtaaaagttatgggtagacacaaaccagaaaacatagtcatagaaatggcacgagaaaatcagacaacacaaaaaggccagaaaaattctagagaaagaatgaaaagaatcgaagaggggataaaagaattgggatctcaaatacttaaggaacatccagtggaaaatacacaattacaaaacgaaaaattatacttatactatctacagaacggacgagatatgtatgtcgatcaagagctggacataaaccgtctatcagattatgatgttgaccatattgtaccccaaagttttataaaagatgatagcattgataacaaagtattaactaggagcgacaaaaatcgaggaaaatcgaacaacgtaccctccgaagaagtcgtgaagaaaatgaaaaattactggagacaactgctaaacgcaaaactaataacccaaagaaaattcgataacttgacgaaagctgaaagaggtggattatctgaacttgacaaagccggatttataaaaagacaactggttgagaccagacaaataacaaaacacgtcgcacaaattttagactcaaggatgaatactaaatatgacgaaaatgataaattaattagggaagtaaaggttataacactcaaaagtaaactggtcagtgacttcaggaaagatttccaattttacaaagtacgggaaataaataattatcaccatgcccatgacgcttatttgaacgcagtagtaggtactgcattgataaagaaatatcccaaactcgaatcagagttcgtctatggagattacaaagtatacgatgtgagaaaaatgatagcaaaatctgaacaggaaataggcaaagcaacagccaaatactttttctattcaaatattatgaacttcttcaaaacagaaatcacactagccaacggcgaaataagaaaacgaccattgatagaaacgaacggcgaaacaggagagatagtttgggacaaagggcgtgacttcgcaacggtaagaaaggtactttcaatgcctcaagtaaacatcgtaaagaaaacagaagtacaaacgggaggtttcagtaaagaatcaatcctgccaaaaagaaacagtgacaaactaatcgctcgcaagaaagactgggatcccaagaaatatggaggatttgactcaccaacagtggcctatagcgtattggttgtagcaaaagtggaaaaaggcaaaagtaagaaactcaaatctgtaaaagaactactaggaataactataatggaaaggtcttccttcgagaaaaatccgatagatttcctggaagcaaaaggttataaagaagttcgtaaagacttaatagtcaaattaccaaaatatagtctatttgaactagaaaacggaaggaaaagaatgttagcgtcagcaggcgaactccaaaaaggaaacgaattagcactcccgagcaaatatgtaaatttcttatatttagcatcacactatgaaaaacttaaaggcagcccagaggacaacgaacaaaaacaactatttgttgaacaacacaaacactatcttgatgaaataatagaacaaataagcgagttctcaaaacgagtcattttagcagatgctaacttagataaagttttaagtgcatataataaacacagagataaaccgatccgggaacaagcagaaaatataatacatttattcactctaaccaatctaggagcaccagcagcatttaaatattttgacacaactatagatcgtaaaagatatacttcaacaaaagaagtacttgatgcgacttttatacatcaatcaataacaggtctatacgaaacgcgtattgacctttcacaattaggtggggattga

SEQ ID NO: 5437 - RNA, 4107 nt, synthetic construct
  misc_feature 1..4107: note = Cas9 variant
  source 1..4107: mol_type = other RNA
atgtcacggccctataacattgggctagacataggcacctctagtataggatggtctgtggtagacgaccaatccaaattagtatctgtaagaggaaaatatgggtatggagtgcggctatatgatgaaggacaaacagcagcagaacgtcggagtttccgaaccacacgaagacgactcaaaagaagaaaatggagactcggattattacgggaaatattcgaaccatacataacaccaatcgacgacactttctttctaagacaaaaacaatcaaacttatccccaaaagaccagagaaaactttacacgcaaacttccctatttaacgaccgtacagaccgcgccttctatgatgattatccaacaatatatcatcttagatatagattaatgacagaaaaacgacaattcgatattcgagaaatatatttggccatgcaccatattgtcaaatacagaggacattttctaaatgaagctccagtctctagcttcaaatcaagtgagattaatttagtggctcattttgatagattgaacaccatattcgcagacctcttttccgaaagtggcttccagctagaaacagataaattagctgaagtaaaagccttattacttgacaatcaacaaagtgcttctaatagacaaagacaggctttaagtttaatctatactccctcaacgaacaaagctgtagaaaaacagaacaaagcaatagcaactgaactattaaaagctatacttggactaaaagcaaaatttaatgtactaacaggcatagaagcagaagatgtaaaagcctggacactaacattcaatgctgaaaatttcgacgaagaaatggtaaaactcgaaagctcactagacgacaatgcacaccaaattatagaatcccttcaagaactatactctggagttcttctcgccgggatagtgccagaaaaccaaagtctaagccaggctatgataactaaatatgatgaccatcaaaaacacctaaaaatgttgaaagcggtacgagaagctctcgcaccaggcgaccgacaaagactaaaacaggcttacgatcaatacgtagacggacaagaaaatacaaaggcttattcaaaggaagatttttatggagacataacaaaagctctaaagaataatccagatcatcccatcgttagtgagataaagaaattaatagaactagatcaattcatgccaaagcaaagaacaaaagataatggcgcaatcccacatcaactacaccaacaagaactcgatcgaataattgaaaaccagcaacaatactacccatggctagctgagctaaatcctaactcaaaacggcaaacagttgcaaaatacaaactagacgaattagtggcattcagagtaccctactacgtaggccctctaattactgcagaacaacaaagacagagctccgacgccaaatttgcctggctaataagaaaagcagaaggacggataacaccctggaatttcgatgacaaagttgacagacaggcttctgcgaatgaatttattaaacgtatgacgacaacagacacatatctcctcgcagaagacgtattaccaaaacaatcattgatctaccaacgcttcgaagtattaaacgaattaaatggtctgaaaatcgatgatcaacccattactacagaactaaaacaagccatatttacagacctattcatgcaaaagatatcagtcaccgtcaaaaatatccaagattatctagtaagtgaaaaacgatatgcttcccgtcccgcaatcacaggactttcagatgagaataaattcaactcaagactctcaacataccacgacttaaaaatgatagtaggtgacgctgtcgatgacgtagataagcaagcagatttagaaaaatgcatcgaatggtccacaatattcgaagacggaaaaatatacagtgccaaattgaacgaaatagattggctcactgaccaacaaagagtccaattggcggcaaaacgctatcgcggatgggggagattaagcgcaaaacttttaactcaaatagttaatgcaaacggccaaagaatcatggacctattatgggatacaacagacaatttcatgagaatagtccatagcgaggacttcgacaaactcataactgaagcaaatcaaatgatgttagctgaaaacgatgtacaagatgtaatcaatgatctatatactagcccacaaaacaagaaagccctgagacaaatcctattagtagttaacgatattcaaaaagcaatgaaaggtcaagcccccgaacgcatactaatcgagttcgctcgcgaagacgaagttaatagccgattatcagtgcaacggaaaaggcaagttgaacaagtataccaaaacattagtaacgaacttttaaataatacagaaatcagaaacgaactgaaagatctaagtaattcagcattatcaaatacaagattgttcctctattttatgcaagggggtcgcgatatgtacacaggcgactcactgaatattgatagactttcaacatatgacatagaccacatactcccgcaatcatttataaaagacaactcgctagacaacagggtcctagtatctcagaaaatgaaccgttcaaaagcggaccaagtacccacagacttcacatctgtagaactgggacagaaaatgcaaatccaatgggaacaaatgctccgagctggacttataacaaagaagaaatacgataatctcacgcttaatccagatcatatttcaaaatacgcaatgaaaggttttataaaccgccaattggtagaaacaagacaagtaattaaactcgctacgaacctcctaatggaacaatacggagaagacaatatagaattaatcactgtcaaatcaggcttaacacatcagatgagaaccgagttcgatttccccaaaaatagaaatctcaataatcaccaccatgcgttcgatgcatacttaacagcgttcgtaggattatacttactaaaacgatatccaaaactaaaaccatacttcgtatacggagaatatcaaaaagctagtcaacaagataaatggaggaactttaattttctaaatggcttaaagaaagatgaacttgtagatgaaaacacagaagcagtcatatgggacaaagaaagtggcctagcatatctaaataaaatatatcaattcaagaaaatattggtaacacgaggagtccatgaaaattcaggagcactgttcaatcaaactctttacgcagcgaaagatgacaaagcatcggggcaaggaggtaaacagttaatccccgcaaaacaagacagaagtacggctttatatggaggatatagtggaaaaacagtcgcgtacatgtgcatagtaaggatcaaaaataagaaaggagatctctataaagtatgcggtgtagaaacaagctggctagcgcaattaaaacaattaacagatgaggatagccaaaaagcattcttagaacagaaaatatcacctcaatttacgaaagtaaagaaacagaaaggaaatataatagaagcagtcgaagagttcgaagtaatagccccacacatcctaatcaatcaacgtttctttgataatggacaagaattaacattaggaagcgcaacttataaacacaatgaacaagaactaatattagacaaaacagcggtaaaactcctaaatggagcgcttccacttactcaatcggaagaactcgccgagcaagtttacgatgaaatcctagaccaagttatgcattattttccattatacgacacaaaccaattcagagcaaaactaagcactggcaaagctgccttcatgaaattgccgtggaaatcacaatgggacggaaataaaatggtacaagtaggccaacaagttatattagatagaatactaattggactacacgctaacgcagcaatgtcagacttaaaagtgctcaaaatgacaactccattcggaatgattcaacaatcaaccggaattaccttatcagccgatacccaaataatataccaaagtcctactggattattcgagcgaagagttgccctaagagacttatga

SEQ ID NO: 5438 - RNA, 4107 nt, synthetic construct
  misc_feature 1..4107: note = Cas9 variant
  source 1..4107: mol_type = other RNA
atggataagaaatactctatcgggctagacataggaacaaactccgtaggatgggcagttataactgacgattataaagtacccagcaagaaattcaaagtacttggaaatacagacagacactcaattaagaaaaatctaataggagctttgctgttcgactccggcgaaaccgccgaagcaacaagattaaaaagaacagcaagaagaagatacaccagaaggaaaaatcgaatctgctacctacaggaaatattcagtaacgaaatggcaaaagtcgacgattcattcttccatagattagaagaatcattcttagttgaagaagataagaaacacgaacggcatccaatattcggaaatatagtcgacgaagttgcatatcatgagaaatacccaacaatctaccacttaaggaagaaattagtagattctaccgacaaagcagacttacgcttaatatatctcgctctagcacatatgataaaatttagagggcattttctaattgaaggagacttaaacccagacaatagtgacgtagataaactctttatacaattagtacaaacgtataaccaacttttcgaagaaaacccaatcaacgcaagtggtgtagatgccaaagcaatattatcggctcgtttaagtaaatcccgtcgattagaaaatttaatagcacagttacctggtgagaagaaaaacggactttttggaaatttaatcgcactaagcctaggccttacgccaaatttcaaatccaattttgaccttgcagaagatgctaaacttcaattatcaaaagacacgtatgatgacgacttagataatcttttagctcaaataggagaccaatacgctgatctttttctagcagcgaaaaatttatcagacgctattttattatccgacatactacgattaaacagtgaaataaccaaagccccattatcagcatcaatgataaaaagatatgacgaacaccaccaagatttaacactgttaaaagcactggttagacaacaattacctgaaaaatacaaagaaatattcttcgaccaatccaaaaatggatacgcaggatacatagatggtggagcctcccaagaagaattttacaaattcatcaaaccaattctcgagaaaatggacggaacagaagaattacttgctaaattaaacagagaagatttattacgaaaacagcgtacatttgacaatggaagtataccacaccagatacacctcggagaacttcatgcaatcctaagaagacaagaggatttttatcccttcctgaaagacaatagagagaaaatagagaaaatacttactttccgcataccatactatgtaggaccactagcccgcggaaattccagattcgcgtggatgacaagaaaaagtgaagaaaccattacaccttggaattttgaagaagtagtagacaaaggcgcatcagcacaatcgttcattgaaagaatgacaaatttcgataaaaatctaccaaatgaaaaagtacttccaaaacacagcttactctatgaatacttcactgtctataacgaactaacgaaagtaaaatacgttacagaagggatgagaaaaccagccttcttatcgggagaacagaagaaagcaatcgtagatcttttgttcaaaaccaatagaaaagtcacagtgaaacaattaaaagaagactacttcaagaaaatcgaatgcttcgattcagtagagatttcaggtgttgaggacaggtttaacgccagtctagggacgtatcacgatttacttaaaataataaaagacaaagacttcctagacaatgaagaaaatgaagacattcttgaagatatcgtactaaccttaacactgtttgaagatagagaaatgatagaggaaagactaaaaacttatgcacacctcttcgacgacaaagtaatgaaacaactaaaaagaagacgatatactgggtggggcagactatccagaaaactcataaatggaatcagggacaaacaatccggaaaaactatactggatttcctcaaatcggatggattcgcaaatagaaatttcatgcaattaatacatgatgatagtctaacttttaaagaagacatacaaaaagcacaagtaagtggacaaggcgattcattacacgaacacatagcaaacctggctggcagcccagcgatcaagaaaggcatacttcaaaccgtaaaagtagtagacgaattggtaaaagtaatgggacgtcataaaccagaaaatatcgtaatagaaatggcaagagaaaatcaaacaacccaaaaaggacagaaaaacagccgcgaaagaatgaaaagaatagaagaaggtattaaagaattaggtagccaaatcttaaaagaacacccggtcgaaaatacccagttacaaaacgaaaaactgtacttatactatctgcagaacggccgagacatgtatgtagaccaagaactagacataaacagattatctgactatgatgtagaccatatagtgccacaatccttcatcaaagacgattcaatcgacaataaagtccttaccagatccgataaaaatagaggtaaatctgataacgtgccatcagaagaagtagtcaagaaaatgaaaaattattggagacaattgctaaacgcgaagctaataacacaaagaaaatttgacaatctaacaaaagcagagcgtggtggattatctgaattagacaaagctggatttataaaaagacagttagtagaaacccgacaaataacaaaacacgtagctcaaatattagactccaggatgaatacaaaatacgatgaaaacgataagctaattagagaagtcaaagtaataacacttaaatccaaactggtttcggacttcagaaaagacttccaattttacaaggttagagaaataaacaattaccaccatgcccatgatgcatacctcaacgctgtcgtgggaacagctttaatcaagaaataccccaagctagaatcagagttcgtatatggagactacaaagtatatgacgtcagaaagatgatagcaaagtccgaacaagaaattggtaaagcaacagctaaatatttcttctatagcaacataatgaatttcttcaagacagaaataacactagcaaatggggaaataagaaagcgaccacttattgaaacaaatggggaaacgggagaaattgtatgggataaaggacgagattttgcaacggtgcgcaaagtcttatcaatgcctcaagtaaacattgtcaagaaaactgaagtacaaacaggagggtttagcaaagaaagcatcctccctaaaagaaactctgacaaattaatagcaaggaagaaagactgggatcctaagaaatatggcggctttgactcaccaacagtcgcatatagtgtcctagtagtagcaaaagtagaaaaaggaaaaagcaagaaacttaaatcagtcaaagaactccttggcctaacaataatggaaagatcatcatttgagaaaaatcctatagatttcctggaggcgaaaggatataaagaagtaaagaaagacctcataataaaactacctaaatatagcctctttgaactagaaaacggcagaaaaagaatgttagcttcagccggagaattacaaaaaggaaatgaattagcactaccctccaaatacgttaacttcttatatttagcatcacattacgaaaaactaaaagggagtcccgaagataacgaacaaaaacagctatttgtcgaacaacataaacactacctagatgagataatagaacaaatatcagaattttctaaaagagtaatattagccgacgctaacttagataaagtactatcagcatataacaaacacagagacaaaccaataagggaacaagcagaaaatattatccaccttttcacactaacaaatctgggagcccccgcagcctttaaatactttgatacaacaatagacagaaaaagatataccagtaccaaagaagtcttagacgctacattaatccatcaatcaattaccggcttatacgaaacaagaatagacctcagccaactaggaggcgactga

SEQ ID NO: 5439 - RNA, 4110 nt, synthetic construct
  misc_feature 1..4110: note = Cas9 variant
  source 1..4110: mol_type = other RNA
atgaaacgtatactggggctagatttaggtaccaactcaattggttgggctctagtaaatgaagcagaaactgtaaacgagaaaagctcaatagtaaaacttggggttagagtaaatcctcttacagttgacgaacagaaaaattttgaagcaggtaaatccataccgacaaatgcaggaaggacattaaaacgaggtatgaggagaaacctacaacgttacaaacttagaagagattacctaatacaatgtttaaaggaatatggatggattaccagtgatactcttctttatgaatgtggaaatcgaactacctttgaaacatacagactacgagccaaagcggtagatgaagaaatagcacttgaagaacttggcagagtcttactaatgataaacaagaaacgcggctacaaaagcaaccgaaaagcaaaatcaagcgatgagggacaattaatagacggaatggcaatagcaatggatatgtatcacaatggcacaactccaggcgagtatgtttattccttactatcaaaaggaaagaaatacataccagtattctatagatcagatctccttgacgagttcgaccgaatctgggactatcaatgtgcatactacccagacatcctcacaagtcagttcaaagaactgatacgtggaaaaagttcacaagtcactagcaaacttttcaaacaacaatataatctatttactgcagacaacaaagaaaaagataaaagactacaggcttattgtagacgagctgatgcattaaagaaaagactgccagtcgaagaggttgcagccgcactgtgcgacgtaaacagagatgtcaatgcaagtagtggatatctcggaacaataagtgacagatcaaagaaattatttttcaataaacaaacagtcgggcaatacttaatgctagaattagataaagattcacatttcagcgtgaaaaacgaagtattttacaggcaagactatctcaatgagtttgaagccatatgggaaaaacaagctgaataccatcctgaactcacaccggatcgaaagaaaatcttacgggatgtagtaattttctatcaacgacccttaaaatcccaaaaagacttggtagcatgttgtgaactagaacgaagacggatagaagtcatgaaagacgggaaagtaagatccgtagagataggtccaaaagtatgccccaaatctagtccactatttcaagatttcaaaatttggcacgtattaaataatctaaaagtacgtgataaagcgacaggagacgaaagattcctagaattagatgaaaaagaaatactattcagtgaacttgccataaaatcaaaactctcaaaaacggaggctttgaaattactatatcaaaaaccaaaaggactcgatctcaattacgattcagttgaaggcaataccacgcaagcagcactatttgaagcataccaaacagtaattgcaatgacaggacatggagaatatgtgtttagcaaaatgtccgcgagtgaagtaatgagcgtcgtggaaggagtattcggaggattaggtttcaacacttctgtattacgattcgattctcttttacagggaaaagaactagaaaaacaagatagctatcgcctctggcatctgttatattcatatgaaggagataattcggtaactggaaccgacggcctagtcgcaaaagtagcatctctattaagatgcgacgaagaatatgcaaaagtggttgcaggagttactttccaaccagactatggaagcctatcagcaaaagcaattcgacgaatactgccacacatgcgagctggaaacgaatactccttagcatgtgaatatgcggggtacaaacatagtcgaagatcgctaacaaaagaagaattagaacaaaaagactataaagaccatctagaactccttccaagaaatagtcttagaaatcccgtagtggagaaaatacttaatcaaatggtaaatgttgtgaatgcagtagttgatgcctacggaaagcctgatgaaatacgaatcgagatggctagagaattaaagaaaagtgcaaaagaaagagaagaaatgacagcagccataaacaaagcaacttcagaacatgaaagaattaaagaaatattaaacaaagaatttggcatacaacacgtatcacataacgacatagttcgatataaactttattgtgaactaaagaataacggatataaaacgttatactctgatacatacataccgcaagaaaaattattctccaaagaagtagatatcgaacacatattgccgcaagcgaggctatttgacgactcattcagtaataaaacattagaatatcgatctgtcaacattgaaaagtcaaatcaaacagcttgggattatgtagccgctaaatggggtgaagaaggttcactaagatataaaaagagggtagacgatttactggcagcaggagtcataggaaaatcaaaacatgataaattactcatgaaacaggaagatattcccaccgatttcatcaatagggacttgcgggatacacaatatattgctagaaaagcgagagaaatactagaagacctagtaccaatggtagtaagcacaacaggagcagtaacagaccgcctaagagaagattggcaattagtagatgtgatgcaggagttaaattgggacaaatatgcaatgaaaggcttaacagaagaatggactgataaggacggccgcagaattagtaggataaaagagtggacgaaaagaaacgatcaccgacaccacgctatggatgctttaaccatcgcctttaccaaacattcattcattcaatatcttaataatctaaacgcaaggtccgataagtccggttcaatctatgctatcgaacaaaaagaactctaccgtgataaccacggcaaattaaggtttataatgccatttgaaggattcaggtcagaagcaaaaagacaactagaaaacatactggtatccataaaagcgaagaataaagtcgtcacacgaaatgttaataatgcaagaagaggatcaggaaggcaagcaaaagtccaactcacaccgagaggacaactacataacgaaaccatatatggcagcatacacagatatgttacaaaattagaaaaagttggaggaaactttgacggagaacaaatagcaaaagtggccaacctaaggtatcgcgaggccctacaagctcgacatgaagcatttggcggcgatgcaaagaaagcatttacaggaaagaacgcattagacaaaaaccctttatatctcaaagacacaagaaccgaagtaccattaaaagtaaagaccgtctcgactgaaaccctgtatactatcagaaaagcagtggcaccagatctcaacgtagataaagtaatagacgcaaaagtaagaaaagtactagaagaaagattacaagaatatggaggagacccaaagaaggcttttgtaaacttagatgaaaatcctatctacttgaacaaagcaaaaggtataactataaaaagagtagcaataactggagtaaataatgcaatagcactacatgataagaaagatgttggaggacatgtgatgttagacgcttcaggtcgcaaacaaccagtagactttgttaatactgggaacaaccatcatgtggcaatatacagagacgcggaaggtagtctacaagaagtagtagttagcttttatgaggcagtagcaagagtatcattaggtctaccggtaatcgacagagaataccgtaaagaagacggatggcaattcttatttacaatgaaacaaaacgagtacttcgtgtttccaaatccagaaactggattcaaccctcaagaagtagacctgacggatgaaacaaactacgctctcatatcgcccaatctttttagagtacaaaaattcacaataaaagattatttctttagacatcatcttgagacgacagtcgaagataggaaagaattaaaagatatgacatggaaaagatgtggcttaggaggaattatcggaatagtaaaagtgagggtaaatcatataggcagaatcgttagtgttggagaatattga

SEQ ID NO: 5440 - RNA, 4110 nt, synthetic construct
  misc_feature 1..4110: note = Cas9 variant
  source 1..4110: mol_type = other RNA
atggctaaaacatacaatattggccttgatatcggaacaaatagcatagggtgggccgtcgtagatgatcaaaaccacctaatgagcataaaaggaaaatatggctatggagtaaggttatacgacgaaggtaaaacggctgaagaaagacgcagcttcaggacaacacggagaagactaaaacgacgaaagtggagattgtctctattgcgcgaaatattcgaaccacaaattacaccactggataacactttcttccttagacaaaaacaatcatcattatcctctaaagataacagaaaattatatcccgagatgtcattatttaatgataggacagatacagatttttatacacagtacccaacaatttaccaccttagtagagacctcatgactaaaaacaaacaatttgacattagagagatctacctcgctatgtatcacatagtcaaataccgaggccactttttaaatgaaagtcccgtatcctcatttaaaagttcagaaatcaaactagcggaaaatttcgagacccttaaccaaatattcaacgaaaggttcaacgaaagcatgttccaactagcagtcaacgactttgacgatctgaaagcacttctcctgaacgatcaacaatccgcttcgaatcgccagaaaaaggcactaggtatgatatatgttccaaatgaaaacaagagcttagaaaaacaaaataaagctatagcaacagaactcctaaaagctatattaggcctcaaagcaaaattcaatgttcttaccggaatagaagtcgacgacgcaaaaccatggacactatcattcaattctgaatcatttgacgaggatattgataaagctgcaacaaacatcgacgacgacagtagagagataattgccatacttcagggactatactccggtattctactagcaggcataataccagaaaaccaatctctatcagaggcgatggtcgaaaaatatgaccaacatgcagcacatttgaaacaattgaaatctatataccccctgttaagcatctctgacaaaaaggccatacaacaagcatataattattacatcgacggccaagataacgcaaaagcatacagccgagaagatttctatgctgcaacaacaaaagctctaaaaagctaccaagacaatgaaacaatcgccgaaatactaaaacttatagaattagaacaattcatgccaaaacaaagaacgaaagataacggtgccataccgcatcaattacatcagcaagaactagaaagaataatagagaatcaacaaaaatactacccctggcttgcagaactcaatcccaatgaatcaagaagaaaaatagcgaaatataaattagatgaactcgtagctttcagagtcccatactatgtcggaccactaataacctctgaacaacaacaacaatctagcaataaaaagttcgcctggatgatccgaaaagcagagggaaaaattacaccttggaacttcgacgaaaaagtggatcgacaagcgtccgctaatgagttcatcaaacgcatgacaactacagacacttatctattagctgaagatgtattaccaaaacaatctttagtataccagagatttgaagtgttaaatgaactcaatggaataaaaatagacgacgtccccataacagtagaacaaaaacaacgtatatttaacgacctatttatgatgcaagcaagtgtaagtgtgaaaaacattcaagactacctagtaagcaaaggctactttgcatccagaccagaaataacaggattatcggatgaaaataaagtaattagtagattatccacttatcatgatttaaaagctatacttggtggaatagtagatgaagccaacaaacaggcagatctagagaaatgtgttgaatggtcaacaatattcgaagatggcaaaatattcgttgaaaagctaaacgaaatagaatggttaactgacgagcagcgaaaaagattatcatcaaaaagataccgaggatggggacgattaagtaataaacttctaaatcaaatagtaaatgagaacggacaacgtataatggatttattatgggacactacagacaatttcatgagaatagtacatagtgaagagttcgacaaattaatatccgcagcaaaccaaacattattaagcaaaaacgatgtgcaggacgtaataaatgatttgtacacatccccacaaaacaagaaagcattaagacaaatattgttagtagtgagtgacatccaaaaagcaatgaaaaaccaagctccgtcgaaaatcctaatagaatttgcaagagaagatgaagctaatccacgtctatcagtccaaagaaaaagacaagttgaacaagtatatcaaaatatctcaaaagatatattaagcgactcagacgtaaaagccgaacttaaagacctaacaaacacagcgctagctaacactagattatttctttactttatgcaaggaggccacgacatgtatactggtgaaacccttaacatagatagattatccgaatatgatattgatcatatattacctcaagccttcataaaggataactcactagataaccgtgtgttagttagtgccaaaatgaaccgatcaaaaagtgatcaggtaccattaaacgactataccgaagaacgattcggaagcaaaatgcgagttcagtgggaacaaatgctacgcgcaggactaatcaccaaaagaaaatatgataacttaacattaaaccctgacagaataagtaaatacgctatgaaagggttcataaacagacaattagtagaaacacgacaagtaatcaaactcgtcacaaatttactaatggatcactatgaagacgatgaggtgcaactaataactgtaaaaagtggactaatacatcaaatgagagaaatgttcgacttccctaaaaacaggaacctaaataaccatcaccatgcattcgatgcttacctaactgcatttgtaggaatttatctgttaaagagatacccaaaattaactcccttctttgtttatgggtcatatcagaaaaacaatacaaatgacaaatggagaaactttaatttcttgaatgacctaaagaaagaagaagtaatagacagcgattctcatgaagtcatttggaataaagcacaaggtctagtagaattagacaaaatatatcaattcaagaaaatattagtaacaagagaagtacacgaaaataccggagcgctttataaccaaacactatattcagccaaagacgataaagcatccggacaaggaggaaaacaacttataccggctaaacaagacagacccacagctctatacggaggatattccggtaagacagttgcatatatgtgcatagtaagaattaaatctaagaaagaagacacttataaagtatgtggagtaaaaacctcatgggtcgccgaactagaacgattgtcagactcaaacgagcaattagcatcattaaaagctaaacttatgcctaaattcacaaagaacaagaagcaaaaaggaaaaacaattcaagttaccgaagacttcgagataatagtaccaagagttctaataaaccaacgcttttatgataacggtcaagaaataacactaggtagtgcgacctacaaacacaatgaacaagagttaatgctcaacaagaaagcagtaaaattattaaatggccaattaagtttagtagaagcagaaacactcgctccacaagtatacgatgaaattttgaaacaagtaatgaaatatttccctctttacgatacaaaccaattcagaacaaaactaaaaatgggaaaagaacaattcataaaattaccatggaagaataaatgggatggcaataaattaattcatgttggacaacaaacagtactagatagaatactaattggattacacgccaatgccgcagtatcagatcttagtacgttgaaagttacgacaccattcggcaaattacaacaaccatcaggtattgctctttcccttaatactaaaatcatttaccaatcaccaacgggcctatttgaaagaagagtagcgctgcgaggactctga

SEQ ID NO: 5441 - RNA, 4110 nt, synthetic construct
  misc_feature 1..4110: note = Cas9 variant
  source 1..4110: mol_type = other RNA
atggataaaccctataacattggactcgacataggaagccattccattggatggaccgtcgtcgatgataactccaagctagtaagaattaaaggaaaactcggttacggcgtcagactttttgacgaaggtaaaacagcagaagaacgaagacaatttagaaccacccgaagacgtctgaaacgccgcaaatggcggctacgtttactacgagaaatattcgaaccacatatcgcacccttagacgaaacattctttcttcgccaaaaacaatccaatctagtgccaactcaaaagaaattaccacaactttcattattcaatgacagatcagatgcagagttctaccacaaatatcctaccatctatcatctaagaaatgcgctgatgacagaaaaacgacaattcgacctcagagaaatctacttagctattcatcacatcgtaaaatatcgaggacacttcttgaatgcagcacccgctgcatcattcaaatccggaaaattcgatctcgaaaacaagtttgaccaactcaacctattgttcgcaagcgcatacagcgatttagactttacattacgaaccgataacgtagatcaggtaaaagcaatactcttaaacgaagatctgagtgctagcacccgacagcgacaagcgttacccttaatttatcaaacctccgcagaccagaaagctgctaagaaactaacaaaatcactagctactgaattattaaaagctatattaggccttaaagccaaattcgacgttctaacagggatcgaaaccgacgataccaaagcctggagactcacattcaatgcagaagatttcgatgacaagttaaacgaattaaatgtaaccgacaacgaagccgcgacacaaataatagaaattttacgagagctatattctagcatcttattggcagctatagtgcccgaaaattatacactatcacaagctatgatggctaaatacaacgcacataagcaacatttatcactcctaaggcaagtcaaaacaaccctaccagcaaagaaacaaaaagaactccaagccgcgtacgacgactacattgaccaacacctaccattagataaattttacgcaaaactcacgaaagtgctacccaaagaaaaagacaccgacaatcctcaaataatacaaatcctcaacctaatagatctcgatcaatttttaccaaaacaacgaaccaaagataatggagcgatcccacatcagctccaccaacaagaactcgatcaaatcatagacaaccaaaaagcatattatccctggttagctcaattaaatccaaacgagaaaagacagaaaatagcaaaatacaaattagatgaattagtagcatttcgagtaccgtactacgtaggacctctaatagaagcaaaaactcaacagaaaacctcaggtgcaaactttgcatggatgattaggaaagaaccaggaacaaccactccaataacaccatggaatttcgacgaaaaagtaaaccggcaagcctcagcaaatgaatttataaaaagaatgactacaaccgacacatacttgttaggtgaagatgtactaccgaaacacagtcttttataccaaaggtttgaagtactaaatgaactgaacggtatcaaaattgatcaaaaacgagttaccgttagacaaaaacaagccatatttaacgatctctttctaaagcaacctaatgtaacagtcaagaaattacaacaatacttacaagcaaaaggagaatatgcgtcagcccctataataacaggattatctgatccaaagaaatttaactctcaattaagtacatatcacgaatacaagaaaatattcggaggcctcatagacgacccagataaacaagcagacttcgaaaaatgcatagaatggagtaccatcttcgaagactcacaaatactgaaagacaaattaaaagagattaactggttaacacccgaacagcgacacaaagttgccaacaaacgttaccagggctggggtagactttctaagaaactactcacccaacttgttgattacaacggacaaagaataatagacattctttggaatacaacagataattttatgcaaatagtgcattcagaagcatttgacaaagcaattataaaagaaaaccaggctttactaacacaatataacccacaagcagtcattgacgatttatacacctccccacaaaacaagaaagccttgagacaaatattactggtcgtaaacgacatccaaaaagcactaaaaggacaagccccaagccgaatcttaatagagttcgccagggaaggccaagaaaatccacggctcagtactcaaagaaaacaacaagtagaaaatgcttataaagaagcgagcgacgcactattatccagtgccgaggtgcgacaagaattaaaaggtctcgacaataaagcactagcaaatacacgattattcctatacttcatgcagggaggcagggatatctatactgggaaatcattgaatatcgatgacttatcaaaatatgacatagaccatatattaccccaggctttcattaaagataactctctagataacagagtactcgtatcggctaaaatgaatagaagcaaatccgaccaagtcccattaaacgattttgccgagataagatatggaaaacaaatgagacaacaatgggagaaaatgctaagagcagggcttataaccaggaagaaataccacaatctaacattaaatccggaaagcattaataaatacacagccaaaggattcatcaacagacaactcgtcgaaacaagacaagtaaccaaactagcaacaaatctcctagttgaccaatatgctgaagatgacgtacaactgataaccgtaaaatcaaaccttacacaccaaatgagagaagaatttgattttcccaaaaaccgaaacgtcaacaaccaccaccatgccttcgacgcctacctcacagccttcgtgggattatatttattaaaaagatatcctaaactagcaccctatttcgtatacggagattaccaaaaaggagcatcacaaaattccaaatggcgtaactttaatttccttggtaacctccaccgtgagaaagttgtggacaaaaacactggagaaataatatggcaacgagacgcaggattaggagaactaaacagaatatacaattttaagaaaatactggttactagagcactcagagtcaatagaggcccaatgttcaaacaaacaatatataaagccgaagaagataagtcaagtggtcgtggatcaaaacaactcatacctacaaagaaaaatagacctacagaactatatggaggttataccaacaaagaaacagcatatttatgtcttgtaaaagaacctcataagaaaggagatatatatagaatttgctcagttcttaacatgtggctaacagaattagacagaatcgcagacccaattgcaaaagcacaaaaactaacagagctcttaactccccaatttaccacaactaaaaagaaacaaggacagaaaatccccgtcgtcaaaccttttaaagtcgtcattcccaaaatactaatcaatcaacgattcttcagcagaggccaagaactaaccgtagcgtcaccaatgtatatgcataacgaacaagaactcttcttaaacaagaaaaccataaaattactaaacggacaattagcgaaaaacgaagcccatgaattagcacctaaaatataccaacaaatcttagaccaagtaaacgactactttcctctttacgacatgtataaattcagagacactttaaacgcaagtaaagaaatctttgttaacttaccatggcaggatcaacgccaagacaagaaaattagccaatcaggccaaaaatccatcctaaataaaatacttataggcctccacgcaaatgcagcccgaataaaattaacagaattaaacttcaaatcggattttggtttattatcccaacgtagcggcatagcttttagcccagacgaccaaatcatatatcaatcccccactggactattcgaacggcgagttacattaaaagacctctga

SEQ ID NO: 5442 - RNA, 4110 nt, synthetic construct
  misc_feature 1..4110: note = Cas9 variant
  source 1..4110: mol_type = other RNA
atgaaagtaaacaattaccacatcggacttgatatcggaacatccagtattggttgggtggctatgggtgaagatggtaagccactacgtgtaaaaggaaagactgccataggcgctagattatttcgagaaggaaacccagctgcggacagaaggatgtttaggacaacgcgacgcagactaaacaggagaaaatggagactcaaattattggacgaaatattcgacccatacataaccccagtagatagtacattttttgctagattaaaacaatccaactggtcaccaaaagatagcagaaaagcattcaaagactcaacactttttcccgacctaacagataaacaatatcacttagactaccccacaatctatcatcttcgacacgctttaatgacacaggacaagcaatttgacataaggatggtttacctcgcactacatcacatagttaagtacagagggaacttcttaaattcaacaccggttgactctttcaaggcatcaaaagtaaattttgatgaccaattcaaaaaacttaatgaactatacaccgcaataaatccagaagaatccttccaaataaactttgcaaactcagaaaagataggacaacaatttctagatccgtcaatacgaaaatttgacaaaaaaaaacaaatctctaaaatagtacctgttaccatggatgacaaagctgtagataaactcaatggaaaaatagcttcagaaatagtaaacgcaatactgggatataaatcaaaactagatgttgccgtccagtgcgatccagaggattcaaagccatgggctgtaaaatttgatgatgaagacatagatgcgaaattgcaaaaaatattaccggaaatggatgaaaaccaacaatcaattatcggcataatacaagacttatatagtcaggtcacattaaatcaaatagtaccgaacggaatgagcttatcagaatcaatgataaaaaaatataacgaccaccatgaccacctaaaactttataaaaaattaatcggccaaatttctgacagtaaaaaaaaaacagctttaaaaaaagcatacgatcaatacgtcggtaatgacgggaaagtaatagaacaggatgatttctattcaagcgtaaaaaagaatctagatgacagcgaactatcaaaacagattatggacctaatagatgccgataaatttatgccaaaacaacgaacatcacaaaatggggtaattccacatcaactacaccagcgggaattagatgaaataatagaacaccaatctaaatactatccatggctagcagagtccaatccaaataaacatgatcttcacctcgccaaatataaaatagaagaactagtagcatttagaataccatactatgtcggtcctatgataaccccagaagaccaaaaaaaaagtggagcagctgtgttttcttggatgaagagaaaagaaccgggtcaaattaccccttggaatttcgaccaaaaagttgatcgtatggaatctgcaaataaattcattaaaagaatgacaacaaaagacacatatctaataggagaagacgtactaccagatgaaagccttctgtacgaaaaattcaaagtcttaaatgaactaaacatggttcgagtaaacggtgattcacttaaagtagcagataaacaagccatatatcaagaccttttcgaaaattataaacacatcagcgttaaaaaaatgcaaaactatattaaagataaaacaggcttaccaaataacccagatatctccggcttatccgaccccgatcattttaataactcactaggaacttataacgacttcaaaaaacttttcggcgataaagttgatgacccggatctacaagatgactttgagaaaatcgttgaatggtctaccgtatttgaagacaaaaaaattttaagagccaaactaaatgaaataagttggttaagcgacaaacaaaaagatgatctagaatcatcaagatatcaacgctggggaagattgtctaaaaaattacttaccggaatagtgaatgaccaaggcgaacgaataatcgatgaattatggaatacaaacaaaaattttatgcaaatacaatcagatgacgacttcgccaaaagaattcatgaagctaatgcggaccaaatgaaagcaacagatgtggaagacgtactagctgacgcctatacatcaccacaaaataaaaaagctataagacaagttgtaaaagtggtagatgatatacaacgtgccatgggaggcgtagcaccaaaatttatctcaatagagttcactagatcggaagatcggaatccaagacgaaccatctcaagagaaaggcaactggaagatacactaaaagatacagcaaaaacactagtaaaatcaatgaaccccgatattctaagtgaactagataacgcatcaaaaagcaagaaaggactaacagataggctctacttatactttacccaacttggacgagatatgtataccggaaaaccaattaacattgatgaaatctctaactatgatatagatcatatattaccacaagcatttataaaagatgactctcttagtaatagagttttagtatccaaagcagtcaataatggtaagtcagccaacgtgcctttaaaactcttcggtgtaaaaatggcacacttctggaaacaactggcagaagccggtctgatcaacaagagaaaactaaaaaatctccaaaccaaccccgatacaatatcaaaattcgctatgcatgggtttataagaagacaactagtagaaacttcacaagtgataaaattagtagctaacattttaggagataaatatcgcaatgacgacaccaaaattatagaaattacagcaagaatgaaccaccagatgagagatgagtttgcatttataaaaaatagagaaataaatgattaccatcacgcattcgatgcatacctcactgcctttctaggtcgatacctataccatagatacataaaactaagaccctacttcgtatacggcgatttcaaaaaatttcgagaagacaaagtaacaatgcgaaattttaactttttacatgatttaacagatgacacacaggcaagaatagcagacaccgaaactggagaagtaatctgggaccgagaaacctcaataaaacaactaagagacgtatatcattacaaattcatgctaatatcccaggaagtgtacaccttgcgaggagctatgttcaaccaaacaatataccctgcagacgaagctggcagaaaaaagttaataccaacaaaagcagataaagcggtagatgtatacggagggtacagtggatcaaacgatgcatacatggctatagtacgcatacatgataaaaaaggggacaaatacaaggtagtcggtgtcccaatgcgtgcattagacaggcttaatgcagccaaaaacgtatccgatgcaaagtatgatcaagttttgaaggatgtgctaacaccgcagttcacaaaaagtaaaaagagcagaaagacaggcgaaatcagccaaacggtagaggactttgaagtggtccttggtaaagtcatgtaccgacaactagtaatagacggcgacaaaaaattcatgttaggatctagcacataccaatacaatgccaaacaattagtattatcagatgaatcagtcaaaacattggcatcaaaagggaaactcgacgaagctcaagagtcagcagcatacgataatgtatatgacgaaatattagataaagtcgaccgatacttcgcgttgtacgaccaaagaaattacagaacaaacttacatgaaggcgaacaaaaattcataggactaccgttacatgacaccttcgatggcagtaaaaaagtagcaaacggtaaaagagaaacaatcagcgatatcctgaatggactacatgctaacgccaccatgacaaatctaaaagtgctcggcatcagctcaccatttggaatgtttcagtcacacggtccaataaatctaaatcctgaaacgatcatattatgtcaaagcccaaccggactgtttgagagacgaataatacttcgagacctatga

SEQ ID NO: 5443 - RNA, 4113 nt, synthetic construct
  misc_feature 1..4113: note = Cas9 variant
  source 1..4113: mol_type = other RNA
atgaaaaaaagaaattacaacataggcctagacatcgggaccagctctataggatggactatcgtggatgataacgcacaaatcatgagagcaaaaggtaaaaatggttacggagtaagaatattcgcagaaggaaaaacagccgccgaccgtcgaggatttagaacaacaagaagacgactcaaacgtaggaaatggaggctcagactattgcaagagtttttcgaaccttatatattacccatagacgaaaatttctttatgcgccaaaaagagtcaaaccttgtgccccaagatccaaacaaacattttaaaggatccatcctttttaatgaccgaacagatcaagaattccacgaacagtacccgacaatatatcatctcagatacgcactcatgacagaacaccgtcaattcgacgttcgagaaatatactgggcaattcatcacatagttaaataccgaggccactttttaaactcaacacttgcaagtaaatttaaaggaggggaattacgattagcggataaatttgaatcgctaaataaacttttcctgagagttcaggcagaaacaggctttgaattaagcgaagataacgtagacaaaataaaaacggtattactagacaacggaaaatcaaggctagaccgacagagagaagtcctcaaaattgtatatttgacaagtgaagataaagatacagaaaaaaaacgcaaagccgtcgcgactgaattcataaaagcagtcctaggactaaagaccaaactattcatagtcctagcaaaaaatccaacagcagaaacagattggaaattcagctttgacgcagaagacattgatgacaaactagatagtatatcggaacaattaacagacgacgaccacgaaatcgtagaactgatatctgaaatacattccataattactcttacaggtgtagtacccgagggtatgggactttctgagtctatgatagctaaatatgaccaacatcaattagatttaaaaaaacttaaaagtctaatgagagatctagacgtgaaacaagcaagaaaactacaagacgcctatgacgaatatatagatggcctaaaaccatctgaagaagcattttattctgccgtatcaagtgtaattcaaaaaatggatgaccctagagcaaaaaaaataacagcagaaatagaactggaagagttcatgccgaaacaaagaaccaaagctaatggacagataccacaccagctacaccaacaagaacttgatcaaatcatagagaaccagaaagaatattacccttggttagcagaagaaaatcctaacaaaagagaacataatgcagcaccacacaagctcgacggtctagtcacatttagagtgccatattatgtcggccccttaatcgaagcaagtgtacaacaaaaaaccagcaatagcaattttgcctggatggaacgtaaagtaaaaaatgacacctcccgaatcaccccgtggaattttgaagagaaagtagatcgaaatgcgagcgcagaaaacttcataaaacgaatgactaccaaagacacctatctcttgaacgaagatgtattacctcaacaatctctattataccaacgatacgaggtccttaatgagctaaataacgtaagggtaaacgacaagaagttagaaaacaattgcaaacaagacgtatacaaagacctatttaaaaacaatacaacagtatccatcaaaaaatttaaagactacctcgtcgccaactgcgaatatgccgataacccaaaaatagaaggtttagcagacgaatccatattcctaagttccctatctaccgaaaataaatttaaagacatcttcggtgcacagatcgatgacccaaactactttgaagactttgagcatattatcgaatgggcaaccatattcgaagataacaagattctaagggccaaactagacgaaatcagttggctgaatgaaagtcagaaaaaagaacttgcaaagttacggatgagaggatggggtagattatcacgcaaactcattgctgaaataacagatgaaaatggcagtcgtattatagaccttttatgggaacatatggacaactttatggtagttgttaaccaagacgttttcaaagaaaaaatcgtagcagaaaacaaacaagtttttaaggaattaaatccactagatataataaacgagcaattcacatcaccacagaacaaaaaagctcttagacaaattctcttggttgtagctgatattcaaaaagcaatgaatggagtaacaccaagcaacatattcattgaatttgctcgagaagatgaaagaaacccaaggcgttccatacaacgactaaggcaggttgagaatatgtacagagatatctcagacacagtcctagcggatccggaagtccgaaacgaattaagcaacatcaaaaatacagaacttgctagagacagagtcttcttgtattttctccaaggaggcagagacgtatatactggcgaacctttaaacatagataagctctccgaatatgatatcgaccacatcttaccacaagcgttcattaaagataactctctcgacaacagagttcttgtaagtgcatcgcttaataggtctaaaagtgatagtgtaccgttggatgactttacatcagaaatgtttggtagaaaaatggaaccactctgggaacaaatgcaaagggcaggacttatctccaaaaaaaagctcgcaaatttaaaatttaaccccgaaaacataaacaaatatactagaaacggatttataaacagacaattagtagaaacccgacaagtaataaaactagccgcgaatattttaaaagatcactatggagaagaaaccgaaatcgttaacgttaaggcaggactgacacatcaatttcgcaaagattttgactttcctaaaaacagaaacgttaacaactatcatcatgcatttgatgcttacctaacggccctcgtaggaacttacctgcttaaaaaatacccaaaattagaatcatattttgtatatggtaaatttaaaaaaggagacggcatcactaatctcaaaaactttaatttcctccacggatttaacaaaccaggcaaaattatcaataaagaaacgggcgaaatattattcgacagagacaaacaactcggatacatgaattcaatatatgacctaagaaaagtaatcgtaacccacgaattaagcactagacatggcgcaatgtatgatcaaacactatataaagcgtcagatgacaaagacagcggtagaggcggaaaacaactcattagaaaaaaagataacctaccaacagaaatttatggaggctatacaggttcaacggacgcttttatgagtataatacgcatgaaaaaaaaagataaattatactataaagttataggcgtacccacccgagtagcacacgaagtgttacaatcagatggtaaaattaacatatttacactgaacaaatttatcgaacaaaaattaacaaaagaaaaagtgaacaaaaaaacaggagcaattacaagaataacagattggttcgaattggtgatagcaaaagttatgtacggtcaagttatagacgacggcggccaaccgtttatgttaggcagcagtacattaccgtacaacgtaagagaactatacttagcgaaagatttagtaaaagttataaataaaggatctacatctaagtcctcatatttagatgtatatgatgagctagtaaaatcattgaataaatatttcccaatgtacgatcgaaacatgtttcggcaaaaaataacagatgcacgcgacaaatttgaaaaactacccaaacgcgacaaagttagcaacggcaaattacaacaaataggacaagtcacaataatcgataggatactcattggattacacacaaacgctggagtatcaaacttaaaagatctaggtatagcgacacctttcggtttcatgcaacaaggaaatggtatcagcctaacgagcacagctaaaatcatttatcaatcatccacaggattattcgaaaaatcaaaagcattagacgatttaaatccgctcgcctga

SEQ ID NO: 5444 - RNA, 4113 nt, synthetic construct
  misc_feature 1..4113: note = Cas9 variant
  source 1..4113: mol_type = other RNA
atgaataaaccctatagtattggactagatatcggtaccaatagcgtcggttggagcataataaccgatgattacaaagtaccagctaaaaaaatgagagttttaggaaatacagataaagaatacattaaaaaaaacctaataggagcactcttattcgatgggggaaacactgcagcagaccggagattaaaaagaaccgcaagaaggagatacacaaggaggcgaaataggattctttatttgcaagaaatcttcgccgaagagatgagtaaagtagatgatagtttcttccacagactagaagattcatttctcgtcgaagaggacaagagaggttcaaaataccccatatttgcaactatgcaagaagagaaatactatcatgaaaaattccccacaatctatcatttaaggaaagaattagccgataaaaaagagaaagcagacttacgtctaatatatctcgcattagcacatatcatcaaatttagaggacatttcctaatagaagacgataggtttgacgtacgaaatacagacatacaaaaacaatatcaagcatttcttgaaatattcgatacaacattcgaaaataatgacctcctaagtcaaaatgtggacgtagaagcgatcttaactgacaagataagtaaaagcgcaaaaaaagacagaatactcgcaagatatccaaatcaaaaatccaccggcatctttgccgaatttctaaaactcatagtcggcaatcaagccgacttcaaaaaacacttcaatcttgaagataagacgcctctacaattcgcaaaagattcctacgacgaagatttagagaacttattaggacagataggagatgaatttgctgacttgttttcggcagccaaaaagctctacgactcagtattactatcaggaatacttacagtcacagatctaagtacaaaagcaccattaagtgctagcatgatacagagatatgacgaacaccgagaagacctaaaacagctaaaacaatttgtaaaagcgagtctaccagaaaaataccaagaaatattcgcagactcatcaaaggatggatatgccggatatatagaaggtaaaaccaatcaagaagcattctacaagtatctttcaaaactactcaccaaacaagaaggatccgaatacttactcgaaaaaataaaaaatgaagattttctgcgcaaacaaagaacgtttgacaacggctccattccccatcaagtccacttgacagaattgagggcaatcattcgaagacaatcggaatactatccatttttaaaagaaaacctagacaggatcgaaaaaatcttaacattccgaattccatattatgttggtcccctagcaagagaaaaatctgacttcgcttggatgaccagaaaaacagatgactcaattagaccgtggaattttgaagatttggtagacaaagagaaatcagccgaagcctttatacatcgcatgacaaacaatgatttgtacttaccagaggaaaaagtccttcccaaacattcactgatatacgaaaaattcacagtatataacgagttaacaaaagtaagattcctagccgaaggcttcaaagacttccaattcttaaatagaaaacaaaaagaaacaatatttaattcactcttcaaagagaaacgaaaagtgacagaaaaagatataataagctttctaaataaagttgacggatatgaaggcatcgctatcaaaggtatagaaaaacaatttaatgcctcattaagcacataccacgatttaaagaaaattctaggaaaagatttcttagacaatactgataatgaactaatattagaagatatagtacaaaccctgacattatttgaagaccgcgaaatgatacgcaaacgtttagatatatataaagactttttcactgaatcccaattaaaaaaactatacagaaggcattacaccggttggggaagactgtcagcaaaactcataaatggaatccgaaacaaagaaaatcaaaaaaccatactcgattacctgatagatgacggatcagcaaacaggaacttcatgcaacttataaaagacgccggcctatctttcaaacctataatcgacaaggctagaacaggaagtcactcagataacttaaaggaagtagtaggagaactagcaggatcacccgcaataaagaaaggcatattacagtccttgaaaatagttgacgaacttgtaaaagttatgggatatgaacccgaacaaattgtggtggaaatggcacgggaaaaccaaacaaccgctaaaggactaagtagacttagacaacgtttaacaaccctaagagaaagtctagcgaatcttaaatcaaatatcctagaggaaaaaaaacctaagtacgtaaaagatcaagttgaaaaccatcacttatcggacgaccgactctttttatactatctacagaacggcaaagatatgtacaccgatgacgagcttgacattgacaatctgtcacaatacgacatcgatctcataattccacaagcatttatcaaagacgactcaattgacaaccgagtcctggtgtcctcagcgaaaaacagaggaaaaagcgatgacgtaccctcagtagaaatagtaaaagactgtaaagtattttggaagaagctcctagatgctaagttgatgagtcaaagaaaatacgacaatctcactaaagcagaacgtggaggccttacatccgacgacaaagcacgatttatacaaagacaattggtggaaacacgacagataactaaacatgtagctaggatactagacgaacgatttaacaatgaactcgatagtaagggtagacgaatacgaaaagtcaaaatagtaacactaaaatcaaacctagtaagtaatttcagaaaagaattcggcttctacaaaattcgtgaggtaaataactaccaccacgctcatgatgcctacctaaacgccgttgttgcaaaagcaatactaacaaaatacccccaactggaacctgaatttgtttacggcgattaccctaaatataatagctacaagacaagaaaaagcgccacagaaaaactgttcttctatagcaacataatgaatttctttaaaaccaaggtcaccctagcagatggaaccgttgtagtaaaagacgacatcgaggtaaataacgatacaggtgaaatagtatgggacaaaaaaaaacacttcgctactgtaaggaaagtattaagttatccccaagtaaacatagtaaaaaaaacagaaatacaaacaggaggcttcagcaaagaaagcatattagcacatggtaactcagataaattaataccacgaaaaaccaaagacatatacctagacccaaaaaagtatggaggctttgattccccaatagtggcatatagtgttttagtcgttgctgatattaaaaaaggtaaagcccaaaaattaaaaacagtaacagaactactagggatcacaatcatggaacgatcaagattcgaaaaaaacccctctgccttcctcgaaagtaaaggctacctaaatataagagatgacaaactcatgatacttccgaaatattcactgttcgaattagaaaatggtcggagaagactcttagcctctgcagatgaattacaaaaaggaaatgaattagctctcccaacacaatttatgaaattcttatacttagctagtcgctacaatgaattaaaaggaaaacctgaagaaatagaacaaaaacaagaatttgtagtacaacatgtatcttatttcgatgacattctacagatcataaacgacttttccaatagggtgatattagccgacgccaacttggagaaaattaataaactataccaagacaataaagagaacatacctgtcgatgaactcgcaaacaacattataaatctattcacatttacaagcctaggagcacccgcagccttcaaattcttcgataaaatagtagaccgtaaacgatacacatcaacaaaagaagtactaaactccactctgatacaccaatccattacaggactatatgaaacgaggatagacttaggtaaactaggcgaagactga

SEQ ID NO: 5445 - RNA, 4113 nt, synthetic construct
  misc_feature 1..4113: note = Cas9 variant
  source 1..4113: mol_type = other RNA
atgactaagaaaaattactcaattggactcgacatcggtacaaacagtgttggctgggcagtcatcacagatgactacaaagttcctgcaaagaaaatgaaagtactaggaaatacagataagaaatatataaagaaaaatttattaggagccttactgtttgattcaggagaaactgctgaagcaacaagactaaaaagaacagcaagaagaagatacaccagaaggaaaaacagactaagatatctacaagaaatattcgcagaagaaatgacaaaagtcgacgaatcattcttctacagattagacgaaagtttcttaaccaccgatgaaaaagacttcgaaagacaccccatttttggaaataaagcagaggaagacgcgtaccatcaaaaatttcccacaatataccatttaaggaattacttagcggactccagcgaaaaagcagatctaagattagtatatctcgcactagcacacatgatcaaatacagaggacatttcttaatcgaaggtaaactaaacgccgaaaatacagatgtacaaaaactatttacagattttgtgggtgtatacgaccgaacctttgacgactcacatttaagtgaaatcacagtagatgttgcttctacgctcacagagaaaatatcaaaaagtagacgactagaaaacctcatcaaatattacccaactgaaaagaaaaatactttatttggaaatctaatcgcactggcattaggattacagccaaatttcaaaatgaattttaaactctcagaagacgctaaactacaattttcgaaagacacttacgaagaagatctagaagaacttctcggtaaaatcggagatgattatgcggatctatttacatcagctaagaatctttatgatgcaatacttttgagtgggattctgacagtagatgacaacagtactaaagctccattaagcgcatctatgatcaaaagatacgtagaacatcacgaagacctagaaaaattaaaagaatttataaaagcgaataaatctgaactataccacgatatatttaaagacaaaaataagaatggatacgcaggatatatagaaaacggagttaagcaagatgaattttacaaatacttaaagaatacattgagcaaaatagatggatcggactatttcttagataaaatagaacgagaagactttctaaggaaacaacggacttttgacaatggatcaatacctcatcaaattcatttacaggaaatgcatgcgatcttaagacgacaaggagattattatcccttccttaaagaaaaacaagaccgaatagaaaagatattaacctttaggataccctactatgtaggaccattagtcagaaaagatagcagattcgcttgggcagaatatagatccgacgaaaagataactccctggaatttcgacaaagtcatagataaagagaaaagtgcagaaaaatttataacaaggatgacactaaacgacctatacctgcccgaagagaaagtattgccaaaacactctcacgtatatgaaacttacgccgtctataatgagttaacaaaaataaaatatgtgaatgaacaagggaaagagagtttcttcgactcaaatatgaaacaggaaatattcgaccatgtgttcaaagaaaaccgaaaagttaccaaagaaaaattacttaactatctaaacaaagagttcccagaatatagaatcaaagaccttatcggcttagataaagaaaataaatcattcaacgcaagtctcggaacctatcacgacctaaagaaaatattagataaggctttccttgatgacaaagttaacgaagaagtcattgaagacattataaaaacattaaccttatttgaagataaagacatgatacacgaaagactacaaaaatattctgacatattcacggccaatcaactaaagaaattagaaagacgtcactacaccggctgggggagactcagctacaaactcattaacggaatacgaaacaaagaaaataataaaaccatattagactatctaatcgacgatggcagcgcaaaccgtaattttatgcaactcatcaatgatgacaccctaccatttaaacaaatcatacaaaaatctcaagtagtaggagacgtagatgacattgaagccgtagtacacgaccttccaggaagccctgcaattaagaaaggaatactacaatcagtaaaaatcgtagacgagctagttaaagtaatgggggataaccccgacaatatagtaatagaaatggctagagaaaatcaaactacaaacagaggcagatcacaaagtcaacaaagactaaagaaactacaaagcagtttaaaagaattaggtagcaacatattgaacgaagaaaaacccagttacatcgaagacaaagtagaaaacagtcatctgcaaaacgaccagttgtttctatactatatacaaaatggaaaagatatgtacacgggagatgaactagacattgaccacctgtccgactacgatatagatcacataattccacaagcattcataaaagatgatagtatagataaccgagtcctcacatcatccgcgaaaaacagaggaaaatcagatgacgttccttcattagatatagtaagagcaagaaaggcagaatgggttcgcctatataaaagcggattaatatcaaaacgtaaattcgacaaccttacgaaggcagagagaggaggtttaactgaagccgacaaggccggatttattaaaagacaattagtagagacaagacaaataacgaagcatgtagcacaaattctagatgcacgatttaacactgaacacgacgaaaacgataaagtcataagggatgtaaaagtcataacacttaaatctaatttagtaagccaatttcgaaaagactttgagttctataaagtaagagagataaacgattatcaccacgcacacgatgcatatttaaacgcagttgtcgggacagcgttactgaaaaagtacccaaaactagcatcagagttcgtttatggagaatacaaaaagtatgacatacgtaagtttataaccaattcttccgacaaagcaaccgcaaaatacttcttttactccaacctaatgaacttcttcaaaaccaaagtcaaatacgcagacggaacagtattcgaaagaccgattattgaaacaaatgccgatggagaaatcgcatggaacaaacaaatagatttcgaaaaagttcgcaaagtactcagttaccctcaagtgaatatagtgaaaaaggtagaaacacaaacaggcggattctcaaaagaatcaattttacccaagggtgattcagacaaactaataccaagaaaaacaaagaaagtttactgggatacaaagaaatatggaggattcgatagccccactgttgcttattcagtatttgtagttgcggatgtagaaaaagggaaagcaaagaaattaaaaactgtaaaagagctagtagggatatcaataatggaacgttcattctttgaagaaaatccggtagaatttttagaaaataaaggctatcacaatatcagagaagataaacttataaaattacctaaatactcgctatttgagttcgaaggtggacgacgacgactgttagcctccgcaagtgaactacaaaaaggtaatgaaatggtactaccaggctatcttgtcgaactattatatcacgcacacagagcagacaatttcaacagcacagaatacctaaactacgtgtcagaacacaagaaagaatttgaaaaagtactaagctgtgtagaagatttcgcaaacctatacgtcgacgttgagaaaaacctaagcaaaattcgtgcagttgcagatagcatggataatttctcaattgaagaaatttccaacagcttcattaacctcctcaccttaaccgctctaggagcccctgccgacttcaacttcttaggtgagaaaataccaagaaaacgatatacatctactaaagaatgcctgaccgcaacattaatccatcaatcaattacagggctatacgaaacaaggatcgacctatcaaaacttggagaagaatga

SEQ ID NO: 5446 - RNA, 4113 nt, synthetic construct
  misc_feature 1..4113: note = Cas9 variant
  source 1..4113: mol_type = other RNA
atgaaaaacgcaaataaagtaacaggtaagtactatttaggattcgatatagggacaaactcagtaggatgggctgttaccgatgagaattacaatctatgtaaattcaaaaaaaaaagcatgtggggaataagattatttgaagatgcaaaaacagctgaagaaaggagaggacaacgagcatccagaagaagattacaacgcagaaaacaacgtatagatttacttcaagaaatttttgctgaagaaataaataaagtagacgagacgttctttatacgactaaatgaatctagattacacttagatgataaaaccgtatcagaaaaacacccactatttataggctcagaatacagcgaaaaggaatactatagagagtacccaacaatattccatctaagaaaagagctaatggagagttccgaaccgcacgatataagacttgtatacttagcaatccatcacatactaaaaaatagaggtcactttttgattgatggagagttgagtaaggccaatagtttcgatgcagctttttatcaaatgaaggaggtactatgcaatgaattagatttagaaatagacggcgaaaacacaaccgaggtcgagcgaactttacgagatagaaatataagtaaatctgataaagttaaattattagccgctttattagcgatgaatcaaaacgaaacagaatcaaaagaaacgaaaaaaaaaatagaaaatatatgtaaattattagccggaaacaaaggagatatatcaaaaatatttgggcaaacaccagaaggggttgagaaaacatccttttcattcggagaagcagattatgatgaatcgataagaccaaacctagaagagtccatccccgaccaatgtttcgtaatagatagcataaaagctctgtacgactggaacgtattagctgatatactaaatggtcaaacgtacttaagttgcgctaaagttaatcaatacgaaacacacaaaaataatttaaaagaattaaagctactagtaaaccgctactgctcaagagaagaatacaaaaggttttttaaaagcgcagtagagaaagcaaattatagtaactatataggatctgctaaacagggaaacaaaataatagatgtaaaaaggtgtgcagaagaagatttttataaagaacttaaaatactattatcaaagatagaaccggaagaagctgatagagaattatatgaaagaataaaacgagaggccgaagaaggttccttacttccactgcaaaggaataaagataatagtgtggtaccaaaccaaatgcacaaagcagaactagccctaatacttgaaaacgcgggatcttatttaggattcctgaacgaaaaagacgaagatggattaagcccagcagaaaaaataattgaattatttagcttcagaataccatactacgtaggtccactttcagacagacacaaagaccggggaagtaacgcctggatagtgagaaaggcagaaggacgtatcctcccgtggaactttgacgaaaaagtagatagagaaaaaagtaatgaagctttcatcgaaagaatgaccaacaaatgcacatatctattaggcaaagatgtagttgcaaaaaattcactaatatatagtcacttcatggtattgaatgaactaaacaatttaagtgtatgtggaaacaaaatatccgtgcaagtaaagcaagacatataccgcgagctcttccaacgtcacacaaaagtatcaaaaaagatgctattgcaatattgtcgcgaaaaaatgatgaacaaagatttagaggaagaagatctttctgggtttgacggagatttcaaagctaaattatcaagctacctagactttgaaaaaaaagtatttggagcaaaaatggaggaagacaggatacggaaaataacagaagatattataagatggaaaacgatttacggtgacgatggaaagatgctacaagcagttgtagagaaggaatacccaggggaactggacagtgaccaactcaaagcagtaaaacaatttcgttacagcggatggggaaatttttcagaagaatttttaaacggtatcgtaggaactgaaaaaccgacaggacagatgtttacaatcattgaagcattatggcagactaattgtaacttaatgcaattactaagtaaaaacttcacctttatggaggaaatagaaaaacataaccgagaactagcaggccaaataaccgacatatcttatgacaaattagtgaaggacctatacataagcccagctaataaacgagcagtatggcaaacagtgcgaatagcggaagaagttaaaaaaataatgggctgtgaacctgcaaaaatatttgtagagatggcaagaggaggggaaaaagaaaaaaaacgtacgatatctagaaaaaaaaaattgttagaattatacgcagcctgtaaaaaagatgcacgagactggaaccgagaaatagaagacagagacgaaagagaatttaattcagacaaactatacctttattatacacagatggggagatgtatgtattcaggtgaaagaatcgatttgcatgaactaatgagtgcgaattcaaagtgggatatagatcatatatacccacaatcaaaagtaaaagatgattctctggacaacagagttttaagccttaagaaaattaataatgaaaaaggaaataaaccattatctagagatattcaacagtcacagcaaaagtggtggacagagctattacaactagaattcattacgaaaaaaaaatatgatcgactaatgcaccgaggtgagctaagcgaagaagaattatccggatttataaatcgccaactggttgaaacacgtcaatcaacaaaggctgcagcagaattattaggaagaatgtataataacagcaaagttgtctacgtgaaagctccactagtatcacagttccgaaaggatgacctaaatatactgaagtcacgattagctaacgactaccaccatgcaaaagatgcatatctaaatatagctgtcggcaatgtctataatgaaaaattcacagacaatccactaagatggatagaaaaacacgctggagaaaactactccataaacagggtgttcgactatgacatagtagcaggcgatggtgccccggtatgggcagcaccactaagagacgagaaaaataaactgaggaagaatgaggtaggcgaaaaatacggtggaacaatagacgtaatcagaaaaaccgtaaaaaggaatgatgtactatacacagagcatacatattgtggaaagggagagctatttaatgcaacgattgcgaaaaaagatggaggggccgaaatcccactgaaagcaggactacaaactggtaaatacggagggtacaaaagtccgaacacgagctattttgcagctattgaattcgacggaaagaaaggcgaaagagttaaaaatataatggaagtacctgtatacatagcgaacattctgttacacgacatagatgcatatataagatactgcgaaacagtaaaaggtttaaaaaacgtaaaaatattacggccatgtatcaaaaagaacgcgctgataagcgtagatggctacccaatgaggatacgtggagcgaacgaaaaaaatatactacttaaaaataacttacaaccaatatttggacgtcacgaggaaactgtgagaaggatagaaaaatatgtagaaaaaaaccaagaatttgaagtcgacgaaaaatttgatggattaaatgaagcaaatttgacagatttgtacgacgacataacagaaaaattatgtgggccctatgtggagcgtcctagtaaccaaggggagtatctcatggaaaatagggaaaaattcctcaatatttcactaaaagaaaaagccaagcttcttgcacaaatgataaagctagtcagatgtgatacagaaacaaaagcagatctgagatcaataggtgcttctaagaatgccggagtaatcagtgtaaataagaacacattagggggaaaaagactcatattaataaatcaaagcgtaacaggattgttcgaaaacagaattgaactgtga

SEQ ID NO: 5447 - RNA, 4113 nt, synthetic construct
  misc_feature 1..4113: note = Cas9 variant
  source 1..4113: mol_type = other RNA
atgaacaaaccatacagtataggattagatatcggaaccaacagtgtaggatggtccatcataaccgacgactacaaagtaccagctaagaaaatgagagtactaggaaataccgataaagaatatataaagaaaaacttaattggcgcactcttatttgacggaggaaacacagcagcagacagacgtcttaaaagaacagcccgtagaagatacacaagaagacgcaataggattctatatctgcaagagattttcgctgaagaaatgagcaaagtagacgactcatttttccaccgacttgaagactcattcctagtagaagaagacaaacgaggctctaaatatccaatctttgcaaccatgcaagaagaaaaatattatcacgagaaatttccaacaatatatcatcttagaaaagaactcgctgacaagaaagaaaaagcagatctacgactgatttacttagccttagctcacataattaaattcagaggacatttcctaatagaagatgacagattcgatgtaagaaacaccgatatacaaaaacaataccaagcatttctcgaaatatttgacacaacgttcgaaaataatgatctattatcgcaaaatgtagatgttgaagccattctgacggataaaatatctaaaagcgcaaagaaagaccgaatactagcaagatatccaaaccaaaaatctactggaatattcgcagaatttctaaaattaatagtggggaaccaagcagattttaagaaacactttaatcttgaggacaaaacaccactacaatttgctaaagactcctacgatgaagaccttgaaaatttattaggccaaataggtgacgaatttgcagatctattttcggcagccaagaaactatatgactcagttctcctatctggaatactaacagttacagacttatctactaaagcaccattatctgcaagtatgatacaaaggtatgatgaacacagagaagatctgaaacaattaaaacaatttgtaaaggcttccctcccggaaaaataccaagaaatcttcgcagattcttctaaagatggatacgcaggttatatcgaaggcaaaacaaatcaagaggctttctacaaatatctatcgaaattactaacaaaacaagagggaagtgaatacttactagagaaaattaaaaacgaagactttttacgaaaacaaaggacatttgataatggtagcataccacaccaagtacacttaacggaactacgagcaataataagaagacaatcagaatactatccattcctaaaagaaaatctagatagaattgagaaaatcttaacattcagaataccgtactacgtaggaccattagcaagagaaaaatcagatttcgcatggatgacgcgaaaaacagatgacagcataagaccctggaatttcgaagatttggtagacaaagagaaaagcgccgaagcctttattcacagaatgacaaataacgacctatacctcccagaagaaaaagtactaccaaaacacagcctaatatatgaaaaattcacagtatacaatgaactgacaaaagtacgattcttagccgaaggttttaaagattttcaatttttaaaccgaaaacaaaaagagacgattttcaatagtttattcaaagagaaaaggaaagtcacagaaaaagatataatctcatttctaaacaaagtagacggatacgaaggaatcgccatcaaaggaattgaaaaacaattcaatgcctcattatcaacataccatgaccttaagaaaatactaggcaaagatttcttagacaatactgataacgaactcatactagaagacatagtacaaaccttaaccctttttgaagacagggaaatgatacgaaaacgcttagatatctacaaagactttttcactgaaagtcaactcaagaaactataccgtcgtcattacactggctgggggcgtctatcagctaaactaataaatggaataagaaacaaagaaaatcaaaagaccatactagattatctaatagatgacggatcagctaaccggaacttcatgcaactaataaaagatgctggcctatcatttaaaccaatcatcgataaagctagaaccggcagccactctgataacctaaaagaagttgttggggaacttgcaggaagtccagctataaagaaaggaatattacagagcttaaaaatagtagatgagttagtaaaagttatgggttacgagccagaacaaatagtagttgaaatggccagggaaaatcaaacgacagccaaaggactatctcgatcgaggcaaagactcacgacattgcgagaaagtcttgcaaacttaaaaagcaacatcttagaggaaaagaaaccgaaatacgtaaaagaccaagtagaaaatcatcacttatcagatgaccgcctcttcttatactacctacaaaatggtaaagacatgtatacagatgacgaattagacattgacaacctatctcaatacgacattgaccatataatcccacaagcattcatcaaagatgatagtatcgataatcgagtcctggtatcaagtgccaaaaatcgcgggaaatcagacgacgtacccagcgtcgaaattgtcaaagattgtaaggtcttctggaagaaactactcgatgcaaaacttatgagtcaaagaaaatatgacaacctcaccaaagcagagagaggcgggctcacctcagacgacaaagcaaggtttatacaaaggcaactggtagaaaccagacaaataaccaaacacgttgctagaatattagacgaacgatttaataatgaactagatagcaaaggtaggaggattcgtaaagtaaaaatcgtaacactgaaaagcaacttagtaagtaattttagaaaagaatttggtttttataaaataagagaagttaataactatcatcatgcacacgatgcctatttgaatgctgtagtggctaaagcaatattaaccaagtatccacaactcgaaccagaatttgtttacggcgattaccccaaatataatagctacaaaactaggaaaagcgcaactgaaaaactattcttctattcaaacataatgaatttctttaaaacaaaagtaaccctagcagacggcacagtcgtagtaaaggatgacattgaggtaaacaacgatactggagaaatagtctgggataaaaagaaacatttcgccactgtacgaaaagtactcagttacccacaagtaaacatagtaaagaaaacggagatacagaccggaggatttagtaaagaaagtatattagcccatggcaattctgacaaacttatccccagaaaaacaaaagacatatacttagaccctaagaaatatggtggattcgacagcccaatcgtagcatactcagtgcttgtagtagccgacattaagaaaggaaaagcacaaaaactaaaaacagtcacagaactcctaggaataaccattatggaacgaagtagatttgagaaaaatccatcagcatttttagaaagcaaaggatacttaaacatacgcgacgacaaactgatgatattgccgaaatactccctatttgaactcgaaaacggcagaagaagactcttagcaagtgccggagaactacaaaaaggtaacgaactagctttaccaacccaatttatgaaatttctatatctagctagtagatacaacgagttaaaaggcaaaccagaagaaatagagcaaaaacaggagttcgtcgttcaacatgtatcatatttcgacgacattttacaaataataaacgatttctcaaatagagtaatacttgccgacgcaaacctcgagaaaataaataaactataccaagataataaagaaaacatacctgtggacgaacttgccaataacataataaatttattcacttttacgtcattaggcgctccagcggctttcaaattcttcgataaaattgtcgaccgaaaaagatacacaagcactaaagaagtactaaacagtactttgatacatcaatctataacaggactttacgaaacaaggatagacctaggtaagttaggtgaagactga

SEQ ID NO: 5448 - RNA, 4113 nt, synthetic construct
  misc_feature 1..4113: note = Cas9 variant
  source 1..4113: mol_type = other RNA
atgacaaaaataaaagacgattatattgttggtttagatatcggtactgattcatgtggatgggtagcaatgaactcaaataacgatatattaaaattacaaggcaaaacagctattggttctagactatttgaaggaggtaaatcggctgcagaaagacgactatttagaactacccacagaagaatcaaaaggagaagatggcggttaaaattactggaagaatttttcgacccttacatggcagaagtagatccttacttctttgcgcgactaaaagaaagcgggctgagtccattagataaaagaaaaaccgtctcttcaatagtattccctacaagtgcagaagacaagaaattttacgacgactaccccactatataccatcttcgatacaaattaatgacagaagacgaaaaattcgatctaagagaagtctatttagcgatacaccatataataaaatatcgcggtaattttctctacaatacatcagtcaaagattttaaagcaagtaaaatcgacgttaaatcatctatcgaaaaactaaatgaactatatgaaaatttgggattagaccttaacgtagaatttaatatatccaacaccgcagaaatagaaaaagtactgaaagataaacaaatattcaaacgagacaaagtcaagaaaatagcagaactatttgctattaaaacagacaacaaagaacaatccaaaagaataaaagacatctcgaaacaggtagctaatgctgttttgggatacaaaacaagatttgacaccatagcacttaaagaaatttcgaaagacgaactaagtgactggaattttaaattatcggatatagacgctgatagcaaatttgaagcattaatgggaaatctagacgaaaatgaacaagcgatcttactaaccataaaagaactatttaacgaagtaactttaaatggaatagttgaagacggaaacacgctatcagaatcaatgataaataaatataacgaccaccgagatgatcttaaactcctaaaagaagttatagaaaaccatattgataggaagaaagcgaaagaacttgcactggcctatgacctttatgttaacaatagacacgggagacttttacaagccaaaaagaaactcggaaaaataaaaccacgtagcaaagaagacttctacaaagtagtaaacaaaaacctagatgatagccgagcgtctaaagaaatcaaaaagaaaatagaattagattcctttatgccaaaacaaagaaccaacgctaacggagtaataccataccaattacaacaactagaactcgacaaaattatagaaaatcaaagcaaatactacccattcctgaaagaaatcaaccctgtatcttcacatcttaaagaagccccgtataaattagatgaacttataagattcagagttccttactacgtaggaccattaattagccctaacgaatcaactaaagacatacaaactaagaaaaatcaaaactttgcatggatgataagaaaagaagaaggaagaataactccctggaacttcgatcaaaaagttgaccgaatagaaagtgctaataaattcataaaaagaatgacgacaaaagacacatacttatttggagaagacgtattacccgcaaactcattactataccaaaaattcacagtattaaatgaactaaacaacatacgaataaatggcaaaagaatatcagtagacttgaaacaagaaatatacgaaaatctattcaagaaacatacaactgtaacagtgaagaaattagaaaactatttaaaagagaatcacaacttagtaaaagtagaaatcaaaggattagcagacgagaagaaattcaatagcggtcttacaacatataatagatttaaaaacctaaatatctttgataatcaaattgacgacctcaaatatcgaaacgactttgagaaaataatcgaatggagtacaatttttgaggataaatctatatataaagaaaaattaagaagcatagattggcttaatgaaaaacaaattaacgcgttatctaatatccgactacaagggtggggacgactaagcaagaaacttctagcacaactacatgaccacaacggccaaacaataatagaacaattatgggacagccaaaataacttcatgcaaatagtcacgcaagcggacttcaaagacgcaattgccaaagcaaaccaaaatttgctcgtagccacgtcagtggaagacatactaaataacgcttacacatcaccagccaacaagaaagcaatcaggcaggtcataaaagtagtcgacgacatagtaaaagcagcttcgggcaaagtcccgaaacaaatagcaatagaatttactagagacgcggatgagaacccgaaaagatcccaaacaagaggttcaaaactacaaaaagtctacaaagatctcagcacagaattagcatctaaaactatagcagaagaactaaatgaagcaataaaagataagaaactcgtacaagataaatattacctctacttcatgcaattaggaagagacgcttatacaggagagccaataaatatagacgaaatacaaaaatatgacatagatcacatactgcctcaatctttcataaaagacgatgcgctagacaatagagtattagtaagccgagctgtcaataacgggaaatcagataatgtacccgtgaaactatttggaaatgagatggctgcaaatttaggaatgacaatacgaaaaatgtgggaagaatggaaaaacattggacttattagcaaaacgaaatacaacaatttgctaacagatccagatcacataaataaatacaaaagtgcaggatttattagacgccaacttgtagaaacctcacagattattaaactggtatccaccattctacaatctagatatcccaacactgaaattattactgttaaagccaaatacaatcactacctaagagaaaaattcgacttgtataaatcccgcgaagtaaacgactaccatcatgcaatagacgcttaccttagcgcaatctgcggaaatctattgtaccagaactaccctaatctacgaccatttttcgtttatggtcaatacaagaaattttccagcgaccccgacaaagaaaaagaaatatttaacaaaacaagaaaattttcattcatcagccaaattctgaaaaacaaaagtgagaactcaaaagaaattgccgaaaaactaaaaagagcgtaccaattcaaatacatgctcgtatcacgagaaaccgaaacaaaagaccaagaaatgtttaaaatgacagtatttccgagggaaacgcctggtaatctaatacccaagaagaaaggaatggcaccagaaatctatggcggttacactaaaaattcagatgcctatatggtaatcgtgaaaatagacaagaagaaagaaacagaataccgcatcctcggaatacctacaagagagctagtaaacctcaagaaagcagaaaaagaagaccattatgaatcatatttaaaggaaatcttagcacctaggattctgtacaataaaaatggaaaacgagataaaaagataacatcattcgaaatagtaaaatcaaaaatcccatacaagcaagttatacaagacggtgacaagaaatttatgctgggatcatcaacttacgtctacaatgctaaacaattaacactttcaaccgaatcaatgaaagcaataacaaataattttgataaagatagtgatgaaaacgacgcactaattaaagcatacgacgagatcttagataaggtagacaaatacctcccattattcgatattaacgcattccgcaaaaagctacacagcggcagagaaaaatttgtcgaactttcactggaggacaagaaagacataatactaaaagtattgataggactacacgacaatcctgctacatccgacttaaaaacattaggattctcgagcactgaattaggcaaaatgcagaaaaattcaggcattgtactatcaggtaatgcgaaattgatatatcaaagtccaactggtctatttaaaaagagtgttaaaataagtgatttatga

SEQ ID NO: 5449 - RNA, 4113 nt, synthetic construct
  misc_feature 1..4113: note = Cas9 variant
  source 1..4113: mol_type = other RNA
atgacaaaaataaaagacgactacatcgtaggactagacataggcacagattcatgcggatgggttgcaatgaactcagataacgacatactaaaactacaaggaaaaacagccatagggagccatctattcgaagccgggaaatcggctgcggacagaagactattccgaacaacacacagacgaataaaaaggagaaggtggagactcaaactattagaggaatttttcgacccctacatggcaaaagtagatccctatttcttcgctaggctgaaagaatcaggactttcaccgctggataaacgcaaaaatgtattttcgatagtatttcccacagcagcagaagacaagaaattctatgacgactatccaacaatataccacttaagatacaaacttatgacagaagatgaaaaattcgatctacgagaagtatacctagccatacatcatataataaaatacagaggcaactttctatataacacatctgttaaagactttaaagctagcaaaattgatgtaaaatcatcaattgaaaaactcaacgaattgtacgagaatctaggactagacttaaacgtagagttcaatatctcaaacacagctgaaatcgaaaaagtattaaaagacaaacaaatctttaaaagagataaagtgaaaaagatagcggaactatttgcaataaaaacagacaacaaagaacaaagtaaaagaataaaggacataagcaaacaggtagccaacgctgtattaggatataaaaccagattcgacactatagccctaaaggaagtatcaaaggacgaactctcagattggaactttaaactatctgacatagacgcagactccaaattcgaagccctaatgggaaatttagacgaaaacgaacaagcgatattactaaccataaaagagttattcaacgcagtaactctcaatggcatagtcgaagacggtaacactctatcagaaagtatgataaataaatataacgatcacagagatgacctcaaactgctaaaggaagtaatagagaaccacatagacagaaagaaagccgtcaaactcgcactcgcatacgacctatacgtcaataatcgtcatggacaactcattcaagccaaaaagaaacttggaaaaattaaacctggctccaaagaagacttctacaaagttgttaataaaaatctagacgatagtcaagcctcaaaagagataaagaagaaaatagagttagacagcttcatgccaaaacaacggacaaatgccaacggagttataccataccaactacaccaactagaactagacaaaataatagaaaatcaatcaaaatattacccattcctaaaagagattaacccagtcagctctcatctaaaagaagcaccttataaattagatgaactaatacgttttagagtcccttattatgtaggcccgttaatctcaccaaatgaaagtacaaaagatatccaaaccaagaaaaaccaaaactttgcatggatgataagaaaagaagaaggccgaatcactccatggaatttcgatcagaaagttgaccgaatagaatcagcaaataaattcattaaaagaatgacgacaaaagatacctacttattcggagagaatgttctacccgcaaactctctcctgtatcaaaaatttactgtactaaacgagctaaataacataagaataaatggcaaaagaattagcgttgacctaaaacaagagatatatgaaaacctattcaaaaagcataccacagtaaccgttaagaaattggaaaactaccttaaacaaaatcataatctcgtaaaagtcgaaataaaaggcctcgccgacgaaaagaaattcaactccggcctcacaacctataatagattcaaaaatttaaatatcttcgataaccaaatagacgatttaaaatatcgaaaagattttgagaaaatcatagaatggagtactatatttgaagataaatcaatttacaaagaaaagctacgtagcattgactggttaaacgagaaacaaataaatgcactaagtaacatccgccttcagggatggggaagattatccaagaaactcttagcacaactacatgatcacaacggacagacaataatagaacaactatgggactcacaaaataactttatgcaaatagtcacccaggcagattttaaagacgcaattgcaaaagcgaatcaaaacctattggtcgcaacttccgtagaggatatcctgaatgatgcatatacgagtcctgccaacaagaaagcaatacgacaagttataaaagtagtagacgatatcgttaaagcggcatccggtaaagtacccaaacagatagcgatagagttcactcgtgacgctgacgacaacccgaaacgatcacaaacaagaggtagtaaactccaaaaagtctataaagatctctcaacagaactagcatcaaaagcaattgccgaagaactcaacgaagctattaaagacaagaaactggtacaagacaaatattatctatactttatgcaactaggacgtgatgcgtatactggcgaaccgatcaacatagatgaaattcagaaatatgatattgaccatatcctaccccaatcattcataaaagacgatgccttagataatagagtcctcgtatcaaaagcagtaaacaatgacaaatctgataacgtaccagtaaaactcttcggaaatgaaatggcaggaaatctcggaataacaattagaaaaatgtgggaggaatggaaaaatatcggactaatatcaaaaaccaaatataataatctactaacagacccagaccacatcaacaaatatgaaagcgcaggttttattagacgacaactggtagaaactagccagatcataaaactcgtaagcacaatattacaatcaagataccctaacaccgaaatcatcacagtaaaagcaaaatacaaccattacctaagggaaaaattcgatctctacaagagtagagaagtcaatgactaccatcacgcaatagacgcatacttatcagcaatatgtggcaacctcctatatcaaaattaccctaatctgagaccattctttgtatatggccaatataagaaattctcatctgaccctgacaaagaaaaagagatttttaacaaaacccgaaaattcagttttatatcgcaaatacttaaaaataaatcagaaaacagcaaagaaatagcagaaaaattaaaaagagcataccaattcaaatatatgctagtatctagagaaaccgagacaaaagatcaagaaatgttcaaaatgacagtatttcccagagaaacgcccggcaatctaattccgaaaaagaaaggaatggccacagaaatttatggaggatacaccaaaaattccgacgcctacatggtgatagtaaaaatagacaaaaagaaagaaacagagtacagaatactaggaataccaacccgcgagcttgtaaatctgaagaaagcagaaaaagaagatcattatgaatcctacttaaaagaaatattagcaccacgtatattatacaataaaaacggaaaaagggataagaaaataacaagtttcgaaatagttaaatccaaaattccgtataaacaagtcatacaagatggagacaagaaattcatgcttggatcgagtacctacgtctacaacgccaaacaactgacattatcaacagaatcaatgaaagccataacaaataatttcgataaagattccgatgagaatgatgcactaataaaagcctacgatgaaatactcgacaaggtggataaatatctaccacttttcgatataaacgccttccgaaagaaacttcactcaggaagagaaaaattcgtagaactctccctagaagacaagaaagacataatactaaaagtactcataggattacatgacaatcccgcaacctccgacttaaaaacattaggcttctcatcgacagaacttgggaaaatgcagaaaaactcaggaatagtattgagtggtaatgccaaactcatataccaatctccaacaggattattcaagaaaagcgtaaaaatttccgatctatga

SEQ ID NO: 5450 - RNA, 4113 nt, synthetic construct
  misc_feature 1..4113: note = Cas9 variant
  source 1..4113: mol_type = other RNA
atgaataaaccatactcaattgggcttgatataggcactaactctgtcggatggtccattataacagatgactacaaagtccccgccaagaaaatgagagtattaggaaacaccgacaaagaatacataaagaaaaaccttataggagcactactattcgacggcggaaacaccgcggcagacagaagattaaaaagaacggcaagaagaagatatacacgacgccgcaacagaatattgtacttacaagaaatattcgcagaagaaatgtctaaagttgatgatagcttctttcacagacttgaagactcattcctagttgaagaagacaaaagaggcagcaaatatcctatattcgcgactatgcaagaagaaaaatactaccatgagaaatttccaaccatctaccatctaaggaaagaactagctgacaagaaagaaaaagcagatctaaggctaatatatttggctctagcccacataataaaattcagaggtcatttccttatagaagatgaccgatttgatgttcgaaacactgacatacaaaaacaatatcaagcatttttagaaatattcgacacaacatttgaaaataatgacctcctgagtcaaaacgttgatgtagaagcaatactaacagacaaaatctcgaaatcagccaagaaagatagaatattagcgagatatcctaatcaaaaatcaacaggtattttcgcagaatttctcaaactaattgtcggaaatcaagctgatttcaagaaacattttaacctagaagataaaacccctctgcaattcgccaaagattcatatgatgaagatcttgaaaacctacttggtcaaataggcgacgaatttgcagacctattttctgcggcgaagaaattatacgactccgtactactttccggcatattaacggtcaccgatctaagcactaaagcccctctctccgcatcaatgattcaacgatacgatgaacatagagaagatttaaaacaactaaaacaattcgtaaaagcaagcctaccagaaaaataccaagaaatatttgccgactcaagtaaagatggatatgcaggatatatagaaggcaaaaccaatcaagaagcattttataaatatctcagtaaattattaacaaaacaagaaggttcagaatatctattagagaaaatcaaaaacgaagactttctacgaaaacaaagaacgttcgataatggctcaatacctcatcaagtacatctgaccgaactccgagcaatcatccgccgacaatctgaatactacccctttttaaaagaaaacctcgatagaatcgagaaaattctgacatttagaataccttattacgttggaccactagccagagaaaaatcagatttcgcatggatgaccagaaaaacagatgatagcataagaccgtggaattttgaagacctagtcgataaagaaaaatcagcagaagccttcatacatcgaatgactaacaacgacctttatctaccagaagaaaaagtattgccaaaacacagtcttatatacgaaaaatttacagtctacaatgaactcacaaaagtacgctttttagcagaaggattcaaagatttccaatttttaaacagaaaacaaaaagaaaccatattcaactcactattcaaagagaaaagaaaagttacagaaaaagatataatttcattcttgaataaagtcgacggttatgaaggaatcgcaattaaaggcatagaaaaacaattcaatgcgtctctctctacataccatgacctaaagaaaatattaggaaaagatttcctagacaatacagataatgaactgattttagaggacattgtacaaacactaacactctttgaagaccgtgaaatgatcaggaaacgattagacatctacaaagacttctttacagaatcacaattaaagaaattgtacagaagacattacacaggctggggcagactctctgcaaaactaattaatggcatcagaaacaaagagaaccagaaaacgatactagactacctaattgacgacggatccgcaaacaggaactttatgcaattaataaaagacgcaggcctatcctttaaaccaataatagataaagctaggacaggatcacactccgataatctcaaagaagtagttggcgaattagcaggctcaccagcaatcaagaaaggcatactacaatcactaaaaattgtagatgagctcgttaaagttatgggctacgaaccggaacaaatcgttgtagaaatggctcgagaaaaccagaccacagcaaaaggactctcacgatctcgacagcgactaaccaccctaagagaaagtttggcaaacctaaaatcaaatatactcgaagagaagaaaccaaaatacgtaaaagatcaagtagaaaaccaccacctatcagacgatagattattcttatattacctacaaaacggcaaagacatgtacaccgatgacgaactcgatatagataatctttcccaatatgacattgaccatatcattccacaagcatttattaaagatgattcaatagacaacagagtgctagtgtcaagtgccaaaaatcgaggcaaatcagacgacgtccctagcgtagaaatcgtaaaagactgcaaagtattttggaagaaactactagacgctaaattgatgagccaacgtaaatatgacaatcttaccaaagcagaaagaggaggactcacttccgatgataaagcgcgatttatccaaaggcagctagttgaaacccgacaaataacaaaacacgtggctcgtatactcgacgaaagatttaacaatgaacttgatagtaaaggaagaagaatacgaaaagtaaaaatcgttactctaaaatcaaatctcgtatctaattttaggaaagagttcgggttctacaaaatacgtgaagtcaacaactaccaccacgcacatgacgcttacctaaatgcagtagtcgcaaaagccatcttaacaaaatacccccagttagaacctgaatttgtctatggtgattaccctaaatataactcctacaaaacccgtaaatctgcgacagaaaaactattcttttacagcaacataatgaactttttcaaaacaaaagttacacttgctgacgggaccgtagtcgtcaaggacgatatcgaagtcaataatgatacaggagaaatcgtttgggacaagaagaaacacttcgcaacagttagaaaagtattatcttatccacaagtgaacatagttaagaaaactgaaattcaaacaggagggttttccaaggaatcaatactagctcatggcaactccgataaactaattccacgtaaaacaaaggatatttacctcgaccctaagaaatatggagggttcgacagtcccaaagttgcatactcagtgctcgtagttgctgacatcaagaaaggtaaagcccaaaaactcaaaaccgtaaccgagttacttggcataacaatcatggaaagaagtcgattcgaaaagaacccaagtgcatttcttgaatcaaaaggttatcttaacatacgtgacgacaaattaatgatactaccaaaatattcactatttgaactcgaaaatggacgtcgtagactcctagcaagtgcaggagaactacaaaaaggaaatgaattagcactacctacacagtttatgaaattcttatatctagcctcacgatataatgaactaaaaggtaaacccgaagaaatagaacaaaaacaagaatttgtcgttcagcatgtaagctatttcgacgatattctccaaattattaacgacttttccaatagggtaatattagctgacgctaacttagagaaaattaataaattgtaccaagataataaggaaaacataccggtggacgaattggctaacaatataatcaatctcttcacttttacatcacttggtgctcctgcagcatttaaattctttgataaaatagtagatagaaaacgatatacttccactaaagaagtattaaacagcacactgatacataaaagcataacaggtttatatgaaacaagaatagatctaggcaaactaggagaagattga

SEQ ID NO: 5451 - RNA, 4113 nt, synthetic construct
  misc_feature 1..4113: note = Cas9 variant
  source 1..4113: mol_type = other RNA
atgaataaaccctattcaatcggcttagatattggaacgaacagtgtaggctggagtataataaccgacgattacaaagtacccgccaaaaaaatgagagtactcgggaatacagataaagaatacatcaagaaaaacttaattggtgcattattatttgacggaggtaacaccgccgcagacagaagattaaaacgaacagcccgaagaagatacacacgaagaagaaatagaatattatatttacaagaaatatttgcagaagaaatgtcaaaagtcgacgactcattcttccataggctcgaagattcattcttagtagaagaagacaaacgtggatcaaaatacccaatattcgctacacttcaagaagaaaaggattaccacgaaaaattctcaaccatataccaccttagaaaagaactggccgataaaaaagaaaaagctgatcttaggctaatctatatagccttagcacacataataaaatttagaggacattttctcatagaggatgactcatttgatgtaagaaacacggacatatcaaaacagtatcaagactttctggaaattttcaacaccacgtttgaaaacaatgacttacttagccaaaacgttgatgtagaagccatactgacagacaaaataagcaagtccgccaaaaaagatagaatactagcccaatatcctaatcaaaaaagcactggtatctttgctgaattcctaaaactaatagtaggtaaccaagctgactttaaaaaatattttaacctagaagacaaaacaccacttcaattcgccaaagactcatacgatgaagacctagaaaaccttctgggtcaaatcggcgatgaattcgcagacttattcagcgcagcaaaaaaattgtatgatagcgtactccttagtggtatcttaacagtaatagacttatccaccaaagcccccttaagtgcttctatgatccaacgttacgatgagcaccgagaagacttaaaacaactaaaacaattcgttaaagccagcttacccgaaaaataccaagaaatctttgcagattcaagtaaagatggttacgccggatacatagaaggcaaaaccaatcaagaagccttttacaaatacttatcaaaactacttaccaagcaagaagatagcgaaaatttcctagaaaaaattaaaaacgaagattttctacgcaaacaaagaacattcgacaacggcagcatcccccatcaagtacacctaaccgaactaaaagctataatcagaagacaatccgaatattatccttttttaaaagagaatcaagatagaatagaaaaaatattaacatttcgtataccgtactatataggaccactagcaagagaaaaaagcgactttgcatggatgacgagaaaaacagacgactcaattaggccgtggaattttgaagatctagtcgacaaagaaaaatcagcggaagcatttattcaccgcatgacaaataatgacttttatttacctgaagaaaaggtgctcccaaaacacagcctaatttatgaaaaattcacagtatataacgaacttacaaaagtacgatacaaaaatgaacaaggtgaaacttattttttcgactcaaatattaaacaagaaatattcgacggtgtattcaaggaacaccgtaaagtatccaaaaaaaaattactagatttcttggctaaagagtatgaagaattcagaattgtcgacgtcataggcctagacaaggaaaataaagcattcaatgcaagcctaggaacgtaccacgacctagaaaaaattctggataaagacttcctagataatccagataatgaatcaatactagaagacatagtccaaacgctaacactctttgaagatcgagaaatgattaaaaaaagattagaaaattataaagacttattcacagaaagtcaactgaaaaaactatatagaagacactataccggttggggacgactatctgcaaaattaatcaatggaatacgagataaagagtctcagaaaacaatactagattacctaatagacgatggccgaagtaacagaaatttcatgcaattgattaacgatgacggtctatcatttaaatccatcataagcaaagcccaagccgggtctcacagcgataacttaaaggaagtcgtaggagaattagcaggatcacccgcaattaaaaaaggaatattacaatccctcaaaatagtagacgaactagtaaaagtaatgggatacgaacccgaacaaattgtagtagaaatggcaagagaaaaccagacaacgaaccaggggcgaagaaactcacgccaacgatacaaattactagatgacggcgttaaaaatctagcatccgacttaaacggaaacatattgaaagaatacccaactgataaccaagcattgcaaaacgaaagactttttttatattacctacaaaacggccgagatatgtacaccggagaagctctagatatagataacctgagtcaatatgatatagaccacatcatcccccaagccttcatcaaagatgatagcatagataatagagtcttagtatcaagtgcaaaaaatcgtggtaaatcagatgacgtaccaagcctggaaatagttaaggactgtaaagttttttggaaaaaattactagatgcaaaattaatgagccaaagaaaatatgacaatctcacaaaagcagaaaggggaggcttaacgtcagacgataaagccagattcattcaaaggcaactagtcgagacaagacagataacaaaacatgtagctcggattcttgatgaacgctttaacaacgaattagactcaaaaggacgtcgaatacgaaaggtaaaaatagtgactctaaaatcaaacctcgtaagcaatttcagaaaagaattcggtttctataaaataagagaagtgaataattaccatcatgctcatgacgcatatcttaacgccgtcgtcgcgaaagcaatattaacaaaatatcctcaactcgaaccagaattcgtctatggagattatcctaaatacaattcatataaaactcgcaaatcagcaactgaaaagcttttcttctactctaatatcatgaacttttttaaaacaaaagtaaccttggcagatggaaccgtagtagtaaaagatgatattgaagttaataacgatactggagaaatagtgtgggataaaaaaaaacattttgcaacagtgagaaaagtactatcctatccacaaaataatatcgtaaaaaaaacagaaatacagacaggaggattctccaaagaaagcattctagcacatggtaacagcgataaactcattccccgaaaaaccaaagacatctacctggacccaaaaaaatacggtggatttgactccccaatagtagcctatagcgttcttgtagttgcagacattaaaaaaggaaaggcacaaaaattaaagacagttaccgaactacttggcattaccattatggagagaagtagattcgaaaagaatccaagcgcattcttagaaagcaaaggatatctgaacatcagagcagataaattaataattctaccaaaatattctctctttgaattagaaaatggacgtagaagactgctggcctccgcaggggaactccaaaaggggaacgaactggccttacccactcaatttatgaaattcctttatctagcgtccaggtataacgagagcaaaggaaaacccgaggaaatagaaaaaaaacaagaattcgtcaatcaacacgtcagctatttcgatgacatactgcaattaatcaatgatttcagcaaacgtgtgatactagccgacgctaacttagaaaaaattaacaaactatatcaagataacaaagaaaatatatcagtcgatgaattagcaaataacattattaacctattcaccttcaccagtttaggagcgccagcagcatttaaattttttgacaaaatcgtagaccgaaaaagatatacatcaacgaaagaggtgcttaattcaacattgatacatcaaagcattacagggctatacgaaacacgcatagatcttggtaaacttggagaagactga

SEQ ID NO: 5452 - RNA, 4113 nt, synthetic construct
  misc_feature 1..4113: note = Cas9 variant
  source 1..4113: mol_type = other RNA
atgaataaaccatactcaattggtttagatataggaacaaattcagtaggatggtcaattataacagatgattataaagtgccagcaaagaaaatgagagtgctaggtaacactgataaagaatacattaagaaaaatctaattggagccctcctgtttgacggaggtaacacagccgctgacaggagactaaaaagaactgcacggcgacgatatacaaggcgaagaaatagaatattatacctacaagaaatattcgcagaagaaatgtcaaaagtcgatgactcattctttcatcgtcttgaagattcatttctagtagaagaagacaaacgaggctctaaatatccgatatttgcaactttacaagaagagaaagactaccacgaaaaattttcaacaatttatcacctaagaaaagaactagctgataagaaagaaaaagccgacttaagactaatatacattgccctagcccacataatcaaattccgaggacactttctcatagaagacgactcatttgatgttagaaatacagacatatccaaacaatatcaagactttctagaaatattcaacactaccttcgaaaataatgacctcctatcacaaaacgttgacgtagaagcaatattgacagacaaaatctcgaaaagcgccaagaaagatagaatacttgcacaatatccaaaccagaaatcaactggaatattcgcagaatttctaaaactaattgtcggaaaccaagcagattttaagaaatattttaacttagaagacaaaacacccctacaatttgctaaagactcatatgacgaagacttagaaaacctcttaggtcaaataggagacgaatttgcagatctattctcagcagccaagaaactttatgactcagtactgctatcgggaatactcacggtaatagatctatcaaccaaagcgcctctatcagcatccatgatacagagatacgacgaacaccgagaagacttaaaacaactcaaacaatttgtcaaagcatcattaccagaaaaatatcaagaaatattcgccgatagttctaaagatggatatgcaggatatatagaaggaaaaacaaaccaagaagcgttctataaatacctaagcaaattactaacgaaacaggaagacagcgaaaactttctagagaaaatcaaaaacgaagatttcttaagaaaacaaaggaccttcgataacggtagtatcccccaccaagtacacttaacggaattgaaagcaataatcagaagacagtctgagtactaccccttccttaaagaaaaccaagatcgaatagagaaaatattgacctttaggattccatactacatagggccattagcccgagaaaaatccgattttgcatggatgacccgcaaaacagacgattcaataaggccatggaacttcgaagacttagtcgacaaagaaaaatccgcggaggctttcattcaccgaatgaccaacaacgacttctatctaccagaagaaaaagtactaccgaaacattccctgatatacgaaaaattcacagtctacaacgaactaacaaaagtaaggtataaaaacgaacaaggtgaaacatatttcttcgactcaaacataaaacaagaaatctttgacggagtcttcaaagaacaccgaaaagtaagtaaaaagaaattactagacttccttgcaaaagaatacgaagaatttcggatagtggatgtaataggcttagacaaagaaaataaagcattcaacgcatcactaggaacataccacgacctggagaaaattctagacaaagacttcctcgataatccagataacgaatcaatacttgaagacatcgtacaaacactcaccttgttcgaagatagagaaatgattaagaaaagacttgaaaattacaaagacttatttactgaaagccaattaaagaaactatacagacgacattacacaggatggggacgactaagcgcaaaactaataaatggcatccgtgataaagagtcccagaaaacaatactagattacctaatagacgatggacgcagtaatcggaattttatgcaactaataaacgatgatggtctcagtttcaaatcaatcatttcgaaagcacaggcaggaagtcatagtgataacctgaaagaagtagttggagaattagccggaagtccagcaatcaagaaaggcatacttcaatcgctaaaaatagtagatgagctagtaaaagtgatgggatacgaacccgaacaaatagtagtagaaatggcacgagaaaaccaaaccaccaatcaagggagacgaaactctcgacaacgatacaaattattagatgacggagtgaaaaacctagcgagtgatctaaatggcaatatactaaaagaataccctactgacaatcaagcactacaaaacgaaagactcttcttatactaccttcagaatggacgagatatgtataccggagaagcgctagacatagacaacttatcacagtacgacattgatcacatcataccccaagcatttataaaagatgactctatagacaatcgagtgttagtatccagtgctaaaaacagaggaaaatccgatgatgttcctagtctagaaatagtcaaagactgtaaagttttctggaaaaagttactagacgcaaaacttatgtcacaacgcaaatatgataacttaactaaagccgaaagaggtgggctcacatctgatgacaaagctcgatttatacaaaggcagctagtagaaacgaggcaaataacaaaacacgtagcacgaatcttagacgaaaggttcaacaacgaactcgacagtaaaggtcgacgtataagaaaagtcaaaatagtaaccctaaaatccaatctagtctccaactttagaaaagagtttggcttctataaaataagggaagtaaacaattatcatcatgcacatgacgcttacctaaacgcagtagtagcaaaagcaatactaacaaaatatccccaattagagcccgagttcgtatacggagattatccaaagtacaactcttacaaaacaagaaagagcgctactgaaaaactattcttttatagcaatatcatgaacttctttaaaaccaaagtcaccctagcagacggcaccgtcgtagtaaaagatgacatagaggttaataatgatacgggagaaattgtatgggacaagaagaaacacttcgctaccgttagaaaagtgttaagctacccgcagaacaacatagtcaagaaaacagaaatacaaacaggaggattctccaaagaatcaattctagcccatggcaactcggacaaacttattccaagaaaaaccaaagatatatatctagaccccaagaaatatggcggatttgattcaccaattgtagcatactcagttctagtggtcgcggatattaaaaagggtaaagcccaaaagttaaaaacagtcacagaattattaggaatcactatcatggaaagaagcaggtttgagaaaaaccccagtgcatttttagaatccaaaggatatttaaatataagagacgacaaactaatgatactaccaaaatattcactatttgaactagaaaatggacgcagaagactactagctagcgccggagaactacagaaaggtaatgaattagcattacccacccaatttatgaaattcctttacttagcaagtagatacaacgaaagcaaaggcaaacccgaagaaatagagaagaaacaagaatttgtaaaccaacatgtaagttactttgatgatatacttcaacttataaacgattttagtaaacgggttatattagcagatgcaaatctagagaaaataaataaactatatcaagataataaagaaaacatctcagtggacgagttagcgaacaatataataaatttatttacattcacatcactaggagctccagcagcattcaagttctttgataaaatagtcgatagaaaaagatacactagcacaaaagaagtacttaattctactctaatacatcaatcaatcaccggattatatgagacccgcatagatctcggaaaactcggggaagactga

SEQ ID NO: 5453 - RNA, 4113 nt, synthetic construct
  misc_feature 1..4113: note = Cas9 variant
  source 1..4113: mol_type = other RNA
atgaacaaaccttactcaatcggactagatatagggacaaactcagtgggatggtccataattaccgacgactataaagttccagcgaaaaaaatgcgagtactcggtaatacagataaagaatacatcaaaaaaaatctaatcggagctttattattcgatggaggaaacaccgcggccgatagacgtctgaaaagaacagccaggcggcgatacacgagacgccgtaatagaatattatacctacaagagatatttgcagaagaaatgtccaaagttgatgactcctttttccatagactcgaagattcattcttagttgaagaagataaacgaggctcaaaatatcccatatttgctacgatgcaagaagagaaatattatcatgaaaaattcccaaccatataccacctaaggaaagaattggctgacaaaaaagagaaagctgacctgcgtctcatatacctagcacttgcacacataatcaaattccgaggtcacttcttaatcgaggacgatagatttgatgtcagaaacactgatattcagaaacaataccaagcgttcttagaaatattcgacacaacattcgaaaacaatgatttacttagtcaaaacgttgacgtagaagcaatattaacagacaaaatctcgaaatctgcaaaaaaagatcgaattttagcaagataccccaaccaaaaaagtaccggaatatttgcagaatttttaaaactaatagtaggaaaccaggcagactttaagaaacatttcaaccttgaagacaaaacacccctacaattcgcaaaagactcatatgatgaagatttagaaaaccttttaggacagataggagacgaatttgccgatttatttagtgctgcaaaaaagctctacgatagtgtcttactcagcggcatcctaacagtcaccgacctatccacaaaagcaccgctatctgcatctatgatacaaagatatgatgaacatcgggaagatttgaaacaactaaaacaattcgtcaaagcgtctcttccagaaaagtaccaagaaatttttgcggattctagcaaggacggatatgctggttacatcgaaggaaaaacaaaccaagaagccttctacaaatacttatcaaaacttttgacaaaacaagagggttcagaatacttattagaaaaaataaaaaatgaagatttcctacgaaaacagagaacatttgacaatggttcaattccccaccaagtccacctaacagaattaagggcaatcatccgacgacaatctgaatattacccactactaaaagagaacctagatcgaatagaaaaaatactaacatttcgaatcccatactacgtcgggccactagcaagagaaaaatcagacttcgcatggatgacacgtaaaaccgatgactccatacgaccatggaatttcgaagatttagttgacaaagagaaaagtgcagaagcattcatacaccgaatgacaaacaacgatctctatcttcccgaagaaaaagtattaccaaaacactcactaatatacgaaaagtttaccgtatacaacgaactaacaaaagtcaggtttttagccgaaggctttaaagattttcagtttctaaataggaaacaaaaagaaaccatattcaattcattatttaaagaaaaacgaaaagtaaccgaaaaagatataataagctttcttaataaagttgacggttatgagggaatagccattaaaggcatcgaaaaacagtttaacgcaagccttagcacttaccacgacctaaaaaaaatcttaggcaaagactttctagataacacagataatgaattaatactcgaagatatagtccagacattaacgctattcgaggaccgagaaatgattcgtaaacgactggacatttacaaagatttctttactgaatcacaactcaaaaaactttaccgccgacattatacaggctggggtagactatctgcaaagctgataaatggcattagaaacaaggaaaaccagaaaacaattctagactacttaatagacgacggctccgcaaatagaaactttatgcaactaattaaagatgcgggactatcattcaaacccattatcgacaaagctcgcacgggatcacactctgacaatttaaaggaagtagttggagaattagcaggttccccagcaattaagaaaggcatcctacaatcattaaaaatagttgatgaactagtaaaagtcatgggatacgaacctgaacaaatagtagtagagatggcaagagaaaatcaaactacggcaaaaggattatcaagatcaagacaaagattaacgacacttagagaaagcttagccaacctgaaatcaaatatcctagaagaaaaaaaacccaaatatgttaaagaccaagtagaaaatcaccacctatcagacgatcgtctctttctatactatctacaaaatggcaaagacatgtacacagatgatgagctagacatagataatctctcccaatatgatatagaccatattatcccacaagcattcatcaaagacgattccatcgataaccgcgtactcgtatcctcagccaaaaatagaggtaaatcagatgacgtcccctctgtagaaatagtgaaagattgtaaagtattttggaaaaagttacttgatgcgaaactaatgagccaacgcaaatacgataaccttacaaaggctgaaagaggaggtctcacatccgacgacaaagcaagattcatccaacgacaactagtagaaacaaggcaaattactaaacacgtggctagaatacttgacgaaagatttaataatgaattagactctaaaggaagaagaatacgtaaagtgaaaatcgtaacactaaaaagcaatttagtaagcaactttcgcaaggaattcggattctacaaaatacgcgaagtaaataattatcatcatgctcatgacgcctaccttaatgcagttgtagcaaaagcaattctaacaaaatatccacaattagagccagaattcgtatatggagattacccaaaatacaactcatataaaactagaaagagcgcaacagagaaattatttttttacagcaatataatgaacttcttcaagacaaaagtaacattagcagatggaacagttgttgtaaaagatgacattgaggtaaacaacgatacaggcgaaattgtctgggacaaaaagaagcacttcgcgacagtaagaaaagtcttatcatacccacaagtgaatatagttaaaaagacggaaatccaaacaggtggctttagtaaagagtccatattagcacatggcaatagtgacaaactaatcccgagaaaaacaaaagacatttacttagatcccaaaaaatatggaggttttgacagcccaatagtagcatattctgttctggttgttgcagacataaaaaagggcaaagcacaaaaattaaaaacagtaacagaactactaggcataaccataatggaaagatcgagatttgaaaaaaaccctagcgcattcctcgaatcaaaaggataccttgatatacgagacgacaaactaatgatattaccaaaatacagccttttcgaactcgaaaacggtagaagaaggttattagcttccgctggggaactacaaaaaggaaatgaactagctctaccaacacaatttatgaaattcttatacctcgcaagcagatacaatgaactaaaaggaaaacctgaagaaatagaacaaaaacaagagttcgtcgtgcaacacgtgtcttatttcgatgacatacttcaaatcattaacgacttttcaaacagggtaatcctggctgatgccaatcttgaaaaaatcaataaattgtatcaagataacaaagaaaacatccctgtggatgaactcgcaaacaatataataaacttatttacattcacatcattaggtgcaccagctgcattcaaattttttgacaaaatagtggacagaaaacgttacacaagtacaaaagaggtacttaacagtactctcatacaccaaagcataaccgggctatatgaaactcgaatagacttaggtaaattaggagaagattga

SEQ ID NO: 5454 - RNA, 4113 nt, synthetic construct
  misc_feature 1..4113: note = Cas9 variant
  source 1..4113: mol_type = other RNA
atgaagaaaccatattccatcggactcgacataggaactaactcagtcggttgggcagttgtaaccgacgactataaagtccctgctaaaaagatgagagtatttggtgatacagatcgatctcacattaagaaaaacctcctaggaactctactatttgatgacggaaacacggcagaatcaagacgattaaaacgaactgccagaagaagatacactagaagaagaaacagaattttatacctacaagaaatatttaccgaatccatgaacgaaatagatgagagcttcttccaccgactggacgattcatttttagtaccagaagataaacgtggaagcaaatatcccatatttgctacattacaagaagaaaaagaatatcataaacaatttcccaccatataccacctaagaaaacaacttgcagactccaaagaaaaatctgacgtccgactcatctacctcgctttagcacacatgatcaaatacagaggtcatttcttgtatgaagaaactttcgacatcaaaaacaacgacatacaaaagatatttaacgagttcataaatatctacgacaatacattcgaaggtagcagtcttagtggacaaaacgctcaagtagaagcgatatttacagataaaataagcaaaagtgcgaagcgcgaacgagtcctaaaacttttcccagatgaaaaatccaccggcctgttttcagaatttctaaagttaatcgttggaaatcaagccgacttcaagaaacactttgacctagaagaaaaagccccacttcaattctcaaaagacacatatgacgaagaattggagaatctgctcggtcaaataggagacgactttgcagacctcttcttaatagctaagaaattatatgacgctatactactctcgggcattttaacggttactgaccctagtacaaaagcacccctttccgccagcatgattgaaagatacgaaaaccaccaaaaagacctcgccgccctaaaacaattcattaaaaataacctacccgaaaaatatgtggaagtattcagtgatcagtccaaagacggatatgcaggatatatcgatgggaaaaccactcaggaagcattctataaatatattaaaaacctgctatcaaaatttgagggagcagactattttcttgataaaattgagcgagaagatttcctcagaaaacaacgaacttttgataacggctcaatccctcaccaaattcacttacaagaaatgaatgctatcttacgaagacaaggggaacactatcctttcttaaaagaaaaccgagaaaagatagagaaaatcctaacgttcagaataccctattacgtaggaccactcgcaagggataatagagatttttcatggttaacgagaaactctgacgaacccattagaccctggaatttcgaagaagtagtcgataaagctagatcagcagaagactttatacatcgaatgacaaactacgacctttatttgccagaagaaaaagtcctaccaaaacattcattactatacgaaactttcgcagtctacaatgaacttacaaaagtcaaattcatcgctgaaggtttaagagattaccaatttctagattctggacagaagaaacaaatcgttaaccaactctttaaagagaaaagaaaagttacagaaaaagacataatacactatctacacaacgtcgacggttacgacggaatagaattaaaaggaatagaaaaacaattcaacgcaaacttatccacctatcacgacctcttaaaaatcacaaaagacaaagagttcatggatgaccccaaaaatgaagaaatcttagaaaacattgtccataccctaaccatcttcgaagaccgagaaatgatcaaacaaagactcgctcaatacgacacattgttcgacgaaaaagtaattaaagcactaacacgtcgacactacaccggatggggaaaattatcagcaaaactaataaacgggataagagacaaacaatctggtaaaacgatactagactacctaattgacgacgataaaataaacagaaatttcatgcaactaataaatgatgacggtttaagttttaaagaaatcattcaaaaagcacaagtagtcggaaaaacagacgacgtaaaacaagtggtacaagaactcccaggctcaccagccataaagaaaggtatcctacaatccataaaaatagtagatgaattggtaaaagtaatgggatacgcattagaatctatagttatcgaaatggcaagagaaaatcaaacaacagcacgtggaaagaaaaactctcaacaacgatacaaaagaatcgaagatgcattgaaaaatttagccccaggtttagactcaaacattttaaaagaaaatccaacagacaacatacaattgaaaaatgacagattattcttatactatctacaaaacgggaaagatatgtatacaggaaaaccactagacataaatcagttatcaagttatgacattgaccatataattcctcaagccttcattaaagacgattcaatagacaatagggttctgacatcgagtaaagacaatcgtgggaaatcagacaacgtaccaagcctagaagtagtacaaaaacgaaaggctttttggcaacaactgctcgactcaaaattaatatctgaacgcaaattcaacaacttaactaaagcagaacgaggaggccttgatgaaagagacaaagttggattcatcagacgtcagttagttgaaacacaacagattaccaaaaatgttgcgcaaatactagacgcacgttttaacacagaagtaaaagagaaaaaccaaaagatacgcacagtaaaaatcataacgcttaaaagtaatctcgtctcaaatttcagaaaagaatttggactatataaagtacgagaaattaataactatcaccatgctcatgacgcatatctaaacgctgtagtagctaaagcaatactaaagaaatatccgaaattagaaccagaatttgtctacggagactatcagaaatatgaccttaaaaagtatatcagtagattcaaaccatccaaagaaatagaaaaagcaacagaaaaatactttttctatagcaacttactaaactttttcaaagaagaagtactatacgcagatggaaccatccgtaaacgcgaaaatatagaatattcaaaggacacaggggaaattgcatgggataaagaaaaagactttgcgacaattaaaaaggtactaagctatccgcaagtaaacatagtaaagaaaagagaagtccaaaccggcggattttccaaagaatcaatcctgccaaaaggcaactctgacaaattgattccacgcaaaacaaaagatattttatgggacacaacaaaatatgggggatttgattcgcctgtgatagcttactcaatcttactcatagcagatatcgaaaaaggtaaagcaaagaaacttaaaacagtgaaaactctcgtaggcataaccataatggaaaaagccgccttcgaagaaaatccaataacattcttagaaaacaagggctaccacaatgtcagaaaagaaaacatactatgcttaccaaaatatagcctttttgaactagaaaacggacgaagaagactactagcgagcgctaaagaacttcaaaagggcaatgaaatagtactacctgtatgtctaacaacattattgtatcattccaaaaacctacacaaactcgacgaacccgaacacctagaatacatacaaaaacatcgcaacgagttcaaagatttacttaacttagtctccgaatttagccagaagtacatattagccgaagcaaacctagagaaaattaaagatctctacgccgataatgaacaagctgacatagaaattctagcaaacagcttcataaaccttttaacttttaccgcattaggagcacccgcagctttcaaatttttcggaaaagacgtagatagaaaacgatatactacagtctcagaaatcctgaatgcaacgttaatacaccaatcgatcactggattatatgaaacgagaatagacctttcgaaattaggcgaagaatga

SEQ ID NO: 5455 - RNA, 4113 nt, synthetic construct
  misc_feature 1..4113: note = Cas9 variant
  source 1..4113: mol_type = other RNA
atgaagaaaccatactcaattggactcgacatagggacaaattccgtaggatgggcagttataacagacgattataaagtgcccgccaagaaaatgaaagtgctaggaaacacagataaaaattatattaagaaaaatctactcggagcacttttattcgatagcggtaatacagcagaagatcgcagactaaaaagaacagcgagaagacgctatacgaggagaagaaatcgattattatacttacaagatatcttttccgatgaaatgaacaaagtggatgaatcatttttccacagactagaagacagtttcctagtatccgaagataaaagaggagaccatcatccaatttttggaaacgttgtcgacgaagttaaataccatgaacaattcccaacaatttaccatctacgaaaatatttagcagatacacctgaaaaagcagatttaaggctagtttacctagcgctcgcacatatgataaaattccgaggacattttctaatagacgacccgaaactagatgtcaaaaacacagacagccaagaactgttttcacaatttttaacagcatatgacgtaactcaagaagatagtcatttagcagacgttaaaataaacatttcagacataataacagagaaaatgaataaatctagaaaagtagaagcactactctttcacttcccaagccagaagaaaaattcctttttcggaaatctagtatccctagttttcggactattaccaaactttaaaacaaatttcaacctcgcagaagacgcaaaattacaactctctaaagattcatatgacgaagatctcgaaaacctactcggccagataggagatgaatatactgacgtcttcgttgcagcaagaaaactatacgactctatccttttatcaggtatcctcacagtaaatgatcttagcacaaaagccatactttccgcatctatggttagaagatatgaagaacataacaaagacctagcaaaactcaaagcattcgtaaaagcaaactttactcacgacgtatttaaagaagtattttctgatgcatctaaaaacggatacgctggatatatagaaggaaaaacctcacaagaagatttctacaaatacgtcaaaaacctaataggcaaagtagatggaagtgccgacttcatcgagaaaatagatagagaagatttccttagaaaacaacgaacatttgacaatggatcaattccacatcaagtacacctagctgaaatgaaagcaatactcaggcgacaaggcgaatattatcccttcttaaaagaacacgccgagaaaatacaacaaattctaactttcaggattccttattacgttggcccattagatagacacggtcattctgactttgcctgggcttccttcaattcggaagaaaaagtgacaccatggaactttgaagaaattatagacaaaaacaaatcagcacaagccttcatagaacgaatgaccaatcaagacctataccttcctaacgaaaaagttcttccaaaacacagtccactgtatgaaaaatacacagtttataacgaattaacgaaaataaaatacgtcactgaaacaggcaccgcaaaattctttgacgctaacctaaaacaagaaatatttgacggcctatttaagaaagaaagaaaagtaacgaaaagaaaactattgacattcctagagaaaaatttcgacgaatttcgaatcgttgatattcaaggtctagataaagaaactgaaacatttaatgcatcctacggaatataccaagatctattaaaaataataaaagacaaagcatttatggatgactctgagaatgctgacatcttagaagacatcgtactaacattaactctattcgaagatagagaaatgataaaacaacgcttggccaaatacgctgatctattcgataaaaaggtaattgacaatctggcaagacggagatacaccggatggggaagattgtcagctaaactcctcaacggcatacgcgacaaaagatccagaaaaaccataatggactatctcgtagatgacggacgatcaaatagaaatttaatgcaactcataacagatgacaatctaacatttaaagacgaaatagccaaagctcaatatagtgacaatagcgatgacttacatcaagtagttcaggatttagcaggctcacccgcaatcaagaaaggtattctccaaagcgtaaaaattgtagatgaactggtgaaagtaatgggctacgaaccagaacaaatagtagtagagatggcgagagaaaaccaaacgaccgcaaaaggcaggcgaaacagccaacaacgatataaaagacttgaagaagcaatcaaaaatttagatagagatctaaactataaaatcctcaaagaacacccaaccgataatcaggctttacaaaatgaccgattattcttatactatttacaaaacggacgggatatgtatacaggagagtcccttgatatcaatcgtttgtcggattacgatatagaccacatcataccacaggctttcatcaaagacaactccatagacaaccgagtcctagtatcaagcgccaaaaacagagggaaatctgatgatgttccatctgaagatgttgtaaatagaatgcgtccattttggaataaactactcaattgtggacttatctcacaaagaaaatacagcaatctaaccaagaaagaactcacaccaaatgacaaagcgggcttcattaaaagacaactcgtagaaacacggcagatcactaaacatgtggccaggattctcgacgaacattttaacaaggaatttgacgaagataagaaacgcatccgcaaagtaaaagtcgtaacattaaaatcgaatttagtttcaaacttccgaaaagagttcgaactatacaaggtacgagaaataaacgactaccaccacgcacacgacgcgtacctcaatgcagtagtagctaaagccctacttatgaaatatccaaagttagagcctgagttcgtatatggagaataccctaaatacaactcatacagagaaagaaaaactgcaactcaaagaatgttcttctattcaaatattatgaatatgttcaaaagtaaagtgaaacttgccgacgaaagaataattgagcgaccaatgatagaagtaaacgacgaaacaggagagattgcatgggataagacaaaacatatagcaacagtaaagaaagtactttcttatcctcaaataaatatagtcaagaaagtcgaggaacaaacaggagggttaacaaatgaaacgatatacccccgaggcagcttcgataaactcctaaaccgaaagaacacactagaagcaagcaaatacggcggattcggaagtcccacagtagcatactgtgtcctagtagtggccgactccaaaaacgagaacggcaaagtcaagaaactcaaattaggatcagaactactagggatcacaatattagagaaaaatgactttgaaaataatagcctagatttcctttcacgtaaaggataccaaggagtccaagagaagaaaataataaaactacctaaatactctcttttcgagttccaagacggttctcgacgaatgctaagtagcgtcatggcaaatgacaataaacgaggtgaccttcagaaagctaacgaaatgatactaccagcttatctagtaaaactactctatcatgccaaacatataaacagtgtaggtgaaccagctcacaaaaactacataaacgaacactgctccgaatttcaggatttgttgaattacatccgacaatttgctgacaaattcgtagacgtagacaaaaacttatccaaaataagatctctgagcaaatccatggccgaatactctgtatctgagatttgcagctcattcgtaaatcttcttacgttaacggcattaggtgcaccggccgacttcaagtttttcggaactacaataccaagaaagagatatggcagtcctcaatcaatcctcagtgcaaccctaatacaccaatcaattacaggattatacgaaaccagaatagatctatccaaattaggagaggactga

SEQ ID NO: 5456 - RNA, 4113 nt, synthetic construct
  misc_feature 1..4113: note = Cas9 variant
  source 1..4113: mol_type = other RNA
atgaacaaaccatacagtattggtctcgacatcggcactaactcagtaggatggagtatcataacagatgactacaaagttccagccaagaaaatgagagtattaggcaatacagacaaagaatatataaagaaaaatcttatcggagccctactatttgacggaggcaatacagcagcagacagacgacttaaacgaactgcaaggcgaagatatacaagacgaaggaatagaatattatacctacaagaaatttttgccgaggaaatgtcgaaagttgacgacagcttctttcacagattagaagactcatttctagtagaagaagacaaaagaggatcgaaatacccaatctttgcaacaatgcaagaggaaaaatactatcacgaaaaattcccaactatatatcatcttcgtaaagaattagcggataagaaagaaaaagccgacttacgcctaatataccttgcgcttgcccacataataaaatttcgaggccacttcctaatcgaggatgacagattcgacgtacggaataccgacattcaaaaacaatatcaagcattcttagaaatattcgataccacatttgaaaacaatgacctattaagtcaaaatgtagatgtagaggcaatactaacagataaaatcagcaaatcagcgaagaaagatcgtatactagccagatatcctaaccagaaatcaaccggaatattcgccgagttcctgaaactaatagttggaaaccaagcagacttcaagaaacacttcaacttagaagacaaaacaccccttcaatttgcaaaagatagctatgatgaagatttagaaaacctccttggtcaaataggagacgaatttgctgacctcttctcggctgcaaagaaattatacgattcggtattactatcaggcatactaaccgtaacggacttaagtacaaaagcaccgctatcggcctcaatgatacaaaggtacgatgaacacagagaagaccttaaacaattgaaacaatttgtaaaagcgtcattaccagaaaaataccaagaaatatttgctgactcaagtaaagacggatacgctggatacatcgaaggaaaaaccaaccaagaagccttttataaatacctatcaaaactattaacaaaacaagagggaagcgaatacctcttagagaaaatcaaaaatgaagactttttaaggaaacaaagaacattcgataacggatcgattccacaccaggtacatcttactgaactaagagctataattagacgtcaatcagaatattacccgtttttgaaagaaaacctcgataggatagagaaaatattaacattccggataccttattatgttggtcctctagcacgagaaaaatcagactttgcctggatgacacgaaaaaccgatgactctatacgaccttggaactttgaagacctggtagacaaagaaaaatcggctgaagcattcatacacagaatgacaaacaatgacttatatctcccagaagaaaaagtactccctaaacattcacttatctatgaaaaattcactgtgtataacgaactcacaaaagtgcgatttcttgcagaaggatttaaagacttccaatttttaaaccgcaaacaaaaagaaacgatatttaattcattattcaaagaaaaacggaaggtcaccgaaaaagacataatttcttttctaaacaaagtcgatggatacgaggggatagccattaagggcatagaaaagcagttcaacgcttcactctcgacataccatgacctaaagaaaatactgggaaaagactttctagacaacacagataatgaactcatactagaggacatcgtacaaaccctaaccctatttgaagaccgcgaaatgatcagaaagagattagacatatacaaagatttctttacagaatcacaactgaagaaactttacagaaggcactacaccggttggggaagattatccgccaaattaataaacgggattcgaaacaaagaaaaccagaaaactattctcgattacttaatagatgacggatcggcaaaccgaaacttcatgcaattaattaaagacgcaggattatcctttaaaccgataatagataaagcaagaactggatcacactcagacaatcttaaagaagtagtaggtgaattggctggatcccctgcaatcaaaaagggaatacttcagtcactcaaaatagttgatgaactcgtcaaagttatgggatacgaacctgaacaaatagttgtagaaatggcccgagagaatcagactacagcgaaaggtttatctcgccttagacaacgacttacaacccttcgagaatctttagcaaacctgaaaagcaatatactagaagagaagaagccaaaatacgtaaaagatcaagtagaaaaccatcatctaagcgacgacagactctttctatactacctacaaaacggcaaagatatgtacacagatgatgaattagacatcgataacttgagccaatacgatatagaccatattataccacaagcattcataaaagatgactcaatcgataacagggtcttagtcagctcagccaaaaacagaggcaaatcagacgacgttccatccgtagaaatcgtcaaagactgtaaagtgttttggaagaaactcctagatgcaaaattaatgagtcaacgcaaatatgacaatttaacaaaagcagaacgtggcggcttaacgtcagacgataaagcccgattcatccagagacaattggttgaaactaggcaaatcactaaacatgtcgcacgaatattagatgaaaggtttaacaacgaattagactcaaagggcagacgaataaggaaagtaaaaatagtcaccttaaagagcaacttagttagtaatttcagaaaagagttcggattctataagattagagaagtaaacaactaccaccatgcgcatgacgcttacttgaacgctgtcgttgcaaaagcgattcttactaaatacccacagctcgaacccgaatttgtatacggcgattacccaaaatacaactcatacaaaacacgaaaaagtgccacagaaaaactattcttttactcgaatattatgaatttctttaaaactaaagtaacattagcagacggaactgttgtagtaaaagatgatattgaagttaacaacgacacaggagagatagtatgggataagaagaaacactttgccaccgttcgaaaagtattatcatacccacaggtaaacattgtaaagaaaactgaaatacaaacagggggctttagcaaagagtcaatactagcacacggaaattcggataaattaatccccaggaaaactaaagatatctacctcgaccccaagaaatatggtggatttgattcaccaattgtcgcatattcagtattagttgtcgccgatatcaaaaagggtaaggcccaaaaactaaaaactgtaacagaattgcttggaataacaataatggaacgaagtagattcgagaaaaacccatcagctttcctagaatctaaaggatatctcaatattagggacgataaactaatgattttacctaaatatagcctcttcgaattagagaacggaagaagaagactattagcatccgcagacgagctacaaaaaggcaacgaactagccctacctacccaatttatgaaattcctgtatttagcaagtagatacaatgaattaaaaggaaaaccggaagaaatagaacaaaaacaagagtttgtagtacaacacgtctcctatttcgacgatatactacaaataattaacgacttcagtaatcgtgtcatactagcagatgccaacttagagaaaattaacaagttataccaagataacaaagaaaatatccccgttgatgaactagcaaacaacataataaaccttttcacatttacaagtctaggagcccccgcagcatttaaattctttgacaaaatagttgacagaaaacgttatacatcaacaaaagaagtattaaacagcactctgatccaccaatcaattacaggcctttacgaaaccagaatagatctgggaaaactaggagaagactga

SEQ ID NO: 5457 - RNA, 4113 nt, synthetic construct
  misc_feature 1..4113: note = Cas9 variant
  source 1..4113: mol_type = other RNA
atggaaaaaaacaaggaatatgtcatagggttagacataggcaccggatcagttggatggagcgcaatatctacagataactaccaactaatcagacaaaaaggaaaaaatttaattggcgtacgattatttaattcagctgaaacagcggaagaaaggcggggatatagaacgacgcgtagaagactaagtagaaggagatggaggatgagccttttaaacgatatatttagaccagaacttaacgaaatagacgagaattttttagcaagactaaaatattcctgggtaagcccccttgaccaaaaaaatccacagctaaacgaacaaggaaccaatgcatcactctatggagatatagaggcggatcaagcgtttcatcgggcatacccaaccatttaccacctacgaaaaacactcatggaagacaatcaaaaacacgacctaagagaagtatatttagcgatacatcatattgttaaataccgaggacacttcctgactcccgattttgacgctaatagtcaaacgatagatatcaaaggattatttaaacagcttggagacgtgtcagggtcgatagaattacaagcagatcaaacctctacagtaatagctgcctttcaatccatattgttagacttcaccaagacaccaaccgaatcaggcagactagcaggccaactcttctcagaccagaataaggataaacaggccaaaaagcaagtcgaagagttgttcaaactattaagaggagggaaaggatccttagcggacatgttcctccttacagacctagataaagtggttaaaaatcaacttaaattcgcattcgatgatgcagtagatgagaatcttaacttaatatctaatctcataaacgaagaacaatacgagcttttactcaacatacagaaactcagaggcacaatcatacttaaacaaatattaggagacgacgaaacagtatcagatgcaaaagtccgcagttatgaggaacacgctcatcaactaaaagaactaaaggcccaagtactaactaaagataataaagaaaaattcgaagaagcataccaattaatacaaaaaggcgatgcaagcaggatcgatggtctcaaaaagttaaaaacaatcataaaccaagaacacgaagctctaagactagataaatacgaagcagataaattactaaaattgatcgaactagaccaactattacctgtacagagatcgaaacgcaacggcgaaatcccacaccaactacacgaatttgaattaaaaaaaataatagaaaaacagggtagatattacccgttccttagagaaacatttgaacgcgacggacaagagttcaacaaaataggccaacttgttaactttagaataccttactacgtaggaccgttagtagacccaaggctcgctggtatccagtcgggggatcaaacaaatcactggatgacacaaaaaaaagcaggaaaaattacaccatggaactacactgagctcatcgatattgataaaagcgcagcagaattcataaaaagaatgacaggtacagatacgtatctagtaggagaaccatcattacataaagcaagtctcatataccaagactacaatgtactacaagaattaaacaacctcagatacgacggcaaaccacttccagtagacgcaaagcaagaaatctactcaaacctacaagtcagcttaaaaaatgcaaccaaaaataaaataaattcattcctcatctccgaaggatatctacaagacggtgaagaacttacaggatttgccggcaaagaattaaaaaataaactaagcagtttccactacttcaaaaacatattcggacctgaacgaatgaacacattaggtaccgacaacttggaaaaaatcacagagctacaaaccgtatttgaagacagacatatgctaaaaagacaacttcagaaactaggtttcctagacgacgacgaatgtgaaaaattagcaggaaaacatttcactggctggggcaatctcagcaaaaaattactaaatacaccggcgatcatagacccagaaataaacgagaataaaataagtttaatcgatgcattatataaaggacaaagaaacctcagtttttacgtaaataacatggacgacaaatatcaatttagggactggatagagtcagaaaaccaaagccaacaagtagaaatatccctggatgaaaaaattaaaaatttggcaggaagtccagctatcaaaagagggatcacacaaagcatggcagttatacaagatataattagggcaaataacggaatatcaccaaaaagaatttacctagaattcgcgagggaatcacaaaatagttatcaacccaattctagaattaaacaaatagaaaaaatatacgatcaaaacaaaaaagaactaatgaaagtctaccctgacgtatttaaggacgttcaaggggtattaaataatgtcgacgaaaataactccttatcagaaaaagcattcctgtacttcatgcaacttggaaaagatatgtatacaggtgaagcattggacttcgataaattatatacatatgacatcgaccatatcatcccacaagcaatgactaaagacaacagctgggacaataaagtattagtcacagccataaaaaaccgagagaaatcaaaccaagtactcgataacgcaatacaagcaaaaatgcacaatttctggcttcaactaaaaaaggttaacttactctcacagaggaaatatgacacattaatgaaaacaaatttcagcaagggagatgaaaaaaaattcattgcccgatcactagtggaaactagacaaataataaaaaacgttgcagaactaataaaatcggaatttgaccacgtagaagcaattccaattagacaagaacttacatcagacatgagacaattaatggattacaaaaaaaatcgacttgtaaacgattatcatcacgcgcacgacgcattgctaattgcaactgtaggcgaatttatgcaaaaacgaggtttcatgcaaggaatgaacccctcacaaaatgtttaccacggatacacacaatatgtcaaaaaatggctctccatggcaaaaaaggccagatcagcggaaaaacccgaaagaatttttccactacaatttgttgtagggtcaatgagaatggcagttagagatggacaagtggacaaagtaacacaccccgctacaggggaaatatgctggacagctgacaacgaagcttatctcaggaaagtactaggttataaaaatattttagtaacacgcaaggtaaaaaacgcaggaaaactgtatcaacgagtaaccgtaaagccaaaaggatcaggagaagcaccagtaaaccaccaaaaatcagacatcaacatttacggaggagtgacaagcgaacaagccgctgaactagtactaatacgaataaaagcaaagaataatgccaaaaatatggtaatcaaaatacctacagcgatcgccaaccaagttgcgaacaaaacgacaacttacgatgcatacgtgagatcacttaatatacctaactacgccggcataattttggatcaaattcccttgggacaactagtatttgatgagaggacttcattttacttagcaagtgcagaaattaaacataacgcccgacaactatgggttaaccaacatataaataacgtacttacgaaaaaaaatataaacgacgaagaaagagataatatactaaacctgctaaccaacgaaaaaaatctcgaaagatttaaacttctagaacccgacctaaaaagagtgaaagctgcgaaacaacaatgggcatcgtgtgacgatcaagaacaaatgcagattctaagaattattataaacaaaatgcacgatgacgcatcccctcaaataccaggtaaaatagatccatttaaaaattatctggataaacaaggtaaaggatggcgagaccttaggacgaaaaaaggcatgaaattatcagataatgcggaatttgtttaccaatccccaactggactatatcatcgcaaaatatcaataaatgaattactaaaacaaaaacaactagaatga

SEQ ID NO: 5458 - RNA, 4113 nt, synthetic construct
  misc_feature 1..4113: note = Cas9 variant
  source 1..4113: mol_type = other RNA
atgaacaaaccgtacagtataggtcttgatattggaacaaatagcgtcggttggtcaataattacagacgactataaagtaccagccaagaaaatgagagtactaggtaacacggataaagaatacatcaagaaaaatttaattggtgcattgttatttgacggcggcaacactgcagcagacagaagattaaaacgaacagcaagacgtcgatacactagaagaagaaaccgtatcctgtatctacaagaaatattcgcagaagaaatgtcaaaagtggacgacagctttttccaccgcctagaagatagttttctagttgaagaagataaaaggggatctaaataccctatattcgcaacgatgcaagaggaaaagtattatcatgaaaaatttcccacaatataccatctcagaaaagaactagctgataagaaagaaaaagcagatctaagactaatatatctagcactagcacacattataaaatttagaggacactttctaatcgaagatgatcgttttgacgtacgaaacacagatatccaaaaacaataccaagccttcttagaaatattcgataccactttcgaaaacaacgacctcttgtcgcaaaatgtagacgtagaagcaatattaacagacaaaatatccaaatcggccaagaaagaccgtattcttgctagatatccaaaccaaaaatccactggaatatttgcagagttcttgaaattaatagtgggaaatcaagcagattttaagaaacattttaacctagaagacaaaaccccactccaatttgcaaaagactcatatgacgaagatttagaaaatctacttggccaaatcggagacgaatttgcagatctattctcagcagccaagaaactatacgattcagtactgttatcaggaattttaacagtaacggatcttagcacaaaagctccactaagtgcatctatgatacaacgatacgacgaacaccgtgaagacctcaaacaactaaaacaatttgttaaagcctcgctaccagaaaaatatcaagaaatttttgcagactccagcaaagacggttatgcaggctatatagaaggaaaaaccaatcaagaagcgttttacaaatacttatctaaattattgaccaaacaagaaggtagtgaatacttgttagaaaagattaaaaatgaagactttcttcgcaaacaacgcacattcgataatggatccataccacaccaagtacacctaacagaactacgtgcaataatccgcagacagagcgaatactatcccttcttaaaagaaaatctcgatcgcatcgagaaaattttaacattcagaataccatactacgtaggtccactagcaagagagaaaagtgacttcgcatggatgactagaaaaacagacgactccataagaccatggaacttcgaagacctagtcgacaaagagaaaagcgcagaagcctttatacaccgtatgacgaataacgatttatacttaccagaagaaaaagtactccccaaacattcactaatatatgaaaaattcacagtatacaacgaactgactaaagtgagatttttagcagaaggatttaaagatttccaattcctcaaccgaaaacaaaaagaaacaatctttaatagtctattcaaagaaaaacgaaaagtaacagaaaaagatatcattagcttcttaaacaaagtagacggctatgaaggcatagcaataaaaggaattgaaaaacaattcaacgcatcactatccacataccatgacctcaagaaaatactgggaaaagatttccttgataatacagacaacgaattaatattagaagacatcgttcaaactttgacgctattcgaagacagagaaatgatcagaaaaagactagatatatataaagactttttcacagaaagtcagctcaagaaattatacagaagacactatacgggatggggtcgactatcagctaaactaatcaacggaatacgaaataaagaaaaccaaaagacaatacttgattatttaattgatgacggtagtgcaaatcgtaattttatgcaactcatcaaagatgctggtctatcgtttaaacctataattgataaagcaaggaccggatcccacttggacaacttaaaagaagtagtaggagaactagcaggatcaccagcaatcaagaaaggaatcctacagtccctaaaaatcgtagatgagctagtcaaagtcatgggttacgaaccggagcaaattgtggtcgagatggcacgtgaaaatcaaacaacagcaaaaggactatcaagatccagacagagacttacgacactaagagaatccttggccaatctaaaatcaaacatattagaagagaagaaaccaaaatatgtaaaagaccaagttgaaaatcaccacctatccgatgacaggttattcctctattatctacaaaatggtaaagacatgtacacagatgatgaactagatatagacaaccttagccaatatgatattgaccacattatacctcaagcattcataaaagacgattcgatagataatcgagtactggtatcttcagccaaaaacagaggtaaatcagatgatgtacctagtttagagatagtaaaagattgtaaagtattctggaagaaacttctagacgcaaaacttatgtcccaaagaaaatatgataatctaacaaaagcagaaagaggaggactgacgagtgacgacaaagcaagatttattcaacgacaactcgtcgaaacacgccaaataactaaacatgtggcaagaatcctggacgaaagatttaacaacgaactcgatagcaaaggaagacgaattagaaaagtcaaaatcgtgacactcaaatcaaacctcgttagtaatttcagaaaagagttcggcttctacaaaatccgagaagtgaacaactatcaccatgctcatgacgcatatctaaatgctgtcgttgccaaagcgatcttaacaaaatacccacaattagagcctgagttcgtctacggagactatcccaaatataactcatacaaaactagaaaatctgcaacggaaaaactatttttctactccaacataatgaactttttcaaaactaaagtaaccctagccgacggtactgtcgtggtgaaagacgacatagaagttaataatgacactggtgaaatagtatgggacaaaaagaaacattttgcaacagtcagaaaagtgttaagttaccctcaagtcaacatcgtcaagaaaacagaagttcagaccggtggcttttctaaagagtcgatattagcccacggcaatagcgataaactaatcccaagaaaaactaaagacatatacctagaccccaagaaatacggaggattcgattcaccaatagtagcatatagtgtacttgttgttgctgatatcaagaaagggaaagcacaaaaactgaaaaccgtaactgaactgctaggaatcactataatggaaagatcaagatttgagaaaaatcctagtgcatttttagaatcaaagggttatctcaacataagaacagataaattaataatactgcccaagtacagccttttcgagcttgaaaacggacgtagacgcctacttgcttcagcaggagaactgcaaaaaggcaacgaactcgcactacctactcaatatatgaaatttctatacttagcaagtcgctataacgaacttaaaggaaagcccgaagaaattgaacaaaaacaagagttcgtcgttcagcatgtaagctatttcgacgacatcttacaaataatcaacgacttttcaaatcgcgtaatattggcagacgcaaatctagagaaaataaataaactctatcaggacaacaaagaaaacatacctgttgacgaactagcaaacaatattataaacttattcacgttcacatctttaggggcaccagcagcattcaagtttttcgataaaatagtagacagaaaaagatatacctctacaaaagaggtcttaaatagcaccttaatccaccaatcaataacgggactatatgaaacacgcatagacttaggcaaactaggcgaaggatga

SEQ ID NO: 5459 - RNA, 4113 nt, synthetic construct
  misc_feature 1..4113: note = Cas9 variant
  source 1..4113: mol_type = other RNA
atgaacaaaccatactcgataggcctcgacataggcacaaatagcgtgggttggtcaataataacagacgactataaagtacctgctaagaaaatgagagtactcggaaatactgataaagaatacatcaagaaaaatttaataggagcacttctatttgatggaggtaataccgcggccgatagaagattgaaaagaactgcccgtaggagatacactagaagaagaaacaggatactatatttacaagaaatatttgctgaagaaatgtcaaaagtagacgactccttctttcatcggctcgaagattctttcttagtggaagaagacaaaaggggctctaaatatccaatttttgcaactcttcaagaggaaaaagattaccatgaaaaatttagcacaatctatcatctaaggaaagaattagcagacaagaaagaaaaagcagatcttagactaatatatatagcattagcacatataattaaatttagaggccactttctaattgaagatgactcattcgacgttcgtaatacagacatatccaaacaatatcaagactttctagaaatcttcaatacgacgttcgaaaataacgatctactttcacaaaacgtagatgttgaagctatcttaactgataaaatttcgaaaagcgcgaagaaagataggatccttgcacaatatccaaatcagaaaagcacaggcatattcgccgagttcttaaaactaatcgttggtaatcaagcagatttcaagaaatacttcaatctagaagataaaacacccctccaattcgcaaaagacagttatgacgaagacttagaaaacctacttggccaaataggagatgaatttgcagatctattttctgcagccaaaaagctatatgacagcgtattattatcaggaatattaacagttatagatttatcaacaaaagctcccctaagtgcaagtatgatccaacgatatgatgaacatagagaagacctaaaacaactaaaacaatttgttaaagcaagcctacctgaaaaataccaagaaatatttgcagacagttctaaagacggatatgctggatacatagaaggcaaaacaaatcaagaggcgttctataaatatctgtccaaactactcacaaaacaagaagacagtgagaatttcttagagaaaattaaaaacgaagatttcctacggaaacaacgaacatttgacaacggaagtataccacaccaagttcatcttacggaactaaaagctatcataagaagacaatccgaatattacccatttttaaaagaaaatcaagatagaattgagaaaatactaacgttcaggattccctattacataggtccactggcaagagagaaatcagattttgcatggatgacaagaaaaactgatgatagcatacgaccgtggaatttcgaagatcttgtagacaaagagaaaagcgctgaagcatttatacatagaatgacgaataacgatttctacctcccagaagaaaaagtgctccccaaacattcccttatctatgaaaaatttacagtatataacgaactcacgaaagtaagatataaaaacgaacaaggcgaaacatactttttcgattcaaatatcaaacaagaaatcttcgatggagtctttaaagaacataggaaagttagcaaaaagaaattattagacttcttggcaaaagaatacgaagaatttagaatcgtagacgtaattggactcgataaagaaaataaagcctttaatgcaagcctaggtacatatcatgacttggagaaaattttagataaagacttcctagataacccagataatgaatcaatattagaagatatagtacaaaccctaaccctatttgaagaccgtgaaatgatcaagaaaagacttgaaaactacaaagacctgtttacagaatcacaacttaagaaactttacagaaggcactacacaggatggggtagactatccgctaaactaataaatggaattagagataaagaatcccaaaagaccatattagattatctcatagacgacggtagatcgaataggaatttcatgcaattgatcaatgacgatggattaagtttcaaaagcataatatcaaaagcccaagcagggtcacattcggacaaccttaaagaagtagtcggagaactagccgggtcacccgcaataaagaaaggaatactgcaatccttaaaaatcgtagacgagctagttaaagtaatgggatatgaacccgaacaaattgtagtcgaaatggcacgagagaaccaaacaacaaatcaaggtagaagaaacagcagacaacgttataaattgcttgacgatggagtcaaaaacctagcatccgacctaaacggaaatatcctaaaagaatacccaacagataatcaagcgttacaaaatgaaagactatttttatactacttgcaaaacgggagagacatgtatacaggggaagcgctagacatcgacgatttatcacaatatgatatcgatcacataatcccccaggcttttataaaagacgactctatagataacagagttctagtatcatcagccaaaaatcggggcaaatcggacgatgttccatccctagaaattgttaaagactgtaaagtattctggaagaaactcctagacgcaaaactgatgagtcaaagaaaatacgataacttaaccaaagcagaacgaggaggactaacctcagatgacaaagcaagattcattcaaagacaacttgtagaaacgagacagataacaaaacatgtcgccaggatactagacgaaagatttaacaacgaattagattcgaaaggaagaagaataagaaaagttaaaatcgtcacactaaaaagtaatttagtttcaaatttcagaaaggaatttggtttttataaaatccgagaagttaacaattatcatcatgcccacgacgcatacctaaacgccgtggtagcaaaagcaatattaacaaaatacccccaattagaaccggaatttgtctatggagactatccaaaatacaattcatacaaaactagaaaaagcgcaactgaaaaattattcttttatagtaacattatgaacttctttaaaaccaaagtaaccctagcagatggaacagtagtcgtcaaagacgatatagaagtaaacaatgataccggagaaatcgtatgggacaagaagaaacattttgcaacagtacgaaaagttctatcctatcctcaaaacaatatagtcaaaaagacagaaatacaaacaggaggcttttctaaagaatcaattctagcacacggtaactcagataaactaatcccccgtaaaacaaaagatatatacctagatcctaagaaatacggcggcttcgatagtcccattgtcgcatactcagtactggtagtagcagatatcaagaaaggaaaagcacaaaaattaaaaactgttacagaactattaggaatcactataatggaaagaagtagattcgagaaaaatccatcagcattcttggaaagtaaaggctatttgaacataagagcagacaagttgatcatattacccaagtactccttattcgagctagagaatggtcgcaggcgattactagcgagcgctggcgaactacaaaagggcaatgagcttgcactaccaactcaattcatgaaatttctatacctcgcaagccgttataacgagtcaaaaggaaaaccggaagaaatagagaagaaacaagaatttgtaaatcaacatgtttcctacttcgatgacatactacagctcataaacgacttttctaaacgtgtcatactagcagatgcaaatctagaaaagataaacaaactataccaagataataaagaaaacatatcggtagacgaactagcaaacaacataattaatctgttcacattcacatcactaggagcgcctgcagctttcaaatttttcgacaaaatagtagacagaaagagatacacatcaacaaaagaagtattaaactcaacgctaattcatcaatcaataacaggtttatacgaaacacgcatagacttaggaaaactaggagaagattga

SEQ ID NO: 5460 - RNA, 4113 nt, synthetic construct
  misc_feature 1..4113: note = Cas9 variant
  source 1..4113: mol_type = other RNA
atgaacaaaccgtattctataggattagacataggaacaaatagtgttggttggtccataattacagacgattacaaagtaccagcgaagaaaatgagagtactcggtaacacggacaaagaatacattaagaaaaaccttataggagcattattattcgatggaggcaatacagctgcagaccgacgactaaaaaggaccgcaaggcgaagatacaccagaagaagaaaccgcatattatacttacaagaaatttttgccgaagaaatgagcaaagtagacgattcattcttccataggcttgaagatagcttcttagtagaagaagacaaaaggggaagtaaatatcccatcttcgccacattacaagaagaaaaagattaccacgaaaaatttagcacaatctaccacctaagaaaagaattagcagacaagaaagaaagagctgatctacgattaatatacatcgctctagcgcatataataaaatttagaggacatttcttaatcgaagacgacagttttgatgtaagaaatactgatataagtaaacaatatcaagactttttagaaatcttcaacactacttttgaaaataatgatctgctcagccaaaacgtagatgtagaagcaatactaaccgataaaatctcaaaatctgccaagaaagatcgcatattagcccaatacccaaaccagaaatctaccggaatctttgctgaatttttaaaattaatagtaggtaatcaagctgacttcaagaaatatttcaatttagaagacaaaactccacttcagttcgctaaagattcatatgatgaagatctagaaaacctattaggtcagattggagatgagttcgcagacctcttctctgcggccaagaaactatacgacagcgtattattatcaggaatattaacagtaatagatctaagcaccaaagcacccttatctgcatcaatgatacaacgatatgatgaacacagagaagacctaaaacaattaaaacaatttgtaaaagcctcactacctgaaaaataccaagaaatatttgccgattcaagcaaagacggctatgcaggatatattgaagggaaaacaaaccaagaggctttctacaaatacttatctaaattattaaccaaacaggaagactctgaaaacttcttagagaaaatcaaaaacgaagatttcttacgaaaacagaggacatttgataacggaagcattccccaccaagtacatttaaccgaattaaaagcaattattagacgccagtcagaatactatcccttcttaaaagaaaaccaagatcgaatcgagaaaattttaacctttagaatcccctattacataggacctctagcacgtgagaaaagtgactttgcctggatgacaagaaaaacagacgacagtatacgtccatggaactttgaagacctggtagacaaagagaaaagtgcagaagcgttcattcatcgaatgactaataacgatttttacctacccgaagaaaaagtacttccaaaacatagtctaatttatgaaaaattcacagtgtacaacgaactaacaaaagtccgatacaaaaatgaacaaggagaaacatatttctttgatagcaatataaaacaagaaatatttgacggagtgtttaaagaacatagaaaagtgagcaaaaagaaactccttgatttcttagccaaagaatatgaagaatttaggatagtagacgttattggactggataaagaaaacaaagcatttaacgccagtctcgggacatatcatgacttagagaaaatactagataaagactttctagataatccagacaacgaatcaatattagaagatattgtccaaacattaacactatttgaagacagagaaatgatcaagaaacgtttagaaaattacaaagatctgttcacagaatcacaactaaagaaactttacaggcgacattataccggatggggcagactctctgcgaaactaattaatggaataagagacaaagaatctcagaaaacgatacttgactacttaatagatgacggaagatcaaaccggaacttcatgcaattaataaacgatgacggtctatcctttaaaagtataatatcgaaagcacaagctggatcccacagtgataacttaaaagaagtagtaggggaactggcgggatcgccagcgatcaagaaagggatattacaaagtttaaaaatagtggacgaactggtcaaagtgatgggatatgaaccagaacaaatagtagtagaaatggcccgcgaaaatcaaacaactaatcaaggaagacgaaactcgagacaaagatataaattactcgacgacggggtcaaaaatttagcgagcgatctaaatggaaacatattaaaagaataccccacagacaatcaagcactacaaaacgaacgtctctttctgtattacctccaaaatggaagagatatgtacacaggagaagctctagacatagatgatctttcgcaatatgacatagaccatattataccacaagcattcattaaagatgacagcatagataatagagtattagtatcaagtgctaaaaatcggggtaaaagcgacgacgtcccctctctagaaatagtaaaagactgcaaagtattttggaaaaagctattagatgcaaaactaatgtcacaacgaaaatatgacaatctgacaaaagcagaaagaggagggctcacctcagacgacaaagcaagattcatacaaagacaattagttgaaactagacaaataacaaaacacgttgccagaatattggacgaaaggtttaataatgaattagactccaaagggagaagaatcagaaaagtaaaaatagtaacactaaaatccaacttagtcagtaacttcagaaaagaatttggattttacaaaatccgagaagtaaataattaccaccatgcccacgacgcttacctaaatgcggttgtagcaaaagcaattttaactaaatacccacaacttgaacccgaatttgtatatggagactatccaaaatacaatagttataaaacacggaaaagtgcaacagaaaaactcttcttctacagcaacatcatgaatttcttcaaaacgaaagtaacgctcgctgacggaacagttgtcgtaaaagatgatatagaagtaaataatgacactggtgaaatagtatgggataaaaagaaacactttgctacagtacgcaaagtactgtcatatccacaaaacaatattgtgaagaaaacagagattcaaaccggaggattttctaaagagagtattttagctcatggcaactccgataaactaattccaagaaaaacaaaagacatatatctcgatccaaagaaatacggcgggttcgacagtcctattgtagcttattccgtattagtagttgcagacattaagaaaggaaaagcacaaaaattgaaaaccgtaacagaattactaggaataacaataatggaaaggtcgcgctttgagaaaaacccatcagcctttttagaatcgaaaggatatctcaacatccgcgctgacaaattaataatacttccaaaatactcactattcgagttagaaaatggtagacgacgcttactcgcatcagccggtgaactccaaaaaggaaacgaattggcgctgcctacacagttcatgaaatttttgtacttagcatcccgatacaatgagagcaaaggtaaaccagaagaaattgagaagaaacaagagttcgtgaaccaacatgtctcatactttgacgatatactccaattaataaacgacttttctaaacgtgtcatattagcagacgcaaatttagagaaaataaacaaattatatcaagataataaagaaaatatatcagtcgatgaactagcaaataacataatcaacctattcacattcacaagtcttggcgctccagcagcattcaaatttttcgacaaaatcgtggatagaaaaagatacacaagcacgaaagaagttcttaatagtacattaatccaccagtcaattactggattatatgaaactagaatagatctaggaaaattaggcgaagactga

SEQ ID NO: 5461 - RNA, 4113 nt, synthetic construct
  misc_feature 1..4113: note = Cas9 variant
  source 1..4113: mol_type = other RNA
atgaacaaaccttacagtataggtttagatataggaactaacagcgtgggatggtcaataataaccgacgactataaagtaccagctaaaaaaatgcgggtattagggaatacagataaagaatacataaaaaaaaacctaataggagctttgttattcgacggcggaaatacagcttcagaccgaaggcttaaaagaacagccagacgacgatatacccgtaggcggaatagaatattatacttacaagaaatattcgctgaagaaatgtcaaaagttgacgactcattcttccaccgactagaagacagcttcctagtagaagacgacaaaagaggatccaaatatccaatcttcgctacaatgcaagaggaaaaagactatcatgaaaaattccccacaatatatcacttgcgcaaagaactagcagataagaaagagaaagcagaccttcgtctgttttatttagcattagctcatattatcaagtttagaggacactttttaatagaagacgactcctttgatgtgagaaatacagacatccaacgtcagtatcaagccttcttggaaatattcgatactacgttcgaaaataaccatctattatcacaaaacatagatgttgaaggaatcctaacagacaaaataagcaaatccgcaaaaaaagatcggatcctcgcacaatacccaaaccaaaaatccactggcattttcgccgaatttctaaaattaatcgtgggtaaccaggcagatttcaaaaaacacttcaatttagaagacaaaaccccactacaattcgccaaagactcatacgatgaagacctcgaaaacctcttaggacaaatcggcgacgaatttgctgacctgttttcagttgcaaaaaaactatacgatagtgtattgctttctggtatattaacagtaacagacctatccacaaaagcacccttaagtgcatcgatgatacagagatatgacgagcatagagaagatctaaaacaattaaaacaatttgttaaagcttccttacccgaaaaataccaagaaatctttaccgactcgagtaaagacggatatgcaggctacatagaaggaaaaactaaccaaggagccttctataaatatctatcaaaattattaacaaaacaagaaggatctgaatacttcttagaaaaaattaaaaatgaagactttcttcgaaagcaaagaacattcgataatggatccatcccacaccaagttcatttaaccgagttgaaagccataataagaagacaatcagaatactacccattcctaaaagaaaacctagaccgcattgaaaagatattaacgttcagaatcccatactacgtagggccattagcgcgagaaaaaagcgatttcgcatggatgacacgtaaaaccgatgactcaatacgaccatggaattttgaagaattggtcgataaggaagcaagcgcagaagcattcatacaccgaatgacaaataatgatctatacttaccagaagaaaaagtattaccaaaacatagcttaatatacgaaaaattcacagtatataatgaactcacaaaagtcagatataaaaatgaacaaggggagacatactttttcgacagtaacatcaaacaagaaatattcgacggagtattcaaagaacacagaaaagtgtccaaaaaaaaactacttgatttcctagcaaaagaatatgaagaattcagaatagtagacgtaataggcctagacaaagaaaacaaagcttttaatgcctctctaggcacataccatgatcttaaaaaaatcttagataaggactttttagataatccagacaacgagagcatactagaggatattgtccaaaccctcacgttatttgaagatagagaaatgataaaaaaaagactcgaaaactataaagacctgttcaccgaatcacaattaaaaaaattataccgaaggcattacactggttggggacgactctcagcaaaattaataaatggaataagagacaaggaaagccaaaaaactatattagactatctaatagatgatggtaaaagcaacagaaatttcatgcaattaatacacgacgacgggctaagcttcaaaagcattattagcaaagcacaagccggaagtcactccgacaaccttaaagaggtagtaggcgaattagccggctccccggccataaaaaaaggaatattacagtcattaaaaatcgtcgacgaactagtaaaggttatgggatatgaacctgaacaaatcgttgtagaaatggctagagaaaatcaaacaactaatcagggacgacgaaattcaagacaaaggtataaactactagatgacggagtcaaaaaccttgctagcgatttgaacggaaacatattaaaggaataccccacggacaaccaggccctacagaatgaacgactcttcctatactaccttcaaaacggcagagatatgtacacaggaaaggcattagacatcgacaaccttagccagtacgacatagatcacattataccgcaagctttcataaaagatgactcaatagataacagagtccttgtgtcgtcagcaaaaaacaggggaaaatccgacgatgtacctagtctcgaaatcgtaaaagactgtaaagtcttttggaagaaacttctagacgctaaacttatgagccaaagaaaatatgacaatctcactaaagcagaaaggggaggcctaacatcagatgataaagcaagattcatccaacgacaactagttgaaacccgacaaattaccaaacatgtcgctcgaattcttgatgaaagattcaataacgaattagattctaaaggtcgtcggataaggaaagtaaagatagtaacactgaaaagtaacttagtatcgaatttcagaaaagaattcggattctataaaattagagaagtaaataactaccatcacgcacacgacgcatacctaaacgcggttgtcgcaaaagcaatactcacaaaatacccgcaactagaaccagagttcgtatacggagactacccgaaatacaacagttacaagacaaggaagtcagcaacagaaaaattatttttttactccaatataatgaactttttcaaaacaaaagttactttggcagatggaacagtagtagttaaagacgacatcgaagtcaataatgacacaggagaaatcgtatgggacaaaaaaaaacacttcgcaactgttcgcaaagtattatcctatccccaagtaaatattgtaaaaaaaacagaaatacaaaccggaggtttcagcaaggaatcaatactagctcatggtaattccgacaagcttataccacgcaaaacgaaggatatatacctagacccgaagaaatatggaggctttgacagcccaattgtagcctattcagtactagtagtggcagatataaaaaaaggaaaagcacaaaaactaaaaacagtaaccgaattattaggcataacaataatggaaaggagccgctttgagaaaaatccttcagcatttcttgaatcaaaaggatatcttaacattagagatgacaaactcatgatcctaccaaaatactcactttttgaactagaaaacggaagacggagattactagcaagtgctggtgaattacaaaaaggaaacgaactagccctaccaacacaattcatgaaatttctatatcttgcgtctcgatataatgaacttaaaggtaaaccagaagaaattgaacaaaaacaagagttcgttgtccaacatgtctcttactttgatgacatcctacaaataattaacgacttctcaaacagggtaatcctcgctgatgccaatctagaaaaaataaataaattgtaccaggacaataaagaaaatataagtgttgacgaattagcaaacaatataattaatctcttcaccttcacatctcttggtgccccggcagcatttaaattcttcgacaaaatagtagatagaaaaagatacacatcaactaaagaagtacttaactcaacactgatacaccaatccataacaggtttatatgagaccagaatagacttaggaaaactaggcgaagactga

SEQ ID NO: 5462 - RNA, 4113 nt, synthetic construct
  misc_feature 1..4113: note = Cas9 variant
  source 1..4113: mol_type = other RNA
atgaacaaaccctatagcatcggattagacatagggacaaattccgtaggatggtcaataataacagatgactacaaagttccagctaagaaaatgcgtgtgcttggaaatacagacaaagaatatataaagaaaaatcttattggagcacttttattcgacggaggaaacacagcagcagatagaagacttaaacgtacagccagaagaaggtatacaagaagaagaaatagaatattatacttacaggaaatattcgctgaagaaatgagcaaagtagatgactcatttttccatcgactcgaagacagtttcttggtcgaagaagacaaacgaggaagtaaatatccaattttcgcaacaatgcaagaggaaaaatactaccatgaaaaattccccactatctatcatctaagaaaagagctcgctgacaagaaagaaaaagcggacttgcgcctaatatatctagcactagcgcatatcataaaattcagaggacatttcttgatcgaagacgacagattcgatgtcagaaacaccgacattcaaaaacaataccaagcatttcttgaaatcttcgacactacatttgaaaataacgacctattatcacaaaacgtagacgtagaagctatactaacagacaaaatcagcaaaagcgcaaagaaagaccgaatattagcaagatacccaaaccagaaaagcacaggcatatttgctgagttcctcaaactcatcgtcggcaatcaagccgactttaagaaacatttcaatctagaagataaaactcccttacaattcgccaaagattcatacgatgaagatctagaaaatttactaggtcaaattggagatgaatttgcagatttattcagtgcggctaagaaactatacgattcagttttactttcaggcattctaaccgtaaccgacttaagtacaaaagctcccctatcagctagtatgatacaacattacgatgaacatagagaagatttgaaacagttaaaacaattcgtaaaagcatccttgcccgaaaaataccaagaaatatttgcagattcatctaaagatggatatgctggctacatcgaaggtaaaacaaaccaagaagcattctacaaatacctgtctaaactacttaccaaacaggaaggctctgaatacctccttgagaaaatcaaaaatgaagatttcctaaggaaacaaaggactttcgataacggttctataccccatcaagtacatcttacagaactacgagccataatacgtagacaaagcgaatattacccatttttaaaagaaaacttagatagaatcgagaaaatacttacattccgaataccctattacgtgggaccactagctagagaaaaatcagattttgcatggatgacaagaaaaacagatgattcaattagaccatggaacttcgaagatctcgtagacaaagaaaaatcggccgaagcattcatccacagaatgacaaacaatgatctgtacttacccgaagaaaaagtattaccgaaacatagcctaatatacgaaaaatttacagtttataatgaattaacaaaagtacgatttctagccgaaggatttaaagattttcaatttcttaataggaaacagaaagaaactatattcaattcccttttcaaagagaaaagaaaagtaactgaaaaagacataatctcattccttaataaagtcgacggatatgaaggaatcgccatcaaaggcattgaaaaacaatttaatgcctcgctatctacatatcatgatctcaagaaaatactcgggaaagatttcttagacaatactgacaacgaattaatattagaagacatagtacaaacgctaactttgtttgaagacagagaaatgataagaaagagacttgacatatataaggatttctttacggaatcccaactgaagaaattatatcgccgacactacaccggctggggtagattatctgcaaaattaataaatggtattcgtaataaagaaaaccagaaaactatcttagattatttaatcgacgacggttcagccaacagaaattttatgcaactaattaaagacgcaggcctttcgtttaaacctataatagataaagcaagaacaggctcacatagcgacaatctgaaagaagtcgtaggtgaattagcgggctccccagcaataaagaaagggatacttcaatcattaaaaatcgttgacgaattagtaaaagtcatgggttacgaaccagaacaaattgtcgtagaaatggcaagggaaaatcaaactactgctaaagggctaagtagatcaaggcaacgcttaacaactctaagagaaagtctagccaatttaaaaagcaatatactagaagaaaagaaacctaaatacgtaaaagatcaagtcgaaaaccaccacctttcagatgatagactattcctatactacttacaaaatggtaaagacatgtacaccgacgacgaattagacatagataacctctcacaatatgatatagatcatataataccacaagcgttcattaaagatgattcaatagataatagggtattagtatcgtcggctaaaaatcgtggaaaaagtgatgatgtcccaagtgtcgaaatcgttaaagattgcaaagtattctggaagaaactgttagatgcaaaattaatgtcacaaagaaaatacgataacctcaccaaagcagaaagagggggattaacctccgacgacaaagccagattcatacaacgacaactcgttgaaacacgacaaatcaccaaacatgtcgctagaatactagatgaacgatttaataatgaactcgactcaaagggtagaaggataagaaaggtaaaaatagtcaccttaaaatctaatctcgtatcaaacttccgaaaagagttcggattttacaaaattcgagaagtcaataattaccaccatgcacatgatgcatacttaaatgcagtcgtcgccaaagccatcttaaccaagtaccctcaactggaaccagaatttgtctacggagactatcccaaatacaatagttataaaacccgaaaaagtgcgaccgaaaaattattcttttactcaaacatcatgaacttctttaaaacaaaggtcactctagcggacggtacagtcgtggtcaaagacgacatcgaagtcaacaatgacaccggagaaatagtgtgggataaaaagaaacattttgcaactgtacgtaaagtgttaagttacccacaagtcaacattgtaaagaaaacagaaatacaaaccgggggtttcagtaaagaatcaatcttagcgcatggaaattccgataaactgataccacgcaaaactaaagatatataccttgatccaaagaaatacggaggcttcgacagtccaatagtggcgtatagtgtattagtagtagcagatataaagaaaggaaaagctcaaaaacttaaaacagtaactgaactactaggtataacaataatggaacgttcacgattcgagaaaaatccatcagcattcctcgaaagcaaaggctacctaaacattcgtgatgataaacttatgatcctaccaaaatatagcttatttgaactagaaaacggccgacgcagactactcgcatccgcgggtgagcttcaaaaaggtaacgaactagcattaccaacccaatttatgaaattcttatacctagcatctagatacaacgaacttaaaggcaaacccgaagaaatcgaacaaaaacaagaatttgtagttcaacatgtcagttatttcgatgatatattacaaataataaacgactttagcaatagagtaatcttagcagatgcgaacctcgagaaaataaacaaactataccaggacaataaagaaaacattccagtagacgaactagcgaataacataattaacctcttcacttttacttctcttggtgctccagcagcgtttaaattcttcgacaaaatagtagataggaaaaggtacacaagtacaaaagaagtattaaacagcacacttatccatcaaagcatcacagggctttatgaaacacgaatagacttaggaaaactaggagaggactga

SEQ ID NO: 5463 - RNA, 4116 nt, synthetic construct
  misc_feature 1..4116: note = Cas9 variant
  source 1..4116: mol_type = other RNA
atgaaagtaaataattatcatataggattagatattggcacatcatccatcggttgggtagcaataggagaagacggaaagccactccgcatcaaaggaaaaactgctataggagcacgcctattccaagaaggtaatcctgccgcagatcgtagaatgttcaggaccacacgacgtaggttaagcagaagaaaatggcgtctaaaattactagaagagatattcgatccttatataacaccagtcgacagcaccttttttgctagactgaaacagagcaacctaagtccaaaagattccaggaaagaattcaaaggcagcatgctctttccagacctcacagacatgcaataccacaaagactatccgacaatttatcatctacgacacgcattaatgactcaagacgaaaaattcgatatcagaatggtatacttagccatacatcatatagttaaatacagaggcaattttttaaattctactccagtggactcttttaaggcatcaaaagtcaacttcgtagaccaatttaaaaaattaaacgagttatacacagcgatcaacccagaagaaagtttccagataaatctcgcaaacagcgaagatattggacaccaatttctcgacccaagcatacgaaaattcgacaaaaaaaaacaaattccaaaaatagtaccggtatcggtagatgacaaagccactgacaagataaatggaaagattgcgagcgaaataataaacgcaatactcgggtacaaatcaaaactggatgtagtagttcaatgtacaccggtagattcaaaatcatgggccttgaaattcgacgaagaagacattgacgcgaaactacaaaaaatactcccagagatggatgaaaatcagcaatcaataatagcaatattacaaaacttatacagccaagtaacgttaaaccaaatagtaccaaatggcatgagcctatcagaaagtatgatagaaaaatataacgatcaccacgatcatttaaaactgtataaaaaaataatagatcaactagccgacccaaaaaaaaaagcagccttgaaaaaagcctacagtcaatatgtaggtgatgatggaaaagtaatcgaacaagctgacttttggagcagcgttaaaaaaaatctagatgactctgatttatcgaaacagatcatggatttgattgacgcagaaaaattcatgccaaaacaaagaacaagccaaaatggcgtaataccacatcaactacaccaacgcgaattagacgaaattatagaacaccaaagcaagtattacccgtggttagcagaaataaatccaaacaaacatgacctacatttagcaaaatacaaaatagaagaattagtagccttccgagtgccttactatgtaggtccaatgataactccggatgatcaagcaaaatctgcggaaactgttttctcctggatggaaagaaaagggaaagaagccggacaaattacaccatggaactttgatgaaaaggtagacagaaatgcatcagcgaatagatttattaaaagaatgacaacaaaagatacttatctcataggtgaagatgtactaccagacgaaagcttgttatatgaaaaatttaaagtcttaaacgaactgaatatggtccgtgtaaatggaaaactgcttaaagttgcggacaaacaagcaatatttcaggatttattcgaaaactataaacatatatcggtaaaaaagctacaaaactatataaaatcaaaaaccggtctaccaagtgatcccgaaatatcaggactctcagatcccgaatactttaacaactctttgggaacatacaatgatttcaaaaaacttttcggaaataaagtagatgaacccgacctccaggacgactttgaaaaaattgtcgaatggtcaactgtgttcgaagacaaacgaattcttcgagaaaaattaaacgaaattacctggcttagtgaccaacaaaaagatgtattagaaagttcaagataccaagggtggggacgattgagcaaaaaacttctcaccggaatcgtaaacgaccaaggagaaagaataatagacgaactatggaacacgaacaaaaatttcatgcaaatacaaagtgataacgactttgcaaaacgtatacatgaagcaaacgccgatcaaatgaaagccgtagacgtagaagatgtcctagcagacgcatatacaagcccacaaaataaaaaagccataagacaggtagttaaagtggtagacgatatacaaaaagcaatgggcggagtagcccccaaatacatatctatagaatttacccgttccgaagatcggaaccccagacgtacaataagtagacaaagacaactagaaaacacgctcaaagatacggctaaatctctagcaaaatcaataaatcctgaactattgagtgaacttgataacgctgctaaatccaaaaaaggtttaacggaccgactatatttatactttacacaattaggtaaagatatttacacaggaaaaccaataaacatcgatgaaataagcacatacgacatagatcacatacttccccaagcgttcgtaaaagacgactccttaaataacagagtactagttagtaaagcaataaataacggtaaatctgataatgtacccgttcaactttttggtgcaaaaatgggacatttctggaaacaactagccgaagccgggttaatatccaaaagaaaactaaaaaatctacaaactgacccagacaccatctcaaaatatgccatgcacggattcattaggagacaacttgttgaaacaagccaagtaataaaactcgttgcaaacatactaggagacaaataccgtaatgacaacactaaaattatagaaataactgcgagaatgaatcatcaaatgcgtgatgaattcgggtttattaaaaacagggaaataaacgactaccaccacgcatttgacgcctatctaacggcatttttggggagatacctatatcacagatatatcaaactacgaccatatttcgtctacggagattttaaaaaatttaaagaagacaaagttacaatgcgaaattttaattttctacacgacctaactgatgacacgcaagaaaaaatagccgacgccgaaacgggagaagtaatatgggacagagaaaatagcatccaacaactaaaggatgtataccattataaatttatgctaatcagtcatgaggtctataccctccgtggggccatgttcaatcaaacagtttacccagcttcagacgcaggtaaaagaaaactaattcccattaaagctgatagacctataaacgtatacgggggatattccggctccgctgatgcttacatggcaatagttaggatacacaataaaaaaggggataaatatagagtagtaggtgtcccaatgcgagccagagacaggctagacgctgccaaaaaagtttcagatgctgactgcgacagagcattgaaggatgtacttacgccacaactaacaaaaacaaaaaaatccagaaaaacgggagaaatcacgcaggtcgttgaagattttgagatagtcttgggaaaagtcatgtataggcaattaatgattgacggtgacaaaaaattcatgcttggatcatcaacgtaccaatacaacgccaaacaacttgtattgtcagatcaatcggtcaaaacactagcttcaaaaggaagactagatccgctccaagaatcaatggattataacaatgtttacacagaaatattagataaagttaaccaatatttctctctatacgacatgaacaagtttagacataaactaaacttgggattctcgaaattcatttcgtttcccaatcataacgtatttgacggtaacacaaaagcatcatcaggaaaaagagaaatcctagaagaagtattaaatggactccacgcaaacccaaccttcggaaatcttaaagacataggtatcaccacaccattcggtcaattacaacaacccaacggtatccttcttagcgatgaagcaaaaatacgttaccaatcaccaacaggtctatttgagcgtactgtatccttaaaagatctatga

SEQ ID NO: 5464 - RNA, 4116 nt, synthetic construct
  misc_feature 1..4116: note = Cas9 variant
  source 1..4116: mol_type = other RNA
atggacaaaaagtacagtataggcctagatataggaacaaatagtgtaggatgggccgtaataacagacgactataaagtgccatcaaagaaattcaaagttctaggcaataccgatagacattctataaagaaaaacctaataggcgctttactcttcgattcgggagaaaccgcggaagcgacacgactaaaaagaacagcccgcaggcgctatactagaaggaaaaaccgaatccgatatctacaagaaattttctcatctgaaatgagcaaagtcgacgactcattctttcacagattagaagaatcatttttagtagaagaagataagaaacatgaaagacatcctatatttggaaacattgtagacgaagtcgcctatcatgaaaaatacccaacaatatatcatctccgtaagaaattagccgattcaacagataaagcagacctacgactaatatatcttgctttagcacatatgataaaattcagaggacatttcctaattgagggcgacctgaaccccgataacagcgatatggataaattattcatccaacttgttcaaacatacaatcaactgttcgaagaaaatccaataaacgcatctagagttgacgcaaaagccatcctttcagcaagattatcgaaaagtcgacgacttgaaaatcttatcgctcaactacccggagagaaaagaaatggattatttgggaatctaatagcactatccttaggtctaacaccaaactttaaaagtaacttcgatttagctgaagacgcaaaattacaactttcaaaagatacatatgatgacgacctggacaacctattagctcagatcggtgatcaatatgcagatctatttcttgctgctaaaaacctgtccgacgcaattttactaagtgacatactaagagtaaactctgaaataacaaaagctcccctttccgcctctatgatcaaaagatacgacgaacaccatcaagacctaacactactcaaagcattagtaagacaacaactcccggaaaaatataaagagatcttctttgaccaatctaaaaacggttatgctggttatattgacggtggagcgtcacaagaagagttctacaaattcataaaaccaatattagagaaaatggatggaactgaagaattattagctaaactcaatcgtgaagacctacttagaaagcagagaacattcgacaacgggtcaataccacatcaaatacatctaggcgaattacatgccatactaagacggcaggaagatttttatccattcctaaaagacaacagagagaaaatagaaaagattttaacattcagaataccctattatgtaggaccactcgcaagaggcaactcgagattcgcatggatgacacgtaaaagtgaagaaaccatcacaccatggaactttgaagaagtagtagacaaaggagccagtgcccagtctttcattgaaaggatgacaaatttcgacaaaaacctaccaaacgaaaaagtactacctaaacattcgctattatatgaatattttaccgtatacaacgaattaactaaagtaaaatatgtgacagaaggtatgcgtaaaccagaatttttatcgggtaagcaaaaagaagcgattgtagacctcctatttaaaacaaatagaaaagtaacagtaaaacaacttaaagaagattactttaagaaaatagaatgcttcgacagtgtagaaatatccggagtagaagaccgttttaacgcaagtctaggtacataccatgacttattaaaaattataaaagacaaagactttcttgacaatgaagaaaatgaagacatccttgaagatatcgtattaacgcttacgctatttgaagataaagaaatgatagaagaacgcctaaagaaatatgcaaatttattcgacgacaaagtgatgaaacaactaaaacgtagacattataccggctggggaagactttcacgaaaattgattaatggaataagggacaaacagtccggaaaaacaatcttagactttctaaagagtgacggcttcgccaaccgaaactttatgcaattaataaacgacgattctttgacctttaaagaggcaatacagaaagcacaagtatcaggtcaaggccactcattacatgaacaaatagcaaacttagccggcagccctgccataaagaaaggaatactacaaagcgttaaagtagtggatgagctagtcaaagtcatgggacacaaacccgaaaacatagtaatcgagatggctagagaaaatcaaactacccagaaaggacagaaaaattcacgtgagcggatgaaaagaatagaagaaggaataaaagaactcggatcacaaattttaaaggagcaccctgtagaaaacactcaattacaaaacgaaaaattatatctgtactatctacaaaatggacgagacatgtatgttgaccaagaattagacataaatcgactaagcgactatgacgtagaccatattgtaccacaatcattcataaaagacgattcaatagataataaagtactcacacgatcagacaaaaacagagggaagtcagacaatgtaccctcagaagaagtagtcaaaaagatgaaaaattattggagacaactgttaaacgccaaattaataacacaaagaaaatttgacaacctaactaaagcagaaagaggaggactaagcgaactcgataaagcaggttttataaaacgccagctagtagaaacacgacaaataacaaaacatgttgctcaaattttggactcacgcatgaacaccaagtatgacgaaaacgataaactcatcagagaagttaaagtaatcactctaaagtctaagctagtatcagattttcgtaaagacttccaattttataaagtccgtgaaataaacaattatcatcacgcccacgacgcatacttaaatgcagttgttggtaccgccttaattaagaaatacccaaaactcgaaagcgaatttgtatacggcgactataaagtctacgatgttagaaaaatgatagctaaaagcgaacaagagatcggcaaagcgacagcaaaaagattcttttactcaaatatcatgaatttctttaaaaccgaaataacgcttgcaaatggagagataagaaaacgtccacttatagaaacaaacgaagaaactggggaaatcgtgtgggacaaaggaagagactttgctacagttagaaaagttctaagcatgccacaagttaatattgtgaagaaaactgaagtacaaaccggagctttaacaaacgaaagcatatacgcaagaggatcatttgacaaactaatatccagaaaacacagattcgagtcatctaaatatggtggattcggaagcccaacagtcacatactcagtactggtagtagcaaaaagcaaagtacaggatggcaaagttaagaaaattaaaacaggtaaagaactaatcggaatcacgttattggataaattggtatttgagaaaaatcctcttaaattcattgaagataaaggatacggcaatgtacaaatagataaatgtataaaactcccaaaatatagcttattcgaatttgaaaatggaactagaagaatgctagcaagtgtaatggctaacaacaatagcagaggagatttacaaaaagcgaatgaaatgttcctaccagcaaaactcgtaacactactctaccatgcacataaaatagaatccagcaaagaattagaacatgaagcatatatattagaccactataacgacctctaccaacttttaagttacatagaaaggttcgcaagtctgtacgtagacgtagagaaaaacattagtaaagttaaagaactattcagcaatatagaaagttacagcatctcagaaatctgctctagcgtaattaatctactaacgctaacagccagtggtgcgcctgctgatttcaaattcctaggaacaaccattcctagaaaaagatatggaagtccacaaagtattttatcatctaccctaattcatcaatcaataacaggactatatgaaacgcgaatagatctaagccaactaggaggggactga

SEQ ID NO: 5465 - RNA, 4116 nt, synthetic construct
  misc_feature 1..4116: note = Cas9 variant
  source 1..4116: mol_type = other RNA
atggacaagaaatacagcataggtctagacattggaacgaactctgtaggatgggcagtgattacagacgactataaagttccatctaagaaatttaaagtgctaggcaacactgatcgacatagtataaagaaaaacttaatcggcgccttgctattcgactctggcgaaaccgctgaagcaacaaggctaaaaagaacagcaagaagaaggtacacaagaaggaaaaacagaatcaggtatctacaagaaatcttttccagcgagatgtcaaaagtagacgatagtttcttccatcggcttgaagaatctttccttgtagaagaagacaagaaacatgaaagacatcctatttttggaaatattgtggacgaagtagcataccacgaaaaatatcctaccatttaccatttacgaaagaaattggcagatagtacagataaagcagatttaagattaatatatctagctttagcccacatgatcaaatttagaggacactttctaatagagggagacctaaatcccgacaatagcgacatggacaaactattcatacaattagtccaaacatacaaccaattattcgaagaaaacccaataaatgcgtcacgtgtagatgctaaagccatccttagtgcaagattatcaaaaagcagaagattagaaaacctaattgcacaactgccaggtgagaaaagaaacggactttttggaaacctaatcgcactgtctttagggctcacaccaaatttcaaatcaaatttcgacctggcagaagacgccaaattacaactatctaaagatacatacgatgacgaccttgataacctactagcacaaataggtgatcaatatgcggacttatttttagctgcgaaaaatttatcagatgcaatactgttaagtgacattttaagagtaaactctgaaataacaaaagcaccattaagcgcatcaatgataaaaagatacgacgaacatcaccaggacctaacactactaaaagccctagtaaggcaacaactaccagaaaaatataaagaaatatttttcgaccaaagtaaaaatggatacgccggatatattgatggaggagcatcccaagaagaattttacaaatttataaaacccattttagagaaaatggacggtaccgaagaactattagcaaaattaaatagagaagatttgcttcgaaaacaaagaacttttgacaacggctctataccgcatcaaatacatctaggtgaattacatgctatattaagacgccaagaagatttctatccatttcttaaagataacagagagaaaatagagaaaatactgacatttagaataccttactatgtaggcccacttgctaggggtaattcacgattcgcatggatgacaagaaaatccgaagaaacgataacaccatggaactttgaagaagtcgttgacaaaggcgcctctgcacaatccttcatcgaaagaatgacaaattttgataaaaacctaccaaacgagaaagtgttacccaagcactctctcttatatgaatactttaccgtctacaatgaactcacaaaggtaaaatatgtcacagaaggaatgcgaaaaccagaatttctatcagggaaacaaaaggaagctatcgtcgatctcttattcaaaacaaacagaaaagtcacagtgaaacagttaaaggaagactattttaagaaaatagaatgttttgacagcgtcgaaataagtggagtcgaagatcgattcaatgcatcacttggcacatatcacgatcttttaaaaatcataaaagacaaagattttctcgataacgaagaaaatgaagatattcttgaggacattgtactaacattaacactattcgaagacaaagaaatgatcgaagaacgactaaaaacctacgctcatctattcgatgataaggtcatgaaacaactaaaaagacgacattacacaggatggggaaggctatcaagaaaattaattaacggaataagagacaaacaatcaggaaaaacaatattagactttctcaaatcagatggatttgctaatcgtaatttcatacaattaatacacgacgattcactcacgttcaaagaagctatacaaaaagctcaagtctccggtcaaggacacagtctacacgaacaaatagcaaacctagcaggaagtcctgccataaagaaaggaatcctacaatcagtgaaagtagttgatgagctcgtaaaggtaatgggacataaaccagaaaacatagtcatcgagatggcaagagaaaaccaaacaacacaaaaaggacagaaaaattcaagagaaagaatgaaaagaatagaagagggcataaaagaactagggtcgcaaatactaaaggaacaccctgtggaaaacacacaactacaaaacgaaaaactatacttatactaccttcaaaacggcagagatatgtatgttgatcaagaacttgatataaaccgcctaagtgattatgacgttgatcatatagtcccacaatccttcatcaaagacgattccatagacaataaagtacttacaagaagcgacaaaaatagaggtaaatcagacgacgtgccatctgaagaagttgtgaagaaaatgaaaaactactggcgacaattgttaaacgcgaaactcatcacacaaagaaaattcgacaatcttaccaaagcagaaagagggggattatcggaactagacaaagcaggcttcatcaaaagacagcttgtagaaaccagacaaatcactaagcatgttgctcaaatcttggactcgaggatgaatactaaatacgacgagaacgataaactgattagagaagtaaaagtaataactctaaagtctaaattagtgagtgacttcagaaaagactttcaattctataaagtaagagaaataaataattaccatcacgctcatgatgcatatttaaacgcagtagtagggacggcattaataaagaaatatcccaaattagaatcagagttcgtctatggtgattataaagtatatgacgtcaggaaaatgattgcaaaaagcgaacaagaaattgggaaagcaactgcaaaacgtttcttctactcaaacataatgaatttctttaaaaccgaaatcactctcgcaaatggagaaatccgaaaacgaccactaattgagactaatgaagaaacaggagaaattgtgtggaacaagggacgcgacttcgccaccgtaaggaaagtactaagtatgccccaagtaaacatcgtaaagaaaacagaagttcaaacaggagctttaactaacgaatcgatatatgcgcgtggatcatttgataaattaatttcaagaaaacatcgatttgaatcgagcaaatacggaggatttggaagcccaacagtcacatattctgtattagttgtagccaaatcaaaagtccaagatgggaaagtaaagaaaatcaaaaccggaaaagaattaatcgggattacattactagataaacttgtattcgagaaaaacccactaaaatttatagaagataaaggatatggaaacgtccaaatagataaatgcataaaactaccaaaatatagtttatttgagttcgaaaacgggaccagacgtatgctcgcctcggtaatggctaataacaattcaagaggcgacttacagaaagccaatgaaatgttcttaccagcgaaattagtcacactactgtaccacgcccacaaaatcgaatcctcaaaagaactggaacacgaggcttacatccttgaccactacaacgacctgtatcaactactatcttatatcgaacgattcgcatcattatacgtagacgtcgaaaagaacataagcaaagttaaggaattgttctctaatatagaaagttactctatatcagaaatctgttcgagcgttataaacttactgacattaacggcatcaggagcacccgcagacttcaaattcttaggaaccacgataccacgaaaacgatacggatcaccgcaatcaattttgtcatcaacactaatacaccaatcaataactggcctctatgaaactaggatagatttatcccaactaggaggagactga

SEQ ID NO: 5466 - RNA, 4116 nt, synthetic construct
  misc_feature 1..4116: note = Cas9 variant
  source 1..4116: mol_type = other RNA
atgaacaataacaactatagtataggcctagacataggcacaaacagtgtaggttgggcagtaataacggatgactataaagtaccaagtaaaaaaatgcgcgtactgggaaatacagacaaacgtttcatcaagaagaatctaataggcgctctcctattcgatgaaggaaccacagcagaagacagaagattaaaaagaacagcacgccgacgatatactagaaggaaaaacagactaagataccttcaagaaatcttcgctgaagaaatgtctaaagtcgattctagtttctttcacagacttgatgacagttttctagttccagaggataagtcaggttctaaatatcctatctttgcaaccttggctgaagaaaaagaataccacaaaaaattcccgactatataccatctaagaaaacacctcgccgattcaaaagaaaaggcagatctaagactaatatatctagcgctagctcacattaccaagtaccgcggccatttcttgtacgaagaagcctttgatattaaaaacaacgacatccagaaaatatttaacgaattcatcaacatatatgataatacattcgaaggctcttcactttctgggcaaaacgcccaagtagaagcaattttcaccggcaaaataagcaaatccgtaaaacgagaacacgtactaaaattgtttccggatgaaaaatcgaccggactattttcagagttcttaaaactgatagtaggaaaccaagccgatttcaagaaacatttcgacttggaagaaaaagcctcactacaatttagcaaagatacgtatgatgaagatctggaaaatctactcggacaaataggcgacgactttgccgacctattcctggtagccaaaaaattatatgacgcaatcctcctatccggaatcttaacggtaaccgatccatccacaaaagctcccttaagtgcctcaatgatagaacgatatgaaaaccatcaagaagacttagccgcccttaaacaattcatcaaaaacaacttaccagaaaaatacgcggaggtttttagcgaccagtccaaggatggctatgccggttatatagacggcaagactactcaagaagccttttacaaatatattaaaaatttattatccaaattcgaaggcgcagattactttctagacaaaatagaaagggaagacttcctacgaaaacaacggacctttgacaatggtagtataccccaccaaatacacctccaagaaatgaacgcgatactaaggcgacaaggagaacactatcccctactaaaagaaaataaagaaaaaatagagaaaatattgacattccgaataccatattacgtaggaccactagcaagaggaaacagggatttcgcttggttgacaagaaacagcgaccaagctatcaggccctggaatttcgaagaaattgtcgataaagccagttcagcagaatcttttataaataaaatgacaaattatgacctatacctacctgaagaaaaagtattacctaaacatagtctcttatatgagacattcgctgtatataacgaactaactaaagttaaatttatagcggaaggcctaagagattaccaattctttgactcaggccaaaaaaaacaaatcgtaaaccaattgttcaaagagaaaagaaaagtaaccgaaaaagatattatacattacctacataatgtcgacggttacgacggaattgaactgaaagggatagaaaaacaattcaacgcaagtctatcaacctatcacgatctattaaaaataataaaggacaaagaattcatggataaccataaaaaccaagaaatcttagaaaatatagtacacaccctaacaatattcgaagaccgagaaatgattaaacaaaggctcgcacaatacgattccatattcgacgaaaaagtaataaaggcgcttacaagacgccattataccggatggggaaaactcagcgcaaaattgatcaatggaatttgtgataaaaaaacaggcaaaaccattttagactacttaatagacgacggttataacaaccgaaattttatgcaattaataaatgatgatggcttatcattcaaagaaatcatacaaaaagcccaagtagttggaaaaacagatgacttaactcaagttgttagagagctatcgggaagtccagccataaaaaaagggatcttacaatcgatcaaaatagtagatgaactagtgaaaataatgggttacgcaccagaaagcatagtcattgagatggccagagaaaaccaaacaactgcaaaaggaaaaaaaaactcacaacaaagatataaacggatagaagatgcattaaaaaacttagccccaggtctcgattcaacgatttcaaaagaaaatccaacagataacatacaactacaaaatgaccgactttttctttactacttacaaaacggaaaagacatgtacaccggagaggcacttgacataaatcagttatcctcgtacgacatagaccatataatacctcaagcatttatcaaagacgactccctagacaatcgtgtcctcacatcttctaaagataatagaggcaagagcgataacgtaccatcactagaggtagtaaaaaaaagaaaagcattttggcaacaactactggactccaaactaatatcagaaagaaaattcaacaacctaactaaagcagaacgcggaggactagatgaaagagacaaagtaggttttatcaaacgccagctagtagaaacaaggcaaataacgaaacacgttgcgagaatactagatgcacgatttaacacagaagtatcggaaaaaaatcaaaaaattagatcagtaaagatcatcaccttaaaatcaaatttagtgagtaatttccgaaaagaattcaaattatataaagtaagagaaataaatgattatcatcatgcacatgacgcatatctaaatgcagtagttgccaaagctatactaaaaaaatacccaaaattagaacccgaatttgtttacggagattaccaaaaatacgacctaaaacgatacatctcaaaatcgaaagaccctaaagaagttgagaaagcaacagaaaaatattttttttacagtaaccttcttaacttcttcaaagaagaagtgcactacgcagacggaacaatcgtaaagagggaaaatatagaatactcaaaggatacaggcgaaatagcttggaataaagaaaaagacttcgtgactatcaaaaaagtactatcataccctcaagtaaacattgtcaaaaaaagagaagtacaaacaggtggattctcgaaagaatcgatacttccaaaaggcaattccgataaactaataccgcgaaaaacaaaagacatactatgggacaccacaaaatatggaggatttgactctccagtaatagcttacagtatcttactcattgcagacattgagaaaggtaaagcaaagaaactaaaaacagtgaagactctagtaggcatcacaataatggaaaaagccgcctttgaaaaaaaccccataacgttcttagagaataaaggatatcataatgttagaaaagaaaacatactatgcttaccaaaatatagcctatttgagctagaaaatggaagaagaagactgttggctagcgcaaaagaattacaaaaaggaaacgaaattgtacttcctgtctatctaacaaccttattatatcactcaaaaaatgttcacaaattggacgaaccagaacacctggagtacattcaaaaacacaggtacgaattcaaggatcttttaaatttagtctccgaattttcacaaaaatacgtccttgcagaagcaaatttagaaaaaataaaatccctatacgtcgataatgaacaagccgatatcgaaatcctcgcaaactcgttcataaatctacttacatttacagccttaggcgctcctgccgcatttaaatttttcggtaaagacgtagacagaaaaagatacaccacggtttcagaaattctaaacgccacactaatacaccaatcaataacaggcttatatgaaacccggatagatctttcaaaactaggcgaagattga

SEQ ID NO: 5467 - RNA, 4116 nt, synthetic construct
  misc_feature 1..4116: note = Cas9 variant
  source 1..4116: mol_type = other RNA
atgacagagaaaaactactctataggtctagacatcggaacaaactctgtaggatgggcagtaataacggatgactataaagtgcccgccaagaaaatgaaagtactaggtaacaccgataagaaatacatcaagaaaaatttattaggagcactactgttcgacaatggagaaaccgctgaagcgacgcgactaaaaagaacagcacgacgcaggtacacccgaaggaaaaatcgactaagatatctgcaggaaattttcgcagaagaaatggcaaaagtagacgagagcttcttctaccgtcttgacgaatcattcctaacaacagacgacaaagatttcgaaagacacccaatattcggaaacaaagccgacgaaataaaataccaccaagaatttccaaccatataccacctaagaaaacacttagcagatagccatgaaaaagcagatctgcgcctaatatatctagccttagcacacatgataaaatttcgaggccactttttaatagaaggtgaactaaatgctgaaaacacggacgtacaaaaattatttgaagcattcgtagaagtatacgatagaaccttcgacgatagcaatttaagcgaaataacagtagatgcgagctctattttaaccgaaaaattctccaaatccagaaggcttgaaaacttaattaaacattatcctacagaaaagaaaaatacattattcgggaacttagtcgccttagcattaggcctacaacccaactttaaaacatccttcaaattatcagaagacgcaaaactacagttctctaaagatacatatgaagaagacttagaagaactcataggaaaaataggagatgaatatgcagacctatttacttcagctaaaaacctctatgacgctatattgttaagcggaatactaacggtggcagataataccaccaaagcacccctaagcgcgagtatgattaaaaggtataacgaacaccaagtagatctaaagaaactaaaagagttcattaaaaacaacgccagtgataaatacgacgaaatattcaatgacaaagacaaaaatggttatgcaggatacatagaaaatggtgtaaaacaagatgaattttacaaatacctaaaaactaccctgtcaaaaatagatggctcggactatttcttagataaaatagaaagagaagatttcttaaggaaacagcgcactttcgacaacggcagtataccacatcaaatacatcttcaagaaatgcacgctatcttacgccgacaaggagaacattatgccttccttaaagaaaatcaggcaaaaatcgagaaaatacttacatttcgaataccctattacgtgggaccattagcccggaaaaacagcagatttgcatgggcagaatatcattcagatgagaaaataactccatggaatttcgatgaaataattgataaagaaaaatctgccgaaaaattcattacaagaatgacacttaatgatctatatctgccagaagaaaaagttttaccaaaacacagcctcgtctatgaaacatatacagtatacaatgaacttactaaagtcaaatacgttaacgaacaaggcaaatctaactttttcgacgctaatatgaaacaagaaatatttgaacatgtattcaaagaaaaccgaaaagtaacaaaagacaaatttcttaattacctaaacaaagaatttcctgaatatcgaatacaggacttaataggattagacaaagaaaataaatctttcaacgctagtctcggtacgtatcatgacttaaagaaaatacttgataaatcattcttagatgataaaacaaatgaaaccatcatagaagacataattcaaactttaacattattcgaagacagagatatgatccgtcaacgtctacaaaaatactctgatatattcacaccccaacaactaaagaaattggaaagaagacattacacaggttggggaagattatcatacaaattaattaacggaatacgcaacaaagaaaatgggaaaagtattttagactatctaattgatgacggttacgcgaacaggaacttcatgcaattaataagtgacgacacgctacccttcaaacaaataataaaagatgcacaaattataggagatatagatgatgtaacctcagtcgtacgagaactcccaggatcccccgcaatcaagaaaggtatattacaaagtgtcaaaatcgttgacgaattggtaaaagtaatgggccacaatccagataacatagtaatagaaatggcgcgcgaaaatcaaacaacaaacagaggaagaaatcaatcacaacaaagacttaagaaactccaagatagcctaaaagaattaggtagcaatatcctaaacgaagaaaaaccatcatatatagaaggtaaagtagaaaacaatcacttacaggacgaccgactatttctatactacatacaaaacggtaaagatatgtacacaggagacgaattagacatcgaccacttatcagactatgacatagatcatataattcctcaagcatttataaaagacgattccatcgacaatagagttctcacaagcagtgccaaaaatagaggcaaatccgacgacgtaccctcgcttgatatagtacatgatagaaaagctgactggatacgactatacaaaagcgggttaatatcaaaacgaaaatttgataaccttactaaagccgaaagaggtggactaacagaaaacgacaaagccggatttataaaaagacaattagtagaaacgagacaaataaccaaacatgttgcacaaatattagacagtagatttaatactgaaagagacgaaaatgacaaagtaattagaaatgtcaaagttatcacattaaaatctaatctagtcagtcaattcagaaaagatttcaaattttacaaagtaagagaaataaatgactatcaccatgcacatgacgcttatttaaatgctgtagtaggtaccgccctattaaagaaataccctaaattagcacccgagttcgtatacggagaatacaagaaatatgatattcgaaaatttattaccagctccggtgataaagcaacagcaaaatatttcttttattctaatctaatgaactttttcaaaagagtaatcagatacagtaacggtaaagtagtagtaaggccagtaatagaatgcagtaaagacacaggtgaaatagcatggaataaacaaacagacttcgaaaaagtcagacgggtcttaagctatccccaagtaaatatcgtcaagaaagtcgaaacccaaacagggggctttagcaaagaaagtatattacctaaaggcaacagtgacaaactaattccaaggaaaacaaagaaatttcggtgggacacaccaaaatacggtggattcgattcgccaaacatcgcctacagtgtattcgtaattgccgacgtagaaaaaggaaaagctaagaaactgaaaaccgtcaaagaattagttggtataagtatcatggaacgatctagtttcgaagaaaatcctgtggtattcttagaaaagaaaggataccaaaatgtacaagaagacaacctaataaaattacccaaatatagtttgttcgagttcgaaggaggcagaaggcgtctacttgcgagtgcatctgaattgcaaaaagggaacgaagtcgtattatctagacatctagtagaactattatatcatgcgcaccgagtcaactcatttaataatagcgaacatctaaaatacgtctccgaacacaagaaagaatttggagaagtattatcatgtgtcgagaacttcgcaaaatcttatgtcgacgtagagaaaaacttagggaaaattcgcgccgtagcagataaaatagataccttttccatagaagatattagcatatcatttgtaaatttattaacactcaccgcacttggagcccccgctgactttaactttctgggtgagaaaattccgagaaagagatacacatcaacaaaagagtgccttaatgcaactctaatacaccaaagcatcacaggtctatatgaaaccagaatagatctatcgaaattaggtgaagaatga

SEQ ID NO: 5468 - RNA, 4116 nt, synthetic construct
  misc_feature 1..4116: note = Cas9 variant
  source 1..4116: mol_type = other RNA
atgaatttaagaaatgttgaaagctatcaagtcggactagacattggtacaggaagtgtaggctgggcagtcctagacgacaatggtgatttatgtagatttaaaggaaaaccgacctggggatcacgcgtttttcccacagcagaaacagcagcggaagcacgcgtacacagagggcaaagacgaagatatgatcgaaggagacaaaggatcgatttattacaacgtttctttgcagacgaagttgcaaaagtcgaccccgagttctttatccgacttaatcaggccagacttcacccagaaaacagagaccctgctcacgcggactatagatggccactctttaacggatcaaactttacggaaaaagattattatcgacaatttcctaccatttatcacctccgggcacacttattaaaatcagacgaaccagcagatataaggcttgtctatttagcactacataatatagttaaacacagaggaaattttctacatcaagataacccgagcttatcagctcgtaatgctaacgttggagatgcggtggaagccttgtgcttggcattggacgaatggtgcggtgcacatgacgtagaatgtgcgtgtgacgaagctgcgctagcggaagcccttggagacgcgagcttacgaccaggggagaaaagggaacgtgcagaagcagccttaggggtcgaaaaagcacataagaaactcgctaaagcagttagctcagcagtggtaggatatgcagctgaatttggacatgtattctttgcagaaagtgaaggtagtaaatttgcgttaagtaacgacgaaaaagtagaagcctacgtatgtccggacgaaggaagagatttgttcgatgcgatgcgtgccgtccatagttcatacgttctaatgggaatattaagcgaagcgcaaggagaattactatcagtatgtaaagtaggagaatatgaacgatataaaagggaccttgaaacacttaaatcattagtgcgagcgtatggtccagaaaggtatgatgagttcttctgcggaccattttatgaaggaactagagattacgaccccggaaaagcgcaaggatacacaaaatataatctcggagcttcaaaattatcacacgaagactttttaaaagaagtgcaaaaattactaaaagatatcggagcacaagcagatgaacgatacgctgacatcgaaagagcaatagaagccggtgcattcctaagacggttaaaaacttcagacaatggtactatcccctatcaattacatctggaagaaatggatgcgataatagaaaggcaagccgcattttatccgtttctggcacaagaaaaagataaactaaaaagtctagtatcatttcgtataccatattacgttggaccattgacacaaaagaatgctgctagagacggaaaaggagaagcaagatttgcatggtcaagccgtaaaccagggatggaagacgcgcgagtatacccttggaactgggaagatgtaatcgacaaagatcaatccgccgaagattttataagaagaatgacagggacgtgcacatatctaaaaggagaaccagtgcttgcgcgatgttcactggattatgaattattttgcgttcttaacgaattagcgggagctagatggacccaagacggcgataaaagctatagattcgatgctgcagatagactaggaattgtagaagatttattcaaaaagaggaagcgagtcacatacgaagcagcagaaaaatggcttgctcgaacacatggacccgagtcaggaaaatccgcaggaggagcttatcatgtatctgggggtcaaggagaagatgctttcgaaagccaattaagcagtcattatgatttctgtaagattctaggcgtagatgaactaagtgatgcagacgaagctatggcagaagacatcatattatggaacaccgtttttgaagacagaagtatactcaaacggaaaataaaactagcctacggagacaggttgggagacgcacaggtaagaaaactctgtcagaaaaggtataccggatggggcagattgagtggtgaactactacgcggacttaggtcagccacagataatggtccaaaaacaataatggatattttgttagaaggggatcctaaccatgcaagaaggatgggtgcagcgatgaatcttatggaaatcctccacgatgatttgctagagtttcaagcaaaaatcgatgaacataatagagagagagcactagcggtaggtggcatgagcgttgatgaggtgacggggagtccggcgttaagaagaggaataaatcaagcgctacgtgtagttgatgaaatcgcaggaattgcaggcaaaccacccgcacatatatacgtggaagtaactcgagatgaaggagcaagaaataaaggacgtagaacaacaagtcgatacagagctttagaagcagcactaagtagtatcaaagcacaatgtgctgatgtttatgcagaattaaaggaaagagatcccagagcacttgatgatgaaagattgaccttatattttatgcaatgtgggaagtgtatgtattctggagatgcactagatatcaacaaactacaaacttatcaagttgatcatatactaccacaatcatacgtaaaggatgatagtttcgaaaacaaggtactcgtcagaccagatacaaaccaacgaaaaggggatactctgttattggatgaaagactcatagcacgaatgaggggattttggagaacattaagagacgcagaattaataggggaaaagaaatttaataatttaacgcgaacaagtgtaagtgatgaacaaatgaagaaattcgtaagcagacagcttgtagaaactggtcagatggttaaacaagtacagcaactattgcaagcaagatacccagagtcagaagtacaaccagtaaaagctggagtatctcaccagttaagggtagggtgtgcacttgcaaaaagcagagaaattaatgacttccatcatgcacacgatgcatatctggcatgtcaagtgggtagatttgtacagtatcgacattcagcagtatattcagaacccgttaaaatggcagcggttgtgaaacaatttataaagaaacaggcagaagattatcgacgtactcgtgaactaccaggtagtgatggatttattgtaagctccttcatgacaccaggtttcgatgtaaaaacaggtgaagtatttagagatgcatgggatgctggggctgaaatagaccgaattagaagatgctttgattataaagactgctttatcagtagaatgccagaagagacccacggggcattctgggacgcaactatttactcaccgagagctgccggaaaaactttaagcctacctctaaaaagaggtcttgatcctcgaaaatacggaagttacagtagagaacaatttgcctactttttcgtttacgaagcagtaaagcctaaaaagaaacaaagagtactagaatttgctccagtcccagttagagttgcaagcgccttagcaaatgatccagatgcactagaagactatgcaagggaactcgctgaagcggaagggctagttttcgaaagaatacgaaggcgaaaagtttacaaatatcagcaaataatcgttggagactccagattatatgttacagggagagaagaagtgagaaacgcccgacaactagcattctcacaagacgaaacaaaactaatatgtcgtatcgaacaaggggaagaatgtgaagaaggcgaattattagacttatttagatccatgcaaaggaaatacctagcgtgtgcaccgagactcgctcgattaatgaaagttgcagaaatggaagaaggatttattgctgctacagcatctggaaaaagagaagtattattaagtttgacctcaatagctgcagcacaccgaaatagtattgatttaaaaccaataggaagaaaaggatcttcaggacaaatgaaaatcacttttagtaaagaattatcaacaaacggtatactattcgttgactcaagtgttaccggtatgtttgaaagacggtgtagacttggattatga

SEQ ID NO: 5469 - RNA, 4116 nt, synthetic construct
  misc_feature 1..4116: note = Cas9 variant
  source 1..4116: mol_type = other RNA
atggaaaacaaaaactacagtataggattagacatcggaaccaattcagtgggctggtccgtaatcacagacgactacaaagtcccctcaaagaaaatgaaagtattagggaacacagataaacgttttataaagaaaaacttgatcggtgctctcttatttgatgaaggtacaacagcagaagcacgtcgactaaaacgaacagcccgacgtcgctatacacgcagaaagaaccgattaagatacctacaagagatatttgccgaagagatgtcaaaagtggatagctctttcttccacagattagacgactctttcctaatccctgaagataaaaggggatcaaaatacccgatattcgcaacactagcagaagaaaaagaatatcataaacaatttccaaccatttatcatctaaggaaacaacttgcagactctaaagagaaaacagacctaagacttatatatctcgcactagcccacatgattaaataccgaggacacttcttatatgaagatacatttgatataaagaacaacgatattcagaaaatcttttccgagttcattagcatatatgataacacattcgaaggcagctcattaagcggccaaaacgcacaagtagaagctatcttcactgacaagatatctaaatcagcaaaaagagaacgagttctcaaattgttcccagatgagaaaagtaccgggcttttctcagaatttctaaaattaatagtcggtaatcaagcagacttcaagaaacattttgacttaggcgaaaaagcaccattacagttttccaaagacacctacgatgaagacctcgaaaacttactcggacagattggagatgacttcgcagatctattcttagtagccaagaaactttacgatgcaatattattatcaggtatcttaaccgttacagatccatcaacaaaagctccattatccgcatctatgattgaaagatacgaaaatcatcaaaaagacctagcagtactcaaacaattcatcaaaaataatctgcccgaaaaatatgatgaagttttcagtgaccaatcaaaagacggctacgcaggctatatagatggtaaaaccacacaagaggctttctataaatacataaagaatctattatcaaaattcgaaggtacagactatttcctagaaaagattgaacgagaagactttttaagaaaacaaagaacattcgataatggtagtatcccacaccaaatacacctacaagaaatgaacgcaatcctcaggaggcaaggtgaacactaccctttcctcaaggacaataaagagaaaattgagaaaatactaacattccgaataccatactacgtaggccccttagcaagaggaaatagagactttgcctggctaactagaaactccgacgaagcaatacgcccatggaacttcgaagaaatagttgataaagcctcatcagcagaagattttattaacaaaatgaccaattacgatctctacttaccagaagaaaaggttttacctaaacactccctcctatatgaaacttttgcagtctataacgaactaactaaagtaaagtttatcgcagaaggtttaagagactatcaattcctagactcaggccaaaagaaacaaatagtaacgcaattattcaaagaaaagcgtaaagttactgaaaaagacataattcaattcctacacaacgtagacggatatgatggaattgaactaaaaggtattgaaaaacaattcaacgcatccctgtcaacttaccatgacttgttaaaaataattaaagacaaagaatttatggacgactccaaaaatgaagaaatactcgaaaatatcgtccacacattaacaatattcgaagatagagaaatgattaaacaaagactagcacaatatgactcattattcgatgaaaaagtaataaaggctttaataaggagacactatacaggatggggcaaactatctgctaaacttatcgacggtatctgtgataaacagaccggcaataccatcttggactacttgatagacgatggtaaaaacaacagaaatttcatgcaactcataaacgacgacggattatcatttaaagaaatcactcaaaaagcacaggtcgttggcaaaacagatgatgtaaaacaagtagtacaagaactgcctggtagcccagctataaagaaaggaatattacaaagcataaaaatagtagatgagctagtaaaagtaatgggccatacaccagaatctatcgtaatcgaaatggctagggaaaaccagacaacagcacgcggaaagaaaaactctcaacaacgctacaaaagaatagaagatgccctcaaaaacctcgcttcgggactagattccaacattctcaaagaacatccaaccaacaatatacaactacaaaacgatagactgtttctatactacctccaaaatggaagagatatgtataccggaaaaccactggatattaaccaattatcctcttacgacatagatcatatagtaccacaagcattcatcaaagatgactcattagacaatagggttctaaccagcttaaaagataaccgaggtaagtcagacaatgtaccttcaattgaagtagttcagaaaagaaaagcattctggcaacaacttcttgacagcaaactaatctctgaacgtaaattcaacaacctaactaaagcagagagaggaggactagatgaacgagataaagtcggcttcataaagcgacagctagtagaaactagacaaataactaaacatgtagcccaaattctggacgcacgatttaataaagaagtcaatgaaaaagacaagaaaaatagaacagtaaaaatcatcacactaaaatccaatctggtgtcaaactttagaaaagaatttcgactatataaagtacgagaaattaacgattaccatcacgcacacgacgcttaccttaatgccgtggtagctaaagcaatactcaaaaagtatccaaaattagaaccggagttcgtctatggtgactaccaaaaatatgacctcaagagatacataagccgttcacgcaaccctaaagaagtcgaaaaagctacggaaaagtactttttctatagcaatttattaaactttttcaaagaagaagtccattacgctgatggaacaatagtaaaaagagaaaatatagaatattcgaaagacaccggagaaatcgcatggaacaaagagaaagattttgccacaatcaagaaagtactctcatacccacaagtaaacatagtgaagaaaagagaagttcaaaccggtggattctcaaaagaaagcatactcccaaaaggaaacagcgataaactaatacccagaaaaaccaaagacatactatgggaaactactaaatacggaggttttgactcaccagtaatagcttatagtatactactcatagcagatatagaaaaaggtaaagctaagaaactaaaaactgtcaaaaccctagtaggaataacaataatggaaaaagcagcgttcgaagaaaaccctattacattcctggaaaacaaaggataccacaacgtacgaaaagagaatatattatgcttgccaaaatactctttgtttgaactcgaaaatggtagaagaagattactcgcatctgcaaaagaactgcaaaaaggtaatgaaatagtattgccagtttacttaactactcttttgtaccattccaaaaacgtccataaactcgacgaaccagaacacctagaatatatccaaaaacatagaaatgagttcaaagacctattaaacctagtaagcgaattttcacaaaaatatgtattagcagacgcaaatcttgagaaaatacaaaacttgtatgctgacaacgaacaagctgacatagaaatcctagcaaacagctttataaacttgttaacattcaccgcattaggcgctcctgcagcttttaaatttttcggcaaagacatagacagaaaaagatacacaaccgtatcagaaattttaaatgcaacactcattcatcaaagtataacgggattatacgaaacacgaatagatttaagtaaattaggtgaagattga

SEQ ID NO: 5470 - RNA, 4116 nt, synthetic construct
  misc_feature 1..4116: note = Cas9 variant
  source 1..4116: mol_type = other RNA
atggacaagaaatactcaataggcctagatattggaactaattcagtaggttgggcagtaataactgacgactacaaagttccttcaaagaaattcaaagtactaggaaacacagacagacactcaataaagaaaaatctgataggtgccttgttatttgatagtggagaaacggcagaagcaactagacttaaacggacagcacgccgacgttataccagacgtaaaaacagaataagatatcttcaagaaattttcagttcggaaatgtcaaaagtagatgattcattctttcatagactcgaagagtcttttctagtagaagaagacaagaaacatgaaagacatccaatatttgggaacatagttgatgaagttgcttaccacgaaaaatatccaacaatataccatttacgaaagaaactggcagactcgaccgataaagctgacctaagattaatatatcttgcactagcacatatgattaaatttagaggacattttctaatagaaggagaccttaatccggacaactcagatatggataaactattcatacagctagtacaaacatataatcaattattcgaagaaaatcctataaatgcttctcgagtagacgctaaagcaatactatcagctcgtttaagcaaaagtagacgtttggaaaacctaattgcacaactgccaggagaaaaacgaaacggattattcggaaacctcattgctctatccctcggtttaacaccaaattttaaatctaattttgatttagcagaagatgcaaaattacaactaagcaaagacacatatgacgacgaccttgataatctactagcccagataggagaccaatatgcagacttattcctcgcagctaaaaacctctcagacgcaatattattatcagatatactcagagttaattccgagataactaaagctccactatcagcaagcatgataaaaagatatgacgaacatcatcaagatctgacacttctaaaagctcttgtcagacaacaattacctgaaaaatataaagaaatattctttgatcaaagcaaaaatggatacgcaggatacatagacggaggtgcgtcacaagaggaattttacaaatttataaaacctatcctagaaaagatggacggcacagaagaattactagcaaaactcaatagagaagacctactccgaaaacagcgaacatttgataacggctcaattcctcaccaaatccacttaggagaattacacgcaatccttagacgccaagaagatttttacccatttttaaaagataacagagagaaaattgaaaagatattaacatttcgcataccttactatgtcggtcctctggcgcgaggcaattcacgctttgcgtggatgacaagaaaaagtgaagaaaccatcactccctggaacttcgaagaagtcgtagataaaggcgcctcagcacagtcgtttatagaaaggatgaccaactttgataaaaatttgcctaatgaaaaagttctaccaaaacactctttactatatgaatatttcactgtatacaacgaattaacaaaagtaaaatatgtgacggaaggcatgagaaaacccgagttcttgtcaggaaaacaaaaagaagccatagtggatttattatttaagaccaacagaaaagtcacggtcaaacaattaaaggaagactattttaagaaaatagaatgtttcgattcagtagaaataagcggcgttgaagacagatttaatgcttccctaggaacataccatgatctactaaaaattataaaagacaaagatttcttagacaatgaagaaaacgaggatattttagaagacatagtactaactctaacactattcgaagacaaagaaatgattgaagaacgcctaaagaaatacgcaaacttatttgacgataaagtaatgaaacaactgaaacgaagacattatacaggatggggcagattatcaagaaaactcataaatggaatacgagataagcaatcagggaaaaccatattagactttctcaagagtgatggatttgcaaatagaaacttcatgcagttaataaacgatgacagcctaacttttaaagaagccatacaaaaagcccaagtaagtggtcagggacattcacttcatgagcaaattgctaacctagcaggttctccagcaataaagaaaggcattttacagtcagtcaaagtagtagacgaactggttaaagtaatgggacacaaacctgaaaacatagtgatagaaatggctcgagaaaaccaaactacgcaaaaaggacagaaaaacagcagagaaaggatgaaaagaatagaagaaggaataaaagaactgggatcacagatattaaaggaacacccagtcgaaaacacgcaattacaaaatgaaaagttatacttatactatttacaaaacggacgagatatgtacgtggatcaggaactagacataaatcgactatccgactacgatgtagatcatatagttccccaatcatttataaaagatgacagtattgataataaaatactaacaagaagcgacaaaaatcgaggaaaatcagacaacgtaccttcagaagaagtagtaaagaaaatgaaaaattactggcgacaattattaaacgctaaactcattacacagagaaaattcgacaacctaacaaaagctgaaagagggggattgtcggagttagataaagcaggattcatcaagcgacaattagtcgaaacacgacaaataacgaaacatgtagcacaaatattggactcacgaatgaacacaaaatacgacgaaaatgataaactaataagagaagtgaaagtcataaccctcaaaagtaaactcgtatcagatttccgtaaagattttcaattttataaagtgagagaaataaataactaccaccacgcacacgacgcatatttaaatgctgtggtaggcaccgcactaataaagaaatatactaaactagaaagcgaatttgtatatggtgattataaagtatatgatgtacgaaaaatgatagcaaaatcagaacaagaaataggtaaagcaaccgccaaaagattcttttattcaaatataatgaactttttcaaaaccgagattaccttggcaaacggggagataaggaaaagaccactaattgagacaaacgaagaaacaggggagatagtttgggacaaaggaagagattttgctacagtacgaaaagttctaagtatgccacaagtaaatatcgtcaagaaaaccgaagtccaaacaggtgctttaacaaatgaatcgatatacgcacgtgggagctttgataaattaatttcgagaaaacatagattcgaatcatctaaatacggtggatttgggtccccaacagttacatatagcgtgttggtcgtagctaaatcaaaagtccaagacggcaaagtcaagaaaataaaaacaggaaaagaactcataggaatgactctattagacaaattagtctttgagaaaaatccactgaaatttattgaagacaaaggttatggaaacgtacaaatagacaaatgcattaaactgcccaaatattcgctatttgagttcgaaaatggcacaaggcgtatgctagcgagcgtcatggcaaacaacaactcccgtggcgatctacaaaaagctaatgaaatgtttttacccgcaaaattagttaccctactatatcacgcacataagattgaaagcagtaaagaactcgaacatgaagcatacatattagatcattacaacgacctatatcaattattaagctatatagaacggttcgcttcactatacgttgacgtagagaaaaatatatcaaaagtaaaggaactattcagtaatatagaaagctattctatatcagaaatatgtagttctgttattaatttactaaccttgactgcaagcggggctccagcagacttcaaatttctaggtacaaccatcccgagaaaaagatacggcagtccacaatctatcctctcttcaacattaatacatcaaagcattaccggattatacgaaacgaggatagatttatcacaattaggaggtgactga

SEQ ID NO: 5471 - RNA, 4116 nt, synthetic construct
  misc_feature 1..4116: note = Cas9 variant
  source 1..4116: mol_type = other RNA
atggataagaaatattctataggactagatataggcacaaacagtgtcggatgggcagtcataaccgatgattataaagtgccatccaagaaattcaaagtactggggaacacagacagacatagcatcaagaaaaaccttataggtgccctattattcgattcaggagaaaccgccgaagcaaccagattaaaacggactgcaagacgtaggtacactcgacgcaaaaacagaataagatacttacaagaaatattctctagcgaaatgtcaaaagtagacgactccttctttcatagactagaagaatcatttctagtagaagaagataagaaacatgaaagacaccccatatttggtaatatagttgatgaggttgcttatcatgaaaaataccccacaatatatcacttaagaaagaaattagcggattctactgacaaagccgaccttcgattgatctaccttgccctcgctcatatgattaaattcagaggtcattttcttatagaaggagacctgaatcctgataactcagacgtcgataaacttttcatacaattagtgcaaacttacaaccaactattcgaagaaaatccaataaacgcaagtagggtggacgctaaagcaatactctccgctaggcttagtaaatcacgtagattagaaaacctcatcgcacaattaccaggagagaaaagaaacggactctttggcaacctaattgcactatcgctaggactaacaccaaacttcaaatcaaattttgacttagccgaagacgctaaactacaattatctaaagacacgtatgatgacgatttagataacttactcgcacagattggggaccagtacgctgatctattcctagccgctaaaaatttatcagatgcaatactacttagcgacatacttcgcgtaaattctgaaataactaaagcaccactatctgcatctatgattaaaagatacgatgaacaccatcaggatctcacattattaaaagccctagtacgacaacaactacctgaaaaatacaaagaaatcttcttcgaccaatccaaaaatggatacgcaggatacatagatggtggagcatcccaagaagagttctacaaatttattaaaccaatactcgaaaagatggatgggactgaagaactgttagcaaaattaaatagggaagatttattacgaaaacaacggactttcgataacggaagcataccccatcaaatacatttaggagaacttcatgcaatattaagaagacaagaagatttctatcccttccttaaagacaacagagagaaaatagagaaaattttaaccttcaggattccatactacgtaggcccactcgctagaggtaattcaagattcgcatggatgaccagaaaaagcgaagaaaccataacaccatggaacttcgaagaagtagtcgacaaaggagcatcagcacaaagttttattgaaaggatgacaaactttgacaaaaacttacctaatgaaaaagttttaccaaagcatagtctattatacgaatactttactgtttacaatgaactaacaaaagttaagtatgttactgaaggaatgcgcaaaccagcctttctttcgggagaacaaaagaaagcgatagttgacctcttatttaaaacaaatagaaaagtaacagtaaaacaattaaaagaagattacttcaaaaagatagaatgtttcgactctgtagagatctccggtgtggaggaccgctttaacgctagcctaggtacttatcacgatttattaaaaataatcaaagacaaagactttctagacaatgaagaaaacgaagatatactagaagacatagttctaaccctaacactattcgaagacaaagaaatgatagaagaacgcttgaaaacctatgcacacttattcgatgacaaagttatgaaacaacttaaaaggaggcactatactggatggggaagattgtccagaaagttaatcaatggcatccgagataaacaatcgggtaaaactatacttgattttctaaaatccgatggcttcgcaaatcgtaatttcatacagttaatacatgacgatagcttaaccttcaaagaagcaatacaaaaagctcaagtaagtggtcaaggacactcactacatgaacagatcgccaatctagcaggctcacccgctatcaagaaaggcattctacaaagcgtcaaagtagtcgatgaactcgtcaaagtgatgggccacaaacccgaaaacattgtaatagaaatggcccgcgaaaaccagaccacccaaaaaggacagaaaaacagcagagaaagaatgaaaagaatagaagaagggattaaagaactaggtagccaaatcctaaaagaacacccggtagaaaacacacaattacagaatgaaaagctatacctatattacctccaaaatggaagagacatgtatgtagatcaagaactagacataaacaggctttcggattatgatgttgaccacatagtaccacaaagttttataaaggacgacagcattgacaataaagttttgacaagatctgacaaaaaccgaggcaaaagcgacaatgtcccctcagaagaagtagttaaaaagatgaaaaattattggagacaactactaaatgcaaaactaatcactcaacgaaaattcgacaacttaacaaaagcagaacgaggaggcctaagtgagctcgataaagcaggttttataaaaagacaactggtagaaacacggcaaattaccaaacacgtagcacaaattttagactctagaatgaataccaaatacgatgaaaatgataaacttatcagagaagtaaaagtaataacattaaaatctaaacttgtttctgactttcgaaaagatttccagttctacaaagtacgagaaattaataactatcaccatgcacatgatgcttatctaaatgctgtagtcggaacagcacttataaagaaatatccaaaactagaatcagaatttgtctatggtgactataaagtctacgacgtaagaaaaatgatcgcaaaatcagaacaggaaattggaaaagcaacagccaaaaggttcttctactccaatatcatgaacttcttcaaaacagaaataactctagccaacggcgaaattagaaagagaccattgatcgaaactaatgaagaaaccggcgaaatcgtatgggacaaaggaagagacttcgcaaccgttcggaaagtattaagcatgccacaagtaaacatagtaaagaaaaccgaagtccaaaccggtgccttaactaatgaatccatatatgcaagaggctcctttgacaaactgatatcaagaaaacatagattcgaatcatctaaatacggaggattcggctcaccaaccgtgacgtactcagtcctagtagtagcaaaatccaaagtacaagacggaaaggtgaagaaaataaaaacaggaaaagagcttataggaataaccttattggacaagctagttttcgagaaaaaccctttaaaattcatagaagacaaaggttatggaaacgtacaaatcgataaatgtataaaattacctaaatattcactttttgaatttgaaaacggcaccagaagaatgcttgccagtgttatggctaataacaattcaagaggagatctacaaaaagcaaatgaaatgtttttaccagcaaagctagttacactactataccacgcacataaaatcgaatcatctaaagaactagaacacgaggcttatatattagaccattacaacgacttgtatcagctattatcgtatatagaacgctttgcaagtctctacgtagacgttgagaaaaacatatcaaaagtcaaagaattgttttccaatatagaaagttactcaataagtgaaatttgttcctcagtaataaacctcctcacactaactgcgtcaggagctcctgcagacttcaaatttttaggcacgaccattcctagaaaacgatacggttccccacagtcaatattgtctagtacactaatacatcaatccatcaccggcttatatgagacaagaatcgacctttcacaattaggaggagattga

SEQ ID NO: 5472 - RNA, 4116 nt, synthetic construct
  misc_feature 1..4116: note = Cas9 variant
  source 1..4116: mol_type = other RNA
atggaaaacaaaaactactccataggtctcgacataggaacaaattcagttggatggtcagttataaccgacgattataaagttccaagcaagaaaatgaaagtattaggaaatacagataaacattttataaagaaaaatttaataggagcattattatttgacgaaggtacaacagctgaagcaagaagattaaaacgaactgcacgccgaagatatacaagaaggaaaaatagactcagatacctacaagaaatattttccgaagaaataggtaaagtggattcttcatttttccacagactagacgactcatttctcataccagaagacaaaagaggtagtaaatacccgatatttgctactcttgccgaagaaaagaaataccacaaacaattccccaccatatatcacctaagaaaacaacttgcagattctaaagagaaaaccgatctaagactcatctacctcgcacttgcacacatgataaaataccgtggtcactttctttatgaagaagcattcgatatcaaaaacaatgacatccagaaaatcttcaatgaatttatttcaatatacaataatacatttgaaggaaacagtttaagtggacaaaatgtacaagttgaagcaatattcacagacaaaatatcaaaatctgcaaaaagagaaagagtcctaaagctattccccgacgaaaagagtaccgggctatttagtgaatttctaaaactaattgtaggcaatcaagctgatttcaagaaacactttgatctagaagaaaaagcacccctccaattctcaagggatacatatgacgaagacttagaaaatctcctcgggcaaatcggcgatgatttcgcggacctatttttagttgcaaagaaactatacgatgcaattctattatctggcatcttaaccgtgaccaacccatcaacaaaagcacctttatcagctagtatgattgaaagatacgaaaaccatcaaaaagacctagcatctttaaaacaattcatcaaaaataaccttcccgaaaaatatgatgaagtcttctcagatcaaagtgaagacggctacgcaggatatatagatggcaaaacaacgcaagaaacattttataaatacatcaaaaatctattatcgaaattcgaaggcgcagattactttttagataaaatagaacgggaagatttcttacgtaaacaacgaacctttgataatggaagtataccccaccaaatacaccttcaagaaatgaatgctattctaagaagacaaggcgaacactatcctttcttaaaagagaacaaagagaaaatcgaaaagatactaacatttcgtatcccatattatgttggtcctctagcaagaggaaacagggactttgcatggctaaccagaaattcagatcaagcaatacgcccctggaacttcgaagaaatagttgataaagcgtcgtcagctgaagacttcatcaataaaatgacaaattacgacctgtatttaccagaagaaaaagtactaccaaaacacagcctattatacgaaactttcgccgtgtataacgaactaacaaaagtcaaatttattgctgaaggcctaagagattatcaattcctagactccggccaaaagaaacaaatagtgacgcaactctttaaagagaaaagaaaagttacagaaaaagatatcatacaattcctacacaacgtcgatggctacgatggcatagaactcaaaggaattgaaaaacaatttaacgcaagtttgtccacttaccacgatctattaaaaataattaaagataaagcctttatggacgatgccaaaaatgaagctatcctcgaaaacattgtacacactttaaccatcttcgaagatagagaaatgataaaacaaagacttgctcaatacgatagcctattcgacgaaaaagtaataaaagcactgacacgacgacattatacaggatggggcaaactgtcggctaaattaattaacggcatatcagataaacaaacaggaaataccatattagattatctaatagacgatggagaaatcaacaggaatttcatgcagttaataaacgacgacgggctgtctttcaaagaaataatccaaaaagcacaagtagtaggtaaaacaaacgatgtaaaacaagttgtccaagaactacccggtagccctgcaatcaagaaagggatattacaatctattaaaatagtagatgaactcgtcaaggtgatgggccatgccccagaaagcatagtaatagaaatggcgcgtgaaaaccaaacgacagcaagaggtaagaaaaactctcagcaaagatacaaacgcatagaagacagcttaaaaatattagcatctggtttgaacagtaaaatactcaaagaacacccaaccgacaatatacaactacaaaacgacagactattcctctattatctacaaaacggaaaagatatgtacacaggagaagcattagatatcaaccaactatcgtcatgtgatatcgaccacatcataccacaggctttcataaaggatgattcactagacaaccgtgtactaacctcgtcaaaagacaaccgcggcaaatctgataatgtaccaagtttagaagttgtcgataaaatgaaagttttctggcaacaactccttgatagtaaactaataagctaccgaaaattcaacaatcttaccaaagcagaacgaggcgggctaaatgagctggataaagtaggattcattaaacgacaactggttgagacccgtcagataacaaaacacgtcgcacaaatactcgatgcacgattcaataaagaagtaactgagaaagacaagaaaaatagaacagtaaaaattataaccctaaaatcaaacttagtatccaactttagaaaggagttcgaattatacaaagttagagaaataaatgattaccaccacgctcacgatgcctacctaaacgcagtagtcgctaaagctattctgaagaaatatccaaaattagaacccgagttcgtctatggagactatcaaaaatatgatctaaaaagatacataagcagaagcaaggaccccaaagaaattgaaaaagcaactgaaaaatatttcttctatagcaacctgctcaacttcttcaaagaagaagtacactatgcagatggaacaatagtcaagagagaaaacatcgaatacagtaaagacacaggtgaaatcgcatggaataaagaaaaagatttcgcaacaatcaagaaagtcctaagtctacctcaagtaaatatagtcaagaaaagagaagtacagactggaggattcagcaaagaatcaatactaccaaaaggaaattcagacaaacttataccaagaaaaaccaaagacattctttgggatacaactaaatacggcgggttcgatagcccggtcatagcctactcaattcttctcatagccgacatcgaaaaaggtaaagccaagaaacttaaaaccgttaaaacactcgtaggaataaccattatggaaaaagatgcctttgagaaaaaccctatcgcattcctagaaaataaaggttatcacaatgtttgcaaagaaaacatactttgtttaccaaaatactcactgtttgaactagaaaatggacgtagaagattgttagcaagcgcaaaagagctgcaaaaatgcaacgaaatagtcctaccagtttacttaactacactcttatatcatagcaaaaacgttcacaaacttgatgaaccgggtcaccttgagtatatacaaaaacacagaaatgaatttaaagacttattaaatctagtatcagagttctcacaaaaatatgtactcgcagacgctaacttagagaaaattaaaaatctttatgccgataacgaacaagcagacatagaaatattggcgaactccttcatcaatttgttaacttttaccgcgttaggagctcctgcagcattcaaattctttggaaaagatgtagaccgaaaaagatacacgaccgtcagcgaaatcctcaacgccacactaattcaccaatcaatcactggattatacgaaacccgcatagacctatcaaaattaggagaagactga

SEQ ID NO: 5473 - RNA, 4116 nt, synthetic construct
  misc_feature 1..4116: note = Cas9 variant
  source 1..4116: mol_type = other RNA
atgaaagtaaataattatcacataggcctagatatcggaacatcctctataggctgggttgcaattggagaagacggaaaaccactacgcattaaaggtaagacagccataggagcaagactatttcaagaaggcaacccagcagctgacagacgaatgtttagaacgactcgaagaagattatctcgaaggaaatggagacttaaactactcgaagaaatatttgatccgtacattactccagttgatagcaccttttttgcaagattaaaacagtcaaacttatcacccaaagactcaagaaaagaattcaagggaagcatgctattcccggacttaacagacatgcagtaccacaaagactatccaaccatatatcatcttagacacgcactcatgacccaagacgaaaaatttgacattcgaatggtataccttgcaatacatcacatcgtcaagtaccgcggaaacttcttaaactcaaccccagtagatagctttaaagcctcaaaagtaaatttcgtagaccaattcaagaagctaaacgaactatatacagcaataaatcccgaagaatcatttcaaatcaatttagccaacagtgaagatatcggtcaccaattcttagacccttcaataagaaaatttgataaaaaaaaacaaatccccaagatagtaccggtatcagtagacgacaaagcgactgacaaaataaacggaaaaatagcaagcgagatcattaatgcaatattaggttacaaatcaaaattagacgtggtcgtgcaatgtacaccggtcgactcaaaatcatgggccctgaaatttgatgaagaagacattgacgctaaattacaaaaaatattaccagaaatggatgaaaaccaacagagtatcatagctatactccaaaacttatacagtcaggtaacactaaaccaaattgtacccaacggtatgagcctgtccgaatcaatgattgaaaaatacaacgatcatcatgaccacttaaaactatataaaaaaataatagatcaacttgctgatccaaaaaaaaaagcagctctaaaaaaagcatatagtcaatacgttggggatgacggcaaagttattgaacaagcagacttctggtcaagtgttaagaaaaaccttgacgattcagatctatcaaaacagataatggaccttattgacgcagagaaattcatgcccaaacaacgaacatcccaaaatggggtcataccacaccaactacatcaacgagaattagacgaaattatagaacatcaaagtaaatactacccatggctagccgagataaacccaaacaaacatgacctccacttggccaaatataaaatagaagaactagtagccttccgagtcccttattacgtcggaccaatgatcacaccggacgaccaagctaaatcagcggaaacagtattttcttggatggaaagaaaaggaaaggaagcaggacaaatcactccctggaacttcgacgaaaaagtcgatagaaatgcatcagccaaccgattcatcaaaagaatgacaacaaaagacacatacctaataggagaagacgtgctaccagacgaaagtttactatacgaaaaattcaaagtactaaacgagcttaacatggtaagagtaaatggaaaactattaaaagtggccgacaaacaagcaatcttccaagacctttttgaaaactacaagcacataagtgtaaaaaaacttcaaaactatataaaaagtaaaacaggcctaccaagcgaccccgaaatctcagggttgtcagatccagaatacttcaacaacagcctaggcacatataatgactttaaaaaactgtttggaaacaaagtagacgaacccgatcttcaagatgacttcgaaaaaatagtagagtggtctacggtctttgaagacaaaagaatattgagagaaaaactaaacgaaataacctggctatcagatcaacaaaaagatgtattagagtcatcacgctatcaaggatggggaagacttagtaaaaaattattaacaggcatagtaaatgatcaaggagaacggatcatagatgagttatggaacacaaataaaaacttcatgcaaatacaatcagataacgattttgccaaaagaatccatgaggctaatgcggaccaaatgaaagcagtcgatgttgaggacgtattagcagatgcatatacatccccccaaaacaagaaagcaataagacaagttgtaaaggtagtagacgatattcaaaaggcaatgggcggagtggccccgaaatatatatccatcgagttcactcggtctgaggatcggaaccccagaagaaccatatctcgacaaagacaattagaaaacacattgaaagatacagcaaaaagtctagccaaatcgataaatccagaactactaagtgaactagacaacgcagctaaatcaaagaaaggactaattgataggctctacttgtacttcacacaactaggaaaagatatatacacaggtaaaccaataaatatcgacgaaatttcaacctatgatatagatcacatcttaccccaggcattcgttaaagatgacagtctcaacaacagagtacttgtttcaaaagcgatcaacaatggtaaatcagacaatgtccccgtacaactatttggtgctaaaatgggacatttttggaaacaactggcagaagcaggtttaatcagtaaaagaaaattaaaaaatcttcaaaccgatcccgacaccatatcgaaatacgccatgcacggatttattcgtagacaactagtcgaaacctcacaagtaataaaactagttgccaacattttaggcgacaaatatagaaacgacgatactaaaataatagaaataacagctagaatgaatcatcaaatgagagacgagtttggcttcataaaaaatagagaaataaacgattatcatcatgcgttcgacgcatacctgacggcattcctaggaagatatttatatcatagatatataaaactacgaccatactttgtctacggagacttcaaaaaattcaaagaagataaagtaaccatgagaaactttaacttcttacacgacctcactgacgacactcaagaaaaaatagctgatgcagaaacaggagaagtaatttgggaccgagaaaattctatacaacagttgaaggacgtttaccactataaattcatgttaatttcacacgaagtatacacattaagaggggcaatgttcaatcaaacagtatacccggcatccgatgcaggcaagagaaaactaataccaataaaagcagacagaccaattaatgtatatggaggatatagcggtagtgccgacgcatacatggctattgtcagaatacataacaaaaaaggcgataaatatcgagtagtcggagttcctatgagagcaagagacagattagatgctgcaaaaaaagtatcagacgcagactacgacagggcactaaaagacgtattaacaccacaattaaccaaaacaaaaaaaagtagaaaaacaggtgagataacacaagtcgtagaagacttcgaaattgtcttaggtaaagtaatgtatagacaactaatgatagacggtgacaaaaaatttatgctaggctcttccacatatcaatacaatgctaagcaattagtattgagcgatcaatctgttaagaccttagcatctaaaggtcgacttgatcccctgcaagagtctatggattacaataacgtttatacagaaatactcgataaagtaaaccaatacttctcactatacgacatgaacaaattcagacacaaattaaacctcggattttcaaaatttatatcatttccaaaccacaacgtatttgacggaaatacaaaagcctcgtccggaaaaagagaaattctagaagaagtattaaatggactacacgcaaacccaaccttcggaaacctcaaagacataggaataaccacacctttcggacagctccaacaaccaaacggaatcctactatcagatgaagctaaaatcagatatcaatctccaaccggtctctttgaaagaacagtatctctcaaagatctctga

SEQ ID NO: 5474 - RNA, 4116 nt, synthetic construct
  misc_feature 1..4116: note = Cas9 variant
  source 1..4116: mol_type = other RNA
atgaaagtaaacaactatcatataggcctggatatcggcacaagttctatcggctgggtagcaataggaaaagatggaaaacctctaagagtaaaaggaaaaacagccattggagcacgcctattccaagagggtaatccagccgctgaccgacgtatgtttaggacaaccagacgtcgactctccaggagaaaatggcgactaaaattgctcgaagagatcttcgacccatatataacacccgttgactccacattctttgcaagactaaagcaatcaaatctaagcccaaaagacagtagaaaagaatttaaaggatcaatgttatttccagaccttacagacatgcaataccataaaaattatcccactatctatcatctaagacacgccttaatgacccaagacaagaaatttgacatacgtatggtctacttagcaattcaccatatcgttaaatatagagggaactttttaaacagcactccagttgattcattcaaagcatctaaagtagatttcgtagatcaattcaagaaactaaacgaattatatgcggccataaacccagaagaatctttcaaaatcaaccttgcgaatagcgaagacataggtcaccaattcctagatccatccatccgaaaatttgacaaaaagaaacagatcccaaaaatagtaccagtaatgatgaatgacaaagttacagaccgattaaacggaaaaatcgcgagcgaaatcatacacgccatactaggatacaaagcaaaactagacgtagtgctacaatgtacaccagtagattcaaaaccatgggcattaaaatttgatgacgaagacatagatgctaaactagagaaaatcctacccgaaatggacgaaaatcagcaatccatagtagctattctccagaatttatactcacaagtaacattgaatcaaatagtcccaaatggtatgtcattaagcgaaagcatgatcgaaaaatacaatgatcatcatgatcatcttaaactatacaagaaattaatcgaccaactagcggacccgaaaaagaaagccgtactaaagaaggcttacagtcaatacgtaggagacgatggcaaagttatagaacaagcagaattttggtcatctgtaaagaaaaatttagatgattccgaactctctaaacagatcatggatctaatcgacgctgaaaaattcatgccaaaacaaagaacttcccaaaatggagtcatccctcaccaactccaccaaagggaactagacgaaataatagaacatcaatcaaaatattacccatggctggtagaaatcaatccaaataaacacgacctacacctagctaaatataaaattgaacaactggtagcatttcgagtaccgtattacgtcgggccgatgataactccaaaagatcaagcagaaagcgccgaaacagtattttcgtggatggaaagaaaagggacagaaacaggacaaatcacaccctggaacttcgatgaaaaagtcgatcgaaaggcttctgcaaaccgattcatcaaacgtatgacaactaaagatacatacttaatcggtgaagacgtactacctgatgagtccttattgtatgaaaaatttaaagtattaaatgaactaaatatggtaagagtgaacggcaaactattaaaagtcgcagacaaacaagctatcttccaagacctcttcgaaaactataaacatgtttcagttaagaaactacaaaactatataaaagcaaaaacaggcttaccatcagatcctgaaatatccggtttatccgatccggagcacttcaataatagtctcggaacctataacgatttcaagaaactattcggttcaaaagtagacgaaccagatctacaagacgatttcgagaaaatcgtagaatggtcaacagtatttgaagataagaaaatattaagagagaaactaaacgaaattacatggttgagcgaccagcaaaaagatgtgctagaatcttctagatatcaaggatggggaagacttagtaagaaattactaacaggaatagtaaacgatcaaggcgagagaataatcgacaaactctggaacacaaataaaaattttatgcaaatacaatctgacgacgacttcgccaaacgaatccacgaagcaaacgccgaccaaatgcaagcagtcgatgtagaagatgtcctagcagatgcctacacttcaccacaaaacaagaaagcgataagacaagtcgtaaaagtagttgatgatatacaaaaagctatgggaggtgtggctccaaaatacatatcaatcgagttcaccagatccgaagacagaaatcccagacgaaccatctctagacaaaggcaattagaaaacacattaaaagacactgcaaaatcactagcgaaatcaattaaccctgaactcctatctgaattagataatgcagccaaaagcaagaaaggcctaacagaccgactatacttatactttacacaactaggcaaagacatatacactggcgaaccaatcaacattgatgaactaaataaatacgacatagaccatattctaccacaagcatttataaaagataatagccttgacaaccgtgtcctagtacttacggcagtgaacaatggcaaaagcgataatgttcccttgagaatgttcggggcaaaaatggggcacttctggaaacaattagccgaagctggtcttatttcaaaaaggaaattaaagaacctacaaactgatcctgacactatctcaaaatatgctatgcacggattcattcgtcgacagctagtcgaaacaagtcaagtaataaaattggtagccaatatcttaggagacaaatatcgaaacgatgacacaaaaatcatcgaaatcacagcacgaatgaatcaccaaatgagagacgaatttgggtttattaaaaacagagaaataaacgattatcaccatgcgttcgacgcatacttaactgcctttctaggaagatatctatatcaccgctacatcaaactacgaccatactttgtatacggtgactttaagaaatttagagaagataaagtaactatgagaaacttcaattttcttcatgatctaacagatgacactcaagagaaaatagccgacgctgaaaccggagaagtcatttgggacagagaaaactcgatacaacaactaaaagatgtatatcattacaaattcatgctaatatctcacgaggtttatactctcagaggagcaatgtttaatcaaacagtctacccagcaagtgacgcaggcaaacgtaaactaataccagtgaaagcagacagacccgtaaatgtctacggaggctattcaggaagtgcagatgcttatatggcgatagtaagaatacataataagaaaggcgataaatacagggtagtaggtgtgccaatgagagctctagataggctagacgcggcgaaaaacgtttccgacgcagacttcgaccgtgctctcaaagatgttctagccccacaattaacaaaaacaaagaaatcaagaaaaactggcgaaataacccaagtcatcgaagattttgagatagttctaggaaaagtgatgtacagacaactcatgatagatggagataagaaattcatgttgggttcatcaacctatcaatataacgccaaacagctggtcttaagtgaccaaagtgttaaaacgttagcaagtaaaggacgactagatccacttcaagaatcaatggattacaacaacgtatatactgaaatactagataaagtaaatcaatacttctctctttacgacatgaataaatttcgccataaactaaaccttggattttccaaatttatatcttttccgaatcataacgtactggatggaaacacgaaagtatcctcaggaaaacgtgaaatattgcaggaaattttaaatggtcttcacgcgaacccaacatttggtaatttgaaagacgtaggtataaccacgccgttcggccagttacaacaaccaaacggtattctacttagtgatgaaacaaaaatcaggtatcaatcgccaacaggcctattcgaaagaacagtttcattaaaagatctatga

SEQ ID NO: 5475 - RNA, 4116 nt, synthetic construct
  misc_feature 1..4116: note = Cas9 variant
  source 1..4116: mol_type = other RNA
atggacaaaaaatattccataggattagacatcggtactaatagcgttggttgggctgtaataacggacgattacaaagtgccatcaaaaaaatttaaagttctagggaacacagataggcacagcataaaaaaaaacctcataggggcactcctgtttgactcaggcgaaacagcagaagctactagactaaaaagaaccgccaggaggagatatactagaagaaaaaacagaatatgttacttacaagagatattctcaaatgaaatggcaaaagtcgacgatagctttttccaccggctagaagaaagcttcctggtagaggaggacaaaaaacacgagcgacaccctatcttcggaaacatagtggatgaagtggcatatcacgaaaaatatccaacgatataccacctaagaaaaaaattagcagactcgaccgacaaagcggacttaagacttatttatctagctttagcacacatgatcaaatttagaggacactttcttatagaaggagaccttaaccccgacaactccgatgtagacaagctatttatccaactggtacaaacttacaatcaactattcgaagaaaacccaatcaacgcgtctcgtgtcgacgccaaagcaatcttatcagcgagattatctaaatctagacgattggaaaacctcatcgcacaattacctggcgaaaaaaaaaacgggttatttggaaatttaatagcactcagcttaggactcacaccaaattttaaatctaactttgacctagcagaggacgcaaaactccagttaagtaaagacacatacgacgacgacttggacaatctattagcacaaataggtgaccaatacgcggatctatttttagcagcaaaaaatctctcagacgctaccttgctaagcgacatcctacgcgtaaactcggaaataacaaaagcacctttatccgcctcaatgatcaaaagatatgatgaacatcatcaggatctaaccttattaaaagcactagtaagacaacagttaccagaaaaatacaaagaaatatttttcgaccaaagcaaaaatggttatgcagggtatatcgacgggggagcctctcaagaagaattttataaatttataaaacccatactagaaaaaatggacggaaccgaagaactcttagcaaaactaaatagagaagatttgctaagaaaacagagaacatttgacaatggcagtataccacatcaaatacatctcggagaactgcatgctatcttacgaagacaggaggatttttacccatttctcaaagataatcgtgaaaaaatagaaaaaatactcacttttagaatcccctattacgtaggaccattagcgaggggaaactcacgcttcgcttggatgaccaggaaatccgaagaaaccataacaccctggaatttcgaagaagttgtagataagggagcaagtgctcaatcatttatagaaagaatgaccaacttcgacaagaatcttccaaatgaaaaagttttgccaaagcattcactattatatgaatatttcacagtttataacgaactaaccaaagtaaaatacgtaactgaaggaatgcgaaaaccagcgttcttatccggcgaacaaaaaaaagctattgtagatctactattcaagacaaacagaaaagttactgtcaaacaattaaaagaagactactttaaaaaaatcgaatgtttcgatagcgtcgaaatatcaggggtagaagacagattcaatgcatctttaggaacttatcacgatctactcaaaataataaaagataaagatttcctggataacgaggaaaatgaagatatacttgaagacatagttctcacgttaacactattcgaggataaagaaatgattgaagaacgacttaagacctatgctcatctctttgacgataaagtaatgaaacaactgaagcggagacactatactggctggggaagactttccagaaaactaataaatggtataagagataaacagagcggaaaaactatactagattttctgaaaagcgacggattcgcaaatagaaacttcatccaattgatacatgatgactcactaacattcaaagaagcgatccaaaaagcacaagtatcaggacaagggcactctcttcacgaacaaatagccaatttagcagggtctcccgcaatcaaaaaaggcatactacaatcagtaaaagtagtagacgaattagtcaaagtaatgggccacaagcccgaaaatatcgtaatagaaatggcaagagaaaaccaaacaacacaaaaaggacaaaaaaattccagagaaagaatgaaaagaattgaagaagggatcaaagaattaggctcacaaatactcaaagaacaccctgtggagaatacacaattacaaaacgaaaaactttacctatattatctacaaaatgggcgagatatgtatgtagaccaagaactggatataaatcgattaagcgattatgatgtagaccatatagtcccacaatcttttattaaagacgattcaattgacaacaaggtactgactagatcagataaaaatcgtggaaaatcggacgacgtcccaagtgaagaagtagtaaaaaaaatgaaaaattattggcgccaattactaaatgcaaaactaataacacaaaggaaattcgacaacttaacaaaagccgaaagaggaggattaagcgaattagataaagcaggtttcataaaacgccagctcgtagaaaccaggcaaataacaaagcatgtggctcaaattctagactcaagaatgaacacaaagtacgatgaaaacgacaaacttataagagaagtcaaagttattacactaaaatctaaactagtaagcgattttagaaaagatttccaattttataaagtccgagaaataaacaactatcaccacgctcatgatgcatatctcaatgcagtagtaggtacagcattaataaaaaaatacccgaaattagagtcagaatttgtatacggagattacaaagtctatgatgtaagaaaaatgatagcaaaaagcgaacaagaaataggcaaagcaacagctaaaagattcttctattcaaatatcatgaacttctttaaaacagagatcactctagctaacggggaaatcagaaaaagaccactcatagaaactaatgaagaaacaggagagatcgtgtgggataaaggaagagactttgcaactgtaagaaaagtactatctatgccacaagttaacatagtaaaaaaaactgaggtacagacgggcgcgttgacaaatgaaagtatttacgcaagagggtccttcgataaattaatatcacgcaaacataggtttgaatcctcgaaatacggcggttttggctcaccaacagttacttactccgtattagtagtagccaaaagcaaagttcaagacggaaaagtaaaaaaaataaaaacaggtaaagaactaataggaattactctactagacaaacttgtcttcgaaaaaaacccattgaaatttatagaagacaaaggatatggtaacgtacagatagataaatgtattaaactacctaagtattccctattcgagtttgaaaacggaacacgacgaatgctcgcttcagtaatggcaaataacaactccagaggagacctacaaaaagcaaatgaaatgttcctaccagcaaaacttgtcacattgctttaccatgcacacaagatagaatcatcaaaagaactagaacacgaagcttacatactggaccattacaatgatctataccaactactatcatacatagaaagatttgcatctctatacgtagacgtagaaaaaaatatatccaaagtcaaagagttattctcaaacatagagtcctattccataagcgaaatatgttcctccgtaatcaacttactaacactaactgcctccggtgcccctgccgatttcaaatttttagggacaaccatacctagaaaaagatatggatctcctcaaagtatcttatcatcaacacttatacaccaaagcatcaccggattatacgaaactcgtatcgatttatcacagttaggttccgactga

SEQ ID NO: 5476 - RNA, 4119 nt, synthetic construct
  misc_feature 1..4119: note = Cas9 variant
  source 1..4119: mol_type = other RNA
atgaacaatgaatacttcgttggatttgatataggtactaattcggttggagcggcagtaacagatgaaaaatatcacgtactcaaattcaaaggaaatgcgatgtggacttcagctgtttttgaaagcgcacaacaatctgccgacagaagattaaaccgaactgctcggcgccgcctagaccgaagtcaacaaagacgagatcttttacaagagctaatagcgccagcaataacacccgttgacccacgctttttcgacagaataagagaaagcgccttatgggcggaagacaaaactactggctcacggtttacgtacttttcagatgaaggatatacagataagcaatatcacaaagagtatccaacaattcatcatttaatatgctcattaatgaatgatccggcacctcacgatcctcgcttagtgtatatagcgtgctcatatatgctcactcacagaggacactttttaaacgaagctgataaagagaaaatagatgatgtccttgatatacgcagggtattcaatgaattatgctcttggttcacgagttatggaatagaagtacctttctcctgctttccagaagagttcgggaatgtattaactgcaaacagaggcgtacaagacagaactcgcgccttctatgatctattatttgcaggaaagaaacccaaacctagcgaagatgatcaagtagacatcgatgtcctcattaaattaatttcaggaggtaagattgaattaagcaaactatttctgaacgaagaatactcagaactagaaaacaacaaaatacaacttagtgacgctggatttgacgaaaaggaacccgaattaagatcggaattaggagatgacttcggtctagtagcagctgcaaagaatatttacgattggtcacttttaacaggagtactcggagaatgcaagagcatatcagaagcaaaagtcaaaacatacgaaaaacatagtgaggatctagcagctttacggagggtcgtgaggaagtaccaccctgacaaatacaaagaaatcttcaagaaatacgtggttggaaattacaccagttattcaggcaacgtgaaatcggcgggaaagatcagtgaaaccaagctaaaaagatgtaaccaagcagagttctgcgactatttgaaatcaaagctcaaagacgttaaacccgcgccaggtgatgatgaatgtgaaagagtgctgaaagaaatatcaaagcatacattttgtcctagacaagtaaccactgataacagagttatcccataccaattatattatacagaattaaagaaagttttagaaaatgcgaaaagatacattccacaattaaatgttactgatgaatatggaagtgcggccgacaaaatattatcactaatgacatttagaatcccatattatgtaggaccattagtaaagaaaaacgattcatcaaacgcatggatagtgcgtaggggcgaaggtcgtatactcccatggaattttgatgaacttgttgataaagataaatgtgaagacgaatttataaggagaatgacatgtaaatgtacctatatagcaggcaaaaatgtcttacccaaaaattcattattatattgcaaatttatggttctaaatgagattaacaacataaagatcaacggagaaagaatctcagtaggagataaacagaaaatatatacagaactattcgaaaagaaacgtaaagttactgtccgagacattcggaatttattaacaagtgaaggcagactcaaagcaggcgatactttcggaggcatagacataaccgtaaaatcgtcactaaaaccacaacatgacctaaaaagattaatggcagcgggtgttataaccgaagcagatgcggaagaaatcattgaaagaatcacatgtaccaccgacgtctcacgattaagaacatggttaggtaaattcggattatcagcggcagatgctaaatacgtatcaggactaaaatattcagacttcgggaggctatcaagagaatttttaacagaagttaacgatgttgatccagcgacaggagaagttattaatccaaacattattacgatgatgtgggaaaataacataaacctaatggaattattaagtcaaaagtacagttatagatcacaaatagaaagtatgaacagagaatattacgcggcaaatccattaacattagacgaaagaatgagcgaaatgtatataccaagtgctgtaagacgaccagtcaaaagaacaatagaaatgatgaaagaatacatgcatataatgagaaaaccacccaaaagaatatttatagaaatggccagagaattgacagatcttgacaataaaggtaaaagaacatcatctagacgtaatacactattagaatttttcaagaaatgtccccaagacaccacggaactaagagcccaactagaaaagaaatccgacgatgaattaagatcagagaaattatatttatactttgcacaattaggaaaatgcatgtattcaggagaaagtatagatatagaacgactgggctcaaaattatatgacgtagaccacatctttccgcaagctagagtcaaagatgacagtatagaaaacaaagtcctagtcttatccgatcttaacggagcaaaatccgatagatacccaataaatgctgacattcgtaataaaatgcatagcttctgggacaaactgcacagcataggactaattggggagaagaaatatgaaagactaacaagatcaactggattcacagatgatgaactagccggctttatatcacgacaacttgtcgagacaagacagagcaccaaagccgtcgcagcattgttggctgaagagttcccagaatccgagatcgtctatgtaaaggcgggtctagcttcacaattcaggcatgaatttggactactgaaatgtcgagagataaatgacttacatcatgcaaaagacgcttatctaaacattgttatgggaaacatctaccatgtaaaattcactaaagacccgatgaactttgtaaaagaatatagaagaaaagaacaagtcttcgatttaaagatccagagcatgttaacccacgacgccattagaaatggggaaacagcatggataggagatggaacctggctagaaactgttaaaaagcaaatggagaaaaacaatatcagatacgtacggtattcatttaggaggaaaggtgcactcttcaatctaatgccagaacgcaaaaatccatcattactaccaaggaaaaacggtaaaaatatggtactaccagcagaaaaatacggaggatacaacaatactgcggccagcttctttagtctagtcaaatatcattcagcaaaaggtagtggcgttgtaatcatacctgtagaactaatacacgcacatagatacgaacatgatagctcatttgccgaagaatatgcattacgggtgttagcagatatagtttctctaaagaaaggagatgtattgcagagtgtcgaatttcccctagggagtagaatattaaaagtcaacactttattagacatcgatggtttcagggcaaacataacaggaaaagactcaggaggtaaatatctaggcataagctctgcatcatcattaataatttcccaggtagatacaacatacataaaaagagtcataagcataaatgaaagaatatctgcctgcgagaaaaacaagcaatcgtataccatacgaccagaatttgatgttattacaagtgaaagaaatatagaaatttacaatatgctatgtgagaagataagcagcagaccattttgtataaaatttgcaaacacttcggacacattcgtttcaggacgagaaaaattcatagccctatcgctcaatgaacaagtaaaaactttaacaaacatgctttctgtttttaaaaccggccgtgcttcaggttgtgaccttactaatataggcggctccaagaatacggcaatagttaaactaaatgcagtactatcaaaccttaaagatttcaaatcagtaaggataattgaccaaagtccaacagggctatacgaaaaagtgtccccaaacttattatctctatga

SEQ ID NO: 5477 - RNA, 4119 nt, synthetic construct
  misc_feature 1..4119: note = Cas9 variant
  source 1..4119: mol_type = other RNA
atgacgaagaaaaattacagcattggattagacatcggaacaaactcggtcggatgggcggtaataacagacgactacaaaataccagctaagaaaatgaaagtattaggaaacacagacaaagaatacatcaagaaaaatctactaggggcactcttattcgatagtggggaaaccgcagaagcaacccgactgaaacgaacagcacgaagacgatatacaagaaggaaaaacagactaagatatttacaagaaatctttgcagaagaaatagcaaaagcagataatagcttctttcaaagactcgatgaaagttttctaactgatgacgacaaagattttgactcccatcccatctttggtaacaaagcagaggaagatgcatatcaccaaaaatttagtacaatataccatctccgcaaataccttgcggacagtcccgagaaaagtgatctacgattagtctacttagcattagcacatatgataaaatatcgcggacacttcctaatagaaggtgaactgaaagcagaaaacacagatgtacaaaaattatttacagattttgtagaagtctacgaccgaaccttcgacgacagccatttaagtgaagtaactgtagatgcatcatcgatccttacagagaaaatcagtaaatccagacgactggaaaatctaatagaatcgtatccaaaagaaaagaaaaacacactattcggtaacttaattgcgctttcacttggactacaacctaacttcaaaacgaacttcaaactctctgaagatgcaaaattacaattctccaaagacacatacgaagaagatttagaagaagtattagagaaaataggagacgattatgccgatctgttcacatcagcgaaaaacctatacgacgcaatattgttaagcggcatattgacagttgacgattcctctacaaaagcaccactatcagcatcaatgatcaaacgatacgcagaacaccatgaagacctagaaaaactaaaagcattcataaaaacaaacaaaccaaatctgtaccatgacatttttaaagacgaaacacaaaatggatatgctgggtacatagaaaacggagtaaaacaagacgaattttataaatatctaaaaacaatactatcaaaaaccgatggatcagaatactttttagacaaaattgaaagagaagactttttaagaaaacaaagaacgttcgataatggatccatacctcatcaaatccatctacaagaaatgcatgcaatactaagacgacagggagactattaccccttcttaaaagaaaaccaagacagaatagagaaaatcctaacattcagaatcccatactacgtaggtccattggcgaggaaaaatagtagatttgcttgggcagaataccatagcgacgagaaaataacaccatggaactttaacaaagtaatagacaaagaaaaatcagcagaaaaatttattacacgtatgacattaaatgatctctatctcccagaagaaaaagtgctgccaaaacatagtcacgtatacgaaacttttgcagtatataacgaactaactaaaataaaatacgtgaacgaacaaggaaaagaagccttcttcgacagcaatatgaaacaagaaatattcgaccacgtattcaaagaaaaccgaaaagttaccaaagaaaaacttctaaactacttagacaaagagttcccagaatatcgaatccaagacttaataggacttgacaaagaaaacaagagctttaacgccagcttgggaacgtaccacgacctaaagaaaatactagataagagcttcctagatgataaagtaaatgaagaagttattgaagacataattaaaactttaaccttattcgaagatagagaaatgatacaacaacgccttcacaaatactcagacatattctcgacacaacaactcaagaaattagaacggagacattacaccggctggggacgactttcatataaattaataaacggcataagaaataaagaaaataataaaacgatattggaatacttaatagacgacggatatgcgaatagaaacttcatgcagctaattaacgacgacaccttaccattcaaacaaatcatcaaagacgcacaaataataggaaacatagatgatatcgcagccgtagtccatgaactcccaggaagcccagcaatcaagaaaggaatactacaatcgatcaaaattgtggacgaattagtaaaagtaatggggcacaacccagataatatagtaatagaaatggcaagagaaaatcagacaacaaatagagggagatcccaaagtcaacaaagattgaagaaacttcaagactcacttaaagaattaggttccaatatactcaataaaaagaaacctagttatgtagaagataaagtagaaaatgtgcatctccaagacgatagattattcttatattacattcaaaacggaaaagacatatatacgggtgaagaattagacattgacagactatcagactatgacattgaccacataataccgcaagcattcatcaaagacgattcaatagacaatcgggtcctaacaagcagtgccaaaaatcggggaaaatccgacgatgtccctaatttagatattgtccgagcaagaaaagcagactgggtaagactatataaatcaggacttatctccaagagaaaattcgacaatctaaccaaaagtgaaagaggaggcttgacagaagcagataaagcaggttttataaaacgccagttagtagaaacccgacaaataactaaacacgtagcacaaattttagacgcaagattcaataccgaacacgacgaagatgacaaagtcatacggaacgtgaaagtaataactttaaaatcaaatttaatatctcaattccgaaaagatttcaaattttataaagtaagagaaatcaacgattatcaccatgctcacgatgcctacctaaacgcagtcgtaggtacagccctattaagaaaataccctaaattagcaccagaatttgtgtatggagaatacaagaaatacgatgtaagaaaattaataacttcttcaagtgataaagcaaccgccaagtatttcttctattctaacctaatgaacttctttaagagagtagtacgatatagtaacggaagagtcatagtaagacctgtaatcgaatattcaaaggatacaggagaaatagtatggaacaaagaaacagactttagaacaatatgcaaagttttatcatatccacaagttaacattgtcaagaaagtcgaaagtcaaactggaggattctcaaaagaatcaatactcccgaaaggagattccgacaaactaatccctcgaaaaactaagaaagtttactgggataccaagaaatacgggggcttcgactctccaataatcgcatattcggtgttcgtagtcgcggatgtcgaaaagggaaaagccaagaaactaaagaaagtgaaggaactcgtaggaatatccataatggaaagaccgtcatttgagaaaaatccaatagtctttttagagaagaaaggttatagaaacgtacaagaagatacattaataaaactgcccaaatatagcctatttgaatttgaaggcggtagacggagattattagcctcagcgagtgaactacaaaaagggaatgaagtagtattgagtgatagactcgtcgaactattatatcatgcacatagagtgaacagttttaacagtaccgaacatcttaaatacgtaagtgaacataagaaagaatttggtgaagtactatcatgtgtcgagaactttgcaaattcatatgtggatgtagagaaaaatttagataaaatcagagcagtaataaataaaatagataccttttcaatagaagaaatcagcacctcctttgtgaatttactaacactaaccgcattaggagcaccagcagactttaatttcttaggcaagaaaattccacgtaaaagatacacaagtacaaaagagtgcttaaacgcaacactaatacatcaatcaataaccggtctttatgaaacaagaatcgatctctcaaaactaggggaagacaaatga

SEQ ID NO: 5478 - RNA, 4119 nt, synthetic construct
  misc_feature 1..4119: note = Cas9 variant
  source 1..4119: mol_type = other RNA
atgacaaagaaaaattactcaataggcctcgatataggtacaaactcagttggatgggcagtcataacagatgactataaagtaccagcaaagaaaatgaaagtactgggtaacactgataagaaatacataaagaaaaacctgctaggagcacttctattcgacagtggtgaaaccgctgaagctaccagattaaaacgtaccgctagaagacgctacactcgcagaaagaatagactaagatatttacaagaaatatttgcaaatgaaatagctaaagtagacgaaagtttcttccaacgactagacgaatcattcttaactgacgatgacaaaacctttgattctcatccgatatttgggaataaagctgaagaagacgcataccaccaaaaatttccaacgatataccacctaagaaaacatctagcggactcctcagaaaaagctgacctaaggttagtatacctcgcattagcacacatgattaaatttagaggccacttcctcatagaaggagaattaaatgcagaaaacacagatgtgcagaaaatattcgcggacttcgtgggagtatataatagaacattcgacgatagtcacctctccgaaataacggtagacgtcgctagtatactcacagaaaagatatcgaaaagcagaagactagaaaacctaatcaaatactaccctacggagaagaaaaataccttatttggaaacctaatcgcactggctctgggtctacaaccaaatttcaaaacaaacttcaaactctcggaagacgcaaaacttcaattttcgaaagatacctatgaagaagaccttgaagaattactaggaaaaattggtgacgactacgcggacttgtttaccagtgccaaaaatctgtacgatgcaatactattatcagggatactcaccgtggatgacaacagcacaaaagcaccactatcagcatcaatgatcaaaagatatgtcgaacatcacgaagacttagaaaaattaaaagagttcattaaagctaacaaatcggaactttaccatgatatcttcaaagataaaaacaaaaacggatacgcaggatatatagaaaatggagtaaaacaagatgaattttacaaatacctcaaaaatatactctccaaaataaaaatcgatggtagcgattatttcctagacaaaatcgaacgagaagatttccttagaaaacaaagaactttcgacaacggatccataccccaccaaatacatttacaagaaatgcacgcaatcttaaggagacaaggggattactacccgttccttaaagaaaaacaggaccgaattgaaaagatattaacattccgcataccatattacgttggaccactcgtaagaaaagacagccgtttcgcatgggctgaatacagatcggacgagaaaataactccatggaactttgacaaagtgattgataaagagaaaagtgcggagaaattcataaccaggatgacacttaacgatttatatctgcccgaagagaaagtattacctaaacactcacatgtgtacgaaacatacgctgtatacaatgaactaaccaaaataaaatatgtaaatgaacaagggaaagaatccttcttcgacagcaatatgaaacaagaaatatttgatcatgtttttaaagaaaacaggaaagtcactaaggagaaattattaaattatctcaacaaagaatttccggaatacagaataaaagatcttattggccttgataaggaaaacaaatccttcaacgccagcttaggcacctatcacgatctgaagaaaatattagacaaagcattcttagacgacaaagtaaatgaagaagtcatagaagacattattaaaaccctaaccctcttcgaagacaaagatatgatccatgaaagactgcagaagtattcagacatttttactgctaatcaactaaagaaactagaaagaagacattacactggatggggaagactctcgtacaaactaattaacggaatacgaaataaagaaaacaataaaaccattcttgactacctcatagacgacggatccgccaacagaaattttatgcaactaattaatgatgacactctaccattcaaacaaattatacaaaaatcacaagtagtaggagatgtagatgacatcgaagcagtagtacatgatctacctgggtctcccgctatcaagaaaggtatactccaatcagttaaaatagtcgatgaactcgtaaaagtcatgggaggaaacccagacaatatagtaattgaaatggcacgtgaaaaccaaacaactaacagaggacgatcacaatctcaacagagattaaagaaactacaaaattcacttaaagaattaggatctaacatcttaaatgaagaaaaaccgagttacattgaagataaagtagaaaattcacacttacaaaatgaccaattgtttttatattacatccaaaacggaaaagacatgtatacaggagatgaattagatatcgatcatctatctgactatgacatagaccacatcatcccacaagcattcataaaagatgatagcatagataatagagtactaacatcttcagccaaaaatagaggaaaatctgacgatgtccccagtttagatatagtcagagcaagaaaagcagaatgggtacgactctacaaatcaggcttaatatccaagcgaaaattcgataatttaacaaaagctgaaagaggaggattaacagaagccgataaagcgggtttcataaaaagacagctagtagaaacaagacaaattacaaaacatgttgctcaaattctagatgcaagatttaacacagagcatgacgaaaacgacaaagtaattagggacgttaaagtcataaccctaaaatccaacttagtttcgcaattccgaaaagacttcgaattttataaagtcagggaaattaatgactaccatcacgctcacgacgcatacttaaatgccgttgtcgggacagcattacttaagaagtacccaaaattagcatcagagttcgtatacggagaatacaagaaatatgacatcagaaaattcatcacaaacagctcagacaaagccaccgccaaatatttcttttactcaaacttaatgaacttctttaagacaaaagttaaatacgcagacggtacagttttcgagaggcctataatcgaaacaaacgcagacggtgaaattgcatggaacaaacaaatcgactttgaaaaagttagaaaagtactatcatacccccaagtgaatatagtcaagaaagttgaaacacaaacgggaggtttttctaaagaatccatattaccaaaaggcgactcagacaaattgatacccagaaaaactaagaaagtatattgggatacgaagaaatacggaggtttcgattccccaactgttgcctatagcgtattcgtcgtagcagatgtagaaaaaggcaaagccaagaaactaaaaacagttaaagaactcgtcggtatatctattatggaaagatcctttttcgaggaaaacccggttgaatttttagaaaacaaaggatatcataatataagagaagacaaactaattaaactaccaaaatatagcttatttgaatttgaagggggccgaagaagattattagcaagcgcatcagaactacaaaaaggaaacgaaatggttctaccaggttatcttgtcgaacttttatatcacgcacaccgggctgacaattttaattctaccgaatacctaaattacgtatcagaacacaagaaagagttcgaaaaagtacttagttgcgtggaggattttgcaaatctatatgtagatgtagagaaaaatctatcaaaaattagggctgtggcagatagcatggacaactttagcatagaagaaatatcaaactctttcattaatttactaacattaacagccttaggagcaccagcagactttaacttcctaggagagaaaataccgcgcaagcgttatacatctacaaaagaatgtctgaatgcaaccttaatccaccaatcaataaccggtttatatgaaacacggatagatttgtccaaactaggagaagaatga

SEQ ID NO: 5479 - RNA, 4119 nt, synthetic construct
  misc_feature 1..4119: note = Cas9 variant
  source 1..4119: mol_type = other RNA
atgaacagtgataaaagggaagattactacgttggactggatatgggcactggaagtctcggaggtgctgttacagatacccagtatcacctactaaaagtaaaaggaaaagatttctggttcgtacgtgaatacgagacagcaaaatcacaattagatagaagaacacatcggatagcaaaaagacgtttacaacggcacaaagcacgaataggcttaatcagatcttattttgcagaagacatactcaagcatgacccactattctacatcagacaggataattccaaatactaccatgaagataaagacgtacggttaaccaccaaagattcaatatttgctgatccaggatacggagacaaggaatatctagatgataaagaatacccaacaatttttcacctacgacaagcattgttaagagatcagataaaagacgaagaacgttatagtcgtttcttatatcttgcaatcatcaatatgtttgagcatagaggtcatttcttactcaatacagaatcaagcgatcttaacgccgacatgataaaagacgtcggagaactcgtcatgaacgctatatgtggagttagtgaatacggatcagtaacctacaaagaaattatagaaattttagaagacaaaaatatatcacggactgctaaaaaagatcaaatagcttcaaaaatagacatcaaaaaatcagaaaaagctcaaatggaaaggatcaaatgcttatgtggtatggaagcagatgcaagagtaatgttcgaaatagaagcggacgaaaagattaaaatagcatttcaacaagcggcatttgaagatgaaaaagaagagatagaagcagtgataggagaagacagatatttaataatcgaaaacatgaaacaactatatgattatagccaactccaaagcgtattaaatggatttgattatctatcagacgctagagtgcaaatgtatgaaaaacataaagaagaccttcacctattaaaaaaagtgtatagaaagaatctcgacagagaaatatacgacagaatgtttaggagtggcgaagaaggatcttattgcgcgtactctaatagtacaaatagcgtagatagcctcgctgaagctaaaaaatacagacgaaacatgaaaaaaaggagtcaaaaggacttatatgacagaataaaaaaagacctaaaggaagtacatgatgcagatgctgatgcaatacgtaaagaaatggaattggaacggttcttacccaaacaaatcacaggggccaacggtattattccgaaccaggtacatagaaaagaattaaaaaaaatactcgagaatgcagagcatcatctagacttcctaaaagagaaagacgaaagtggctatacagtatctgaaagaatactaatgttattctcaagcaacataccttactatgtcggtccagtgggcagtggaagcaagaccggctgggcaaagattcaagaatccggtcaagtattaccatggaatatggagcaaaaaatagatatagaacaaaccagtgaaagattcatcacgaatctaatcagggagtgcacatacctgtcaggagagaaagtattaccaaaacaaagtctattatatgaatcatactgcgtccttaacgagataaataacctccgaatacacggcaaacgaatagttccagaactaaaacaagatatttataaggaagtatttcaaggatttagacttggtaaaaaagtaacaaaaaaaaatatatgtacataccttataaacagaggattaataacggaagaaagcgaagtaagcggaatagacaaagaaataaacgcataccttccatcatatggaaaaatgtatggcgtattcggagaaagactaagagaagaggctgttcaagagatagctgaaaaaataatatactacggaacgatatacggcgatgcaaagtctatgttcagaaaaaaattaaaccaatatgtaagtgacggatggatgacagaataccaagcaaaaagaataagtggatataaattcaaggactgggccagattatcaagatctatgttatgcctcagcggatgcgacaagtcaactggggaaaaaatctccttaataagagccatgtgggaatataacctaaactttatggaactaatatacagggaagatttcactttccaaaaggaactagaagagagaaggaaagcattaggcaagacgttacaagagttccaattcgaggacctagatgaatattattactcagcaccagttaagaggatgatttggcaagcagttcaagcattaaaagaaataacccaaataatgggacataatccaaaacgtatatttatagaaatgacaagaacggaagaagaaaaaggcgagcaaggaagaaaaaacagccgagaaaaaagactactaaaaatgtacgaaagcattcgagatgagagaaactgggcagcagaaataaaaaatgctaacgcttcaggtaaactaaatagcaaaaagctctatttatactatttacaaatgggacgagatgtttacactggagaacccatagatatagaagacctattcgacgactcaagatacgacatcgaccacatatatccccgaagtttaacaaacgataacaatatagaaaataatctcgtgctagtatcaaaaacaataaatcaaaatgaaaaaaaaaacgattatcccgtaccagaaaaaattagacgcaataaaaaggtgagaaatctttggcatacactacataagatgggatttatgaatgatgaaaaatacaatcgattaacatccactgaaagactatccgaggaccagctcgcaggattcatagcaaggcaactagttgaaaccgcacaaggagcaaaaggaatagccgaattaatgaaggcaatgctaccaggcactgacatagtatacgctaaagctagaaatgtatcagatttcagaaaagaatacaaaatgctaaaaagcaggttagtaaacgactatcaccatgcacaggatgcttacctaaacatagtggtaggtaatgtatactttatgaaatttacaagaaacccaatgaattttgtaaaaacggaagcaagacgggacggacgaaattatgactacaacctatataaaatgtatagtaaagatatcataagaaacggcgaaaaagcatggattgcaacaagcgaacaaggacccggtaccatcagactagtaaaagaaactatgggacgcaatacacctataattacacgccaagcgttcgaacaaagaggagaattatttaatttgcaacctgtaggtaaatatagtgccaaaaaagataattacgtgccgctcaaaataaacgatgaaaaaatgcaagacgtaagcaaatatgggggatacacatctctaaatccaagttattttatatttattgaacacggtccagaaaaaaaaagaaaaaaatgcttcgaagttatacattcgtattacgctgctcaaataaaaacagaaaaagatttaatagattttctcttacagaagggctataaaaatccaagagtaataaatgctagaattaaaaaaaacgcactcataaaatacaacggatatttcttatacattataggaatggatgcaagaaaaaacatagagttcagcaatgcgacagcaatgtgtctgaaaaacaaatatattcaatatgtatgcaaattggaaaaaatgaacaaagcaattctattgtcggaaaaacagaaaactaacttacactgggacgagaaaatcacatgtgaatcaaacttagagttatatagggaattaacagaaaagcatctacactcgatctaccaaagacaccccagaagtataggaaaatgcttagcggacggagaaggtgcatttaaactacttgatatagaggaacaagtaaaaataatatgcgatatagtacaatacacttcctttcaacgcggagtatttagcttaaaagttctaggaggaccgaaagaagtgggccgaataagaataagtggtaatatgaccgaagcgaaagaatgcaagttggtaaattactcaataacaggcatgtataaaacagaaatggatcttctaaaaaaatga

SEQ ID NO: 5480 - RNA, 4122 nt, synthetic construct
  misc_feature 1..4122: note = Cas9 variant
  source 1..4122: mol_type = other RNA
atggaaaaaacatactctatcggactggatataggcactaattccgttggctggtcggtcataaccgatgactacaaagtgcccgccaaaaaaatgaaagtactaggcaataccgataaaaaatatatcaaaaaaaacttactcggtgcgctcctttttgacagtggagaaactgcagaagtaacaagattaaaacgtacagcaagacgacgctacacacgccgcaaaaatcgacttagatatttacaagaaatcttcgcaaaagagatggccaaagtagacgaatcctttttccaaagattagaagagagtttcctcactgacgatgataaaacattcgattctcatcctatattcggaaacaaagcagaggaagacgcctatcaccaagaatttccaacaatataccacctgagaaaacacctcgctgattcgtcagaaaaagctgacttaagattggtctatttagcactcgctcacatgattaaattcaggggtcacttcctaatcgaaggtgaactaaatgcagaaaataccgacatacaaaagctcttcaacgactttgtagaaacttacgataaaatagcggacgaatcccatcttagcgaagttgatgcctcatctatactaacaaacaagatatctaaatcgcgaaggctcgaaaacttgatcaaacaatacccaaccgaaaaaaaaaataccctatttggaaatcttgttgcattagtgttaggactacaacccaattttaaaaccaatttcaagttatcagaagacgcaaaactccagttttctaaagatacatatgacgaagatctagaagaacttctggggaaaataggggatgattatgcagatttgttcaccgcagctaaaaacttatatgacgcaatattactgtcaggtatactgactgtagatgacaattctactaaagcacccctaagcgcctcaatgatcaaaagatacgaagaacaccacgaagatctggaaaaactcaaaaaattcataaaagtaaacaatttcgacaaatatcacgaaatattcaaagataaaagcaaaaatggatacgctggctatatagagaatggcgtaaaacaagatattttttacaaacacttaaaatcaatcataagtgaaaaaaatggtggtcaatacttcttagacaaaattgaacgagaagacttcctcagaaaacaaagaacatttgacaacggatccattccccaccaaatccacctccaagaaatgagggcgatattaagaagacagggggaatactatccgtttttaaaagaaaatcaagccaaaatcgaaaaaattctaacattcagaattccttattacgtaggacctctcgcgagaaaagacagtagattcgcatgggcaaactaccactccgacgaaccaataaccccatggaattttgacgaagtagtagataaagaaaaatcagccgagaaatttataacaagaatgacactaaatgatctctatttacctgaagaaaaagtactacccaaacattctcacgtttacgaaacctttacagtctacaacgaattaactaaaatcaaatatgtaaatgaacaaggagagtcatttttttttgacgcaaacatgaaacaggaaatattcgatcacgtttttaaagaaaatcgtaaagtaacaaaagcaaaattactctcatatctaaataatgaattcgaagaatttaggataaacgatctaataggactcgacaaagacagcaaatcattcaacgctagcctaggtacgtatcatgaccttaaaaaaatcctagacaaatcattccttgacgataaaacgaacgagcagataatagaagacatagtcctgacattaacactattcgaagatagagacatgatccacgaacgtttacaaaaatattcagacttttttactagccaacaattaaaaaaactagagaggagacactataccggatgggggagactttcatacaaattaataaacggaataaggaacaaagaaaataacaagacgatattagatttcctaatagatgatggtcatgctaatagaaattttatgcaactaatcaatgatgaaagcctatcattcaaaacaataatccaagaggctcaagtagtcggcgacgtagatgatatagaagctgttgtacacgatctcccagggagcccagctataaaaaagggaatattacaatctgtaaaaatagtagacgaactagtaaaagtcatgggcgacaatccggataacatagttatagaaatggccagagaaaaccaaaccactaaccgagagaggagtcaatcccaacaaagactaaaaaaactgcaaaattctcttaaagaattgggctctaacattctaaatgaggaaaaaccatcatacatagaagacaaagtcgaaaacagtcacctacaaaacgaccaactgttcctgtactatatacaaaatggaaaagatatgtatactggtgatgaattagacatagatcacttaagcgattacgatatagatcatataataccgcaagcatttataaaggacaatagcatcgataacagagtacttactagcagcgcaaaaaatcgaggaaaaagcgatgacgttccttcactagatattgtcagggcaaggaaagcagaatgggtacgattatataaaagcggtttaatatcaaaaaggaaatttgataacttaacgaaagcggaaagaggaggcctaacagaagcagacaaagcaggattcataaaaagacaattggtggaaacacgacaaataacaaaacatgtagcccaaatactcgatgctaggttcaacacgaaacgagacgaaaacgataaagttattagagacgttaaggttataacactcaaaagtaacctcgtatcacagtttagaaaggaattcaaattctacaaagtaagggaaataaacgattatcaccatgcccatgatgcatacctcaacgcagtagttggtacagctttactaaaaaaatatcccaaactaacaccagaattcgtttatggagaatataaaaaatacgatgtaagaaaacttatagcgaaaagctccgacgactattcagagatgggtaaagcaactgccaaatacttcttctactcaaatcttatgaatttctttaaaaccgaagttaaatatgctgacggtcgagtttttgaaaggccagacatcgaaacaaatgcagatggagaagttgtatggaacaaacaaaaagattttgacatagtacgaaaagtactcagctatcctcaagtcaatatagtcaaaaaagtagaagaacaaacagtaggccaaaatggtggattatttgacaacaatattttagctaaacctgaaaaagatgataaaaaaaaacttttccccatcaaaaagagcttaagtacaacctcttatggtggatacgcccgagcaacaatagcgtactctattctcatagtaagcgagttcggcaaaaataaagaacttaaattattaggcctacctctattagataaagtaaaatatgaaaaaaaccctatagcttacctaaatagtataggtatcatcaacgttaaatcaatattcaaattaccaaagtattgtctattcgaatttcaagaaaaaaacacaaattatagaagatatatggtctctaaccaggaactaaaaagagccaaccaactattcctaacatgcaaagaaaccgaattagtatacaaatatataaaatccgacaatgacaacacccacctcgtcggtaacgaaaagacaatcttatctatctggaataaattagtaatatttatggaacggactaaattaatagataaaaaactatttgcaagcctaaaacaactaaaagatgaagtcgatctcataaacatacttgacatgactgcaaaaagcctagacttcacaaaaatatcagccggccaaaaaaaaataacaataagcgattcattaagtctacccattaaaagatggcagtttagttcagacgaaaaaatgctaaaacaattaaaaacagcaaccttaatccatcagtcagtaaccggactatacgaaactagaattgatttatctaaactcggtgaagaatga

SEQ ID NO: 5481 - RNA, 4122 nt, synthetic construct
  misc_feature 1..4122: note = Cas9 variant
  source 1..4122: mol_type = other RNA
atggagaaaacatattccataggtctcgatataggaacaaatagcgtaggatggagtgtaataacagacgattacaaagtgccagccaagaaaatgaaagtactaggaaataccgataagaaatatatcaagaaaaacctactgggcgctttactatttgactcaggtgaaacagcagaagtcactagattaaaacgcacagcacgaagaaggtacacgcgaaggaaaaaccgcctaagatatctacaagaaatttttgcaaaagaaatggcaaaagtagatgaatcattctttcaacgtttagaagaatcatttctaacagatgacgacaaaactttcgattcacacccaatattcgggaacaaagctgaggaagacgcgtaccatcaagaatttccgaccatctaccacttacgcaaacacctagcggactcatctgaaaaagcagacctaagattggtatacctcgcattagctcacatgataaaattcagagggcacttcctgatagaaggagaattaaacgcagaaaacaccgatatacaaaaattatttaacgactttgtggaaacatacgacaaaatagcagatgaaagccatttatcagaagtcgatgcatcatctatcctcacaaataaaatatccaaatcaagacgactcgaaaacctaattaaacaatatccaacagagaagaaaaatacactcttcgggaacctagtagccctagtactcgggctgcaacccaattttaaaacgaactttaaattgtcagaagatgcaaaacttcaattttcaaaagatacatacgatgaagacctagaagaacttttaggcaaaataggggacgactacgcagacctatttacagcggccaaaaacttatacgacgcaatcctcctctccggtatcttaaccgtagatgataattccactaaagcgcccctttcagcatcaatgattaaaagatacgaagaacaccatgaagatctagaaaaactcaagaaattcattaaagtaaacaacttcgataaatatcatgaaatttttaaagataaatcgaaaaacggctacgcaggctatatagaaaatggagtaaaacaagatatcttctacaaacatctcaaatctataatatctgagaaaaacggcggacaatatttcctcgacaaaattgaacgcgaagacttcttacggaaacaacggacatttgacaatggctcaattccgcatcaaatacaccttcaggaaatgagagcaattctacgtcgacaaggggaatattatccattcctgaaagaaaatcaatcaaaaatagagaaaatactaacgtttaggattccctattacgtaggacccctagcaaggaaaaattcaagattcgcatgggctaaataccactcagatgaaccaataaccccctggaacttcgatgaagtagtagataaagaaaaatcagctgaaaaattcattacaagaatgacccttaacgatctctacctaccagaagaaaaagtcctacccaaacattcccacgtttacgaaacatacgccgtatacaatgaattgacaaaaattaaatacgtaaatgaacaaggtaaagaatcattcttcgattcaaacatgaaacaagaaatatttgatcacgtgttcaaagaaaaccgaaaagttactaaagaaaaattactaaattacctaaataaagagttccccgaatacagaattaaagacttaatcggactagataaagaaaacaaatctttcaatgcttcattagggacctaccatgatctcaagaaaatactagataaatctttcctggacgacaaagtaaacgaagaagttatagaagatataataaaaacactaaccctttttgaagacaaagatatgatacatgaacgcttacagaaatatagcgacattttcaccgcaaaccaactaaagaaactagaaagacgccattatacagggtggggaagattaagttataaactaataaacggcattcgaaacaaagaaaataataaaacaatcctcgactatctaatagacgacggtagtgctaacagaaacttcatgcaattaataaacgatgatacactaccattcaaacagattatccaaaaatcccaagtagttggagacgtagatgatatagaagcagtagtccatgacctacccggcagtccagcaatcaagaaagggatattacaatccgttaaaatcgtggacgaattagtaaaagttatgggaggaaatccagataacatagtgattgaaatggcacgagaaaatcaaaccactaatcgaggtaggtcgcaatcacaacaaaggctcaagaaattacaaagctcattaaaagaactaggtagtaacatcataaacgaagagaaaccgtcatacattgaagataaagtcgaaaacagccacttacaaaacgaccaactatttttatattacatacaaaatggaaaagacatgtataccggagacgaactagatatagaccatttaagcgattatgatatagatcacataataccgcaagcctttataaaagatgatagtatagacaaccgggtactaacaagttccgccaaaaataggggtaaatcagatgacgtacctagcctcgacatagtaagagcacgcaaagcagaatgggttagactctacaaaagcgggctcatctcaaaacgaaaattcgataacctaactaaagccgaacgaggaggactaacagaagccgataaagccggatttataaaaagacagctagtagagacgcgccaaataactaaacatgtagcccaaattcttgacgcgcgttttaatactgaacatgatgaaaacgacaaagtaataagagacgtaaaagttataaccctaaaatccaatctagtatcgcaattccgaaaagacttcgaattttacaaagtacgcgaaataaatgactaccatcatgcacatgatgcctatctaaatgcagtagtcggaacggcattactaaagaaatacccaaaattggcaccagaatttgtatatggagaatataagaaatacgacgtgaggaaactaattgcaaaatcttcagacgaccactcagaaatgggcaaagctacagcaaaatacttcttttacagcaacttaatgaacttcttcaaaaccaaagtaaaatacgcagacggaagtgtctacgaacgaccaataatcgaaacaaacgcggatggcgaagtagtgtggaacaaacaaaaagattttgaaatcatacgaaaagtcttatcataccctcaggtgaatatagtcaagaaagtagaagaacaaacagtcggccaaaacggtggactttttgacaacaatatactcgcaaaacccgaaaaagacgataagaagaaactttttccgattaagaaatccttaagtacaacttcatacggcggatatgcaagagcaaccatcgcatattcgattttgatagtttctgaatttggtaaaaataaagagttaaaattactaggacttccccttttagacaaagttaaatacgagaaaaatccaatagcctacctaaactcaataggcataattaatgtaaaatcaatatttaagttaccaaaatattgtctatttgagttccaagagaaaaacacaaactacagacgttacatggtatcaaatcaagaattgaaaagagctaatcaacttttcttgacttgtaaagaaacagaacttgtgtacaaatatataaaaagtgataatgataatactcacttggtcggaaatgagaaaactatccttagtatctggaataagctagttatattcatggaaagaactaaacttatagataagaaactatttgcaagtctcaagcaactaaaagatgaagtcaacctaataaacatccttgacatagcatctaaatccattgacttcacaaaaattagcgcaggtcaaaagaaaatagtacttaatgattctctctctttaccaataaaacgatggcagttcaaatcagatgagaaaatgctgaaacaattaaatgatgcgaccttgattcaccaaagcattacaggactttatgaaaccagaatagacctaagcaagctgggagaagaatga

SEQ ID NO: 5482 - RNA, 4122 nt, synthetic construct
  misc_feature 1..4122: note = Cas9 variant
  source 1..4122: mol_type = other RNA
atgaatttaagacgagctagagattacagcataggactagacttaggtacaggaagtgtgggttgggctgtcacagacgcagaaggaaatctatacagtttcaaaggaagaccggcaatgggcagtagaacatttccaaatgcggaacccgcatcagtagccagaataccgaggggtcaaaggcgaagatacgaacgtagaagacaaagaataaaactacttcaacaattctttatgagtgacatggaaagagtcgatcccgacttctttacgagattaaatcaatcaacactattagcagaagataaagatgagagaatagcaagttgcgcatggcctatatttaattcatccgactttacagaaaaagattactacaagaaatttccgactatatatcatttacgcgcttttctttgtgaaagcgacgaaaaaggcgatctacgactcgtgtatttagccctgcacaatatagtaaaacataggggaaactttttgtaccaagataatcctgcattgagtgcatctgatgcttcagtcgatgaagcggttagacaattagtagatgcactagctgaatggtgtcagaataaagaaatagagctttcttgtgatgcagggagaattatagaagtgtttggtgatgcatcgctcagaagaactgataaaagagatcaattaaaaggattattaggattacctgcagatctagcgaaaactatgggcaaagagcttgcatcggccgtattaggttatgcagcaaacttttctaaaatctttctaatatcagatgcagaacataagttttcattagggaacgacgaaaaggtcgaggaatttgaaacaatctgcccaaatgaatgtaccagcctcttcagcgcactacgtacagcgtactcagcatatttattatctggcattctaagagatgctaatggaaaaacattaagtttctgtaagaagaaagaatacgatcgatatcacgatgatttagcattacttaaagcattagttagagaatacgcgcccgaaagttatcaatcattctttggaggggaacggttagtagtaaacggcagaatgacaaaacggtatgatccaacaaaagctaaagggtataccaaatacgatcttgttcatagtgctggtagttacgacgagttagcaaaagatgtaaagaaactccttgggagtttagcagctgatgattcaagatatcaacgaatgatgcaagcatttgatgaagaacggtttcttagaaggcttaaaacgtctgataatggttcgattccatatcaacttcacctagaagaactaagagcaataatagcaaggcaaggtgaattttatccattcttaaaagaggaaagtaaaaagatagaatccctagtaagtttcaggataccttattatgtagggccattaacgactaaaaacgccgctgtagatgttcacggtaataaacgatttgcctggtcggagagaaagcccggaatggagagcgctaaagtaagaccatggaattgggacgatgtaatcgacagaggtaaatcagccgaaaattttatagtaagaatgacaggaacatgcacttatctccaaaacgagaaagtcttaccaaaatgcagcttactatatgaggaattttgcgtgttaaacgaattgaacggagcccattggtccgctgatggagaccatgagtgcccctttgatacaagcgacagaaggggaatagtccaggatttattttgtgggaaaagaagagtctcatacaaacaagtcgaagactggctaagacagcacggttcgcggagagcaagagtatccggaggacaaggtgcgagtggttttgaatcaaaaatgtcttcgtatatcttcttctcaaaagatgttttgcatgtagatagaatagatcctgcagatttccctatgattgaagaaattatactttggaatacgttattcgaggaccgagatatattaaaagaaagaatagaagaagcgtatggcgacagactaaatgcagaacaaattaaaacaatatgcaaaaagaggttcacaggatgggggcgtttaagtcgaagacttttaacaggaataaaggctcaaacagaccaaggggatttaagtataatggacattttaagagaaggagatccgaataatgatcacagaggtaaagcaatggtgttcatgggaatactccatagcgaagatttaggatttcaaaagaaaatcgatcagattaatcaagagaaagtttctgcaggtaaagttagtttagaggatttgcctggtagtccagcacttagaagaagcataaaccaagcaatgagagttgtcgacgaaatcgtttcaattgcaaaatgcccaccctctcatatatatctagaagtcacaagagatgaagatggagcaaggaaaggacgaagaagtacgagaagatacgacgctataaaagctgcattagaaaaatttaaagaagagtcacccacatggttcgaccaagacgtctttggagaatttagaagaagcagagcagaagatctagacgaaagattatcgctctactttatgcaaggagggaaaagtctatactcagctacaccactgaaattggaactattacacactaatcaatatcaagttgatcacataattcctcaatcatatataaaagatgacagctttgaaaataaggctttggtactagctggagaaaatcaaagaaaaagcgatgctctattaatagactcgagtatacgaactgcgatggccccatactggcgtgctctccatcaagccggtttaatgggggataagaaatttaatagcttgatgtgctcgtctataagtgacaaaagagtaagaggattcatagcaagacaactggtagaaacaagccaaatagttaaactagcaggaatgatgttacaaagtaattacccagaagcagatgtgcaaccagtaaaagcctcgttaggacacgatctcagagtacaagctggatttattaaatgcagagaagtgaatgactttcaccacgcccatgatgccctcattgcatgtgaagttggtaggtatataaatcaatgtcatcccggcatttatgataatcctataggatacgcaagagctgtaagggaacttgtaagaaagcagaatgaagaaatgcgtaaatacggcagacttccaggatcagcagggtttatagtaggaggtttcatgagaacccatgtagacgttgatacaggagaagtcgtttgggacgctgaagaggaactatcccgaataagagcataccttgactattcaaacgtattcgtcacacgaatgtccgaagaaacatcaggtgcgttgtggaatgctacaatctacagcccacactacgggaaaactgcaccaacattacacataaaacaaggattagatgtacaaagatacggtgggtattcctcagctacattcgcttattttactttatatgtagcagaaaaaggaaagaaaagaaaagcggaactattaggaataccaatatcagtagcccggaaaatagaaggagaaccaagtaaattggatgcattcgtagctcaagatgccgaagcgaagaaactaaaacacccacttataataagagcacgaatattaaaatacgcaagatttgaaatggagggtaatcaattttattttgcagcacaagatgcagtttactcagcaaggcagttagtattaaaaggtgatctatactcagtagccgcaaaagcctgtgataaacacttgaatgacagctgtatcagtaatgaagacttaattcggttatatgatgaattggtacataagggggatttattatgcaataaatttggcaatgttacggatgttctccgagcaggcagagaaagatatgcagggctaagtataagtgagaaacgacagctagtctgtaatgttctggcctattacagatccgccacggcaagagttgacatatcattagtaggtggacccaaacatgcaggtaatttagggatcgcctttgtattaaacaatccagaagcaatagtcttcgtagatcaaagtgtaacagggatgtttgagaaaagaaccagagtagaactatga

SEQ ID NO: 5483 - RNA, 4122 nt, synthetic construct
  misc_feature 1..4122: note = Cas9 variant
  source 1..4122: mol_type = other RNA
atgaagaaaatacttggtctcgacctaggaacaaactcgataggatgggctttagtaaacgaagcggacaacgaaagagaaaaatccagcataataaaaataggagtcagagtaaacccgctaacagtcgacgaacaacaaaatttcgaaaaaggaaaatccataacaactaacgcagatcgtactcttaaaaggagcatgcgccgtaatttacaaagattcaaactacgaaaagaaaacttgatagaaattctcaagaaacaaaaatttataaatgatgaaacaatattaagcgaaaatggaaacaaatccacttttgaaacatacaatctgagggcgaaaagtgctacagaagaaataacactagaacaatttgcacgtgtactactaatgatcaataagaaacgaggatacaaaagtagcagaaaagcaaaatcacaagacgaaggacaattaatagatggaatggaaatagccaagaaactatataatgacaatctaacgccagggcaattcgttttccaaattctgaaagaaggtaagaaatacatacccgacttctacaggagcgaccttcaagccgaatttgacaaaatatggtcatttcaaaaacaatttaaccccgatatcctaacagaagaatttaataaacaaatcataggaaaagggaaagtaaatacaactaaaatatttctggcaaaatacggtatctatacaatagacaataaaggggcagacaagaaatctcaagcatacaactggagagtcgaagccctaaccaaccaattgacgaaagaagaattagcattcgtaatatcagacctcaacggaatcataagcaatagctccggatatttgggatccatatcagacaggtccaaagaactatattttaacaaacaaacagtcggacaatacctaattgctcaattaaaagaaaacccccatacccaactcaaaaatcaagtgttctatagacaagactatctcgatgagttcaacacaatatgggaaacccaagcaaaatttcataaagaattgaccaatgaattaaaagaagaaatacgagatattataatattctaccaaagaaaactgaaatctcaaaaaggccttatatcattctgcgagttcgaatcaaaacaaatagaaattaatatagacggcaaaaagaaattaaaaacagtcggatctaaagtatgtcccaaatcaagccccctctttcaagtctttaaaatttggcaaatactaaacaatatacaagtgatagaaaaatcgacaggcaaaagtaaatttttagaacaagatgaaaaagaaatactcttcaaagaattaaatttcaaagataaaataagtaaaacagatgccctcaaaattctatataaaaattataaagaattagatttcaattttaaagaaaatatagaaggaaaccgtacccaagcaacattcttaaaagcatttcaatcaataatagaattatcaggacacgaagtatctgattttagcaaaataaaaacagacgaaatacttgaaattgtaactccaattttcgaagggttcggattcaatacaaatttattacaatttaatagtaacttaaaaggaaaagatttcgaaaaacaagccgtttatcaactttggcatttattatactcattcgaaggagacaactcgaatacaggcaacgaaaaattaatacagaaaataagcgaactatacggtttcgaaagagagtacgcaataataattgccaacatctcctttcaaccagactacggctccttatcgactaaagctataagaaaaatcctacctcatctaaaagaaggaatagaattttcattagcatgtgaatacgccggctaccgacatagcaaaaactcactaaccaaagaagagaaaaacaagaaaatattaaaagataaaatcgacattttaccgaaaaatagtctacgcaacccagtcgtcgagaaaattctaaaccaaatgataaacgtagtcaacgcaactatcgaaacatatggcaaacctgacgaaatacgaatcgaactagctcgagaactcaagaaatcggccaaagagcgagaagacctaaccaacgctattaataaatcaaccttggatcatgaaaaatacaaagcactgctacaaaaagagttcggactatcaaatgtctccagaaacgatatcataagatacaaattatatctagaactcgagcacaacggctttcacacattatattcaaacacttacatagaaccaaacaaactattttcaaaggagttcgatatagaacacataattccccaaagcagactattcgacgactcgttctcaaacaaaacaatagaatctcgtagcgctaatatcgaaaaaggtaatgaaacagcattcgactacgtaagcaacaaaaatggcgaagtaggactcaaggattatcttaagaacatagaagacctatttaacaatggtaaaatctcaaaaactaaatacaacaaattaaaaatgaaaggtgacgaaataccgtcagacttcatcgcccgagacctaagagacactcaatacatatcaaagaaagccaaatctattttagaagatctagtaaaagacgtagtctcaacaggtggttccatcactgatagactgcgcgaagattggcaattaatagatataatgaaagaactcaactgggataaatatgacaaattaggtctaaccgaagtaatagaaaacaacgatggacacaaaataaacagaatcaaagattggacaaaaagaaacgatcaccgtcatcatgcaatggacgcattgacaatagcattcacaaagagatcctacatacaatacctcaacaatttaaacgcaagatctgacaaatcaggaagcatttacgggattgagcaaaaagaattatatcgcgataaaaacaataagctcagatttaaaccaccaataccactagacgattttagagcagaggccaaaaagcaactggaaaacaccctagtttccataaaggctaaaaacaaagtagcgacaatcaacattaacaatactaagaaacaaggcggagagaacaagaagaaacaactaaccccacgtggccaactacatctagaaaccatatacgggtcgatccaacaatacgtcactaaagaagaaaaagtaggagcaaattttaacaaagaacttatagaaaaagtagcaaacaagaaatgcagagaagcactgctcaaacgcttaatagagttcgacaacgatccaaagaaagcattcaccaggaaaaactcacttaataaaaatccattatacatcgacactataaaaacctacaaagtaccagaaaaagtcaaaaccgtaactacagaaacaatatacacgatcagaaaagacataaatcctgacctgaaaatcgataaagtcgtagataagaaaatcaaaaacatcctagaactgagattaaaagagttcaatggagacgcgaaaaaggctttctccaacttagatgaaaaaccaatatggttgaacaaagaaaaaggaatctccatcaaaagagtaacaataactgggatcagtaatgctatagcgcttcacgacaagaaagataaggaaggaaactttatactagacaaccaaggcaagaaacaagccgtagattttgtaaatacaggaaataaccatcatgtagccatctataaggatgaaaaaggaaatctccaagaaaacgtcataacattctacgaagcagtcgaacgggttaatcagggtatcccaataatagataaaacatacaaacaaaatgaaggatggcagttcctatttagtatgaaacaaaatgaatacttcgtgttccccaatgagaaaacaggatttaactcgaatgaaatcgatctactcaatccagaaaattaccatcttatatccccaaacctcttcagagtacagaaaatagcaacaaaagattacttctttcgtcatcatctcgagactaatgtcgagaacataacaaccacaaaagacttaacgtggaaacgccttggaataaacggaataataaacatacttaaagtcagaataaaccacatagggcaaatagtatcagtaggtgaatactga

SEQ ID NO: 5484 - RNA, 4122 nt, synthetic construct
  misc_feature 1..4122: note = Cas9 variant
  source 1..4122: mol_type = other RNA
atgacaaaaaaaaactactcaatcggcctcgacataggaactaattcagtaggctgggcagtcattacagacgattacaaagtaccagcaaaaaaaatgaaagtactaggaaatacggacaagaaatacataaaaaaaaatctacttggagcattactcttcgactctggcgaaacagcagaagcaaccagattaaaacgcactgcccgacgacgatatactcgcagaaaaaaccgcctaaggtacttacaagagatatttgccgaagaaatgacaaaagtagacgaatcattctttcaaagactcgatgaatcatttctacgatgggatgacgataataaaaaattaggacgatacccaatattcggaaacaaagcagacgtcgtaaaataccaccaagagtttccaacaatatatcatctacgaaaacacttagcagactccagcgaaaaagcagacctgcgtcttgtatatctcgctctcgcacacatgataaaatttagaggacactttttaatcgaaggagaactcaatgctgaaaacacagatgtccagaaaatatttgctgacttcgtaggggtgtatgaccgaacattcgatgattcgcatttatccgaaatcacagtagatgcagctagtatactcacagaaaaaatatctaaatcacgtcgactagagaacctaattaaatattatcctacagaaaaaaaaaataccttatttggtaatttaattgcgctagcactaggcctacaacctaactttaaaatgaatttcaaattgtccgaagacgccaaactacaattcagcaaagactcttatgaagaagatttaggcgagctgttaggtaaaatcggtgatgattatgcagacctctttaccagtgctaaaaacctctacgacgcaatactattatctggaatcttaatagtagatgacaatagtactaaagcacctctaagtgccagtatgataaaaagatatgtagaacaccaagaagatttagaaaagttaaaagaattcatcaaagctaacaaaagcgaactttaccatgacatattcaaggataaaaacaaaaatggatatgcaggttacatagaaaatggagtaaaacaagacgagttctataaatatctaaagaacacgctgtcgaaaattgcaggttccgactatttcttggataaaatagaaagagaagacttcttacgaaaacaacgaaccttcgataacggatccattccacatcaaatccatctgcaagaaatgcacgcaatattaagaagacaaggagattactatcccttcttgaaagaaaatcaagacaggatcgaaaaaatattaacatttcgaattccctattatgttggacccttagcaagaaaggattcaagattttcttgggctgaataccacagcgatgaaaaaataacaccatggaactttgacaaagtcatagataaagaaaaaagtgcagaaaaattcataacaagaatgacgctcaacgacctctacttgccagaagaaaaagtattacctaaacactcccatgtatatgaaacgtatgccgtatataacgagctaacaaaaataaagtacgttaacgaacaaggaaaagattcgttctttgacagcaatatgaaacaagaaatatttgatcacgtgtttaaagaaaatcgtaaagttaccaaggaaaaactgctaaactatttaaacaaagaattcccagagtatagaataaaagaccttatcgggcttgacaaagaaaacaagagcttcaatgcatcactaggcacataccatgatctcaaaaaaatcctagataaagcattcctagacgataaagtaaacgaagaagtaatagaggatataataaagacgttaaccctctttgaagataaagatatgatccacgaacgactccaaaaatatagcgacatcttcacagccgaccaattgaaaaaactagaacgtagacattacacaggatggggcagattatcctataaactaataaatgggataagaaacaaagaaaacaacaaaacaatactcgactatttaatagacgatggctcagcaaatcgcaatttcatgcaactcataaatgatgacacactgccattcaaacaaatcatacaaaaatcccaagtagtaggagatgtagacgacatagaagcagttgtacatgacttgcccggatctcccgctataaagaaaggcatcctacaatccgtcaaaatagtagatgaactagttaaagtaatgggtgacaatccagacaatattgtgatagaaatggcaagggaaaaccaaacaacgaatagagggagaagccaatcacaacaacgattaaaaaaactgcaaaacagtctaaaagaattaggatcaaatattttaaatgaagagaaaccaagttacatagaagacaaagtcgaaaatagtcatttacaaaatgaccaattattcctgtactacatacaaaatggaaaagacatgtacaccggagatgaattagacatagaccacctctcagactatgatatcgaccatataataccccaggcatttataaaagacgatagtatagataaccgcgtgcttactagttctgccaaaaataggggaaaaagcgacgacgtaccttccctggacatagttcgagcacgaaaagcagagtgggtaagactttacaagtccggcctcattagcaaaagaaaattcgacaatctaacgaaagcagaaagaggaggactaaccgaagccgataaagcagggttcattaagcgccaactagtggaaacgcgacaaattaccaaacacgtagcccagatcttagatgcgagatttaatacagaaagcgatgagaacgacaaagtaatacgagatgttaaagtaattactctgaaatcaaatttagtcagtcaattcagaaaagacttcgaattttataaagttcgagaaattaacgattatcaccacgcgcacgacgcttacctaaacgccgtagtaggaacagcacttctaaaaaagtatcccaaattagcatcagaattcgtctacggagaatacaagaaatacgacataagaaagttcattacaaactcctcagataaggcaacagctaagtattttttctatagtaatttaatgaatttcttcaaacgagtaatacgttattcaaacggaaaagtgattgtacgacctgtagtagaatatagcaaggacacggaagatattgcatgggataaaaaatcaaattttagaacaatatgtaaagttctatcctacccacaagtcaacattgtaaagaaagtagaaacgcaaaccggaggttttagcaaagaatcaatattacccaaaggcgattcagataaactaattccgagaaaaacaaaaaaggcatactgggacacaaagaagtatggtggatttgactcaccaactgtagcatattccgttttcgttgtagcagatgtcgaaaaaggaaaagcaaaaaaactcaagacagtgaaagagctcgtgggaatatccattatggaacgatccttcttcgaagaaaatccagtggaatttctagaaaacaaaggatatcacaatatacgtgaggacaaactaattaaactgcccaaatactcattatttgaattcgaaggcggaaaacgaaggctcttagcatctgcatctgaactgcaaaaaggaaacgaaatggtcatcccaggccatctagtcaagctactataccatgcccaaagaataaactcatttaattcaacaaaatatttagactatgtaagcgcacataaaaaagaattcgaaaaagtactatcgtgtgtcgaagatttcgccaacctatatgtagatgtagaaaaaaatttatctaaaataagagccgtagctgattcaatggataacttctcaatagaagaaataagcaattccttcataaaccttttaacactgacggcacttggagcaccagcagactttaatttcctaggagaaaaaattcctcgaaagcgatacacatcaactaaagaatgcttaaacgccactctaatacatcagtcaattaccgggttatacgaaactaggattgatttaagcaaaataggagaagaatga

SEQ ID NO: 5485 - RNA, 4122 nt, synthetic construct
  misc_feature 1..4122: note = Cas9 variant
  source 1..4122: mol_type = other RNA
atggaaaacaaaaactatagtataggtttagatataggaacaaatagcgttggctgggcagttataaccgatgactacaaagtgccatccaagaaaatgaaagtattaggaaatacagacaaaagatttatcaagaaaaatttaataggagcactattgtttgacgaaggtacaactgctgaagcacgcagactaaaaagaacagcacgacgccgatacactcggaggaaaaatcgcttaagatacctgcaagaaatattcgctgaagaaatgtcgaaagttgattcgtcattcttccatagactagacgatagctttttaattccagaagacaagaaaggatcaaaatacccaatatttgcaaccttgatcgaagaaaaggaataccacaagcagtttcctaccatataccacctacgcaagcaactggcagacagtaaagagaaaactgacctaagactaatttatttagccctagcccacatgattaaataccgagggcatttcctatacgaagatacatttgatattaaaaataacgacatacagaaaatatttaacgaatttataagtatatataataacacattcgaaggcaattctctatcaggccaaaacgtacaagtagaagctatcttcacagataaaataagcaaatcagcgaaacgcgagagagtattaaaactattcccagacgaaaaatctacaggattattttcagagttcctaaaactaatagtaggaaatcaagccgattttaagaaacacttcgacctcgaagaaaaagcacctttacaattttcaagagatacttatgacgaagatctagaaaatcttcttggacaaataggagatgattttgcagacctgttcgtcgcagccaagaaattatacgacgcgattcttttaagcggaatactaacagttacggaccctagcacaaaagcacctctatcagcttctatgattgaaagatacgaaaaccatcaaaaagatctagcaactctgaaacaatttatcaaaaccaatttaccagaaaaatacgacgaagtattctctgaccaatctaaagacggatacgctggatacattgacggcaaaacaacacaagaaagtttctacaaatatatcaaaaacctattatccaaattcgaaggagccgattatttcctcgagaaaatagaaagggaagatttcctacgaaaacaaagaactttcgacaacggcagtataccccatcaaatccatctccaagaaatgaacgcaatcttacggcgacaaggggaacattacccgtttcttaaagaaaataaagaaaagatagagaaaatactcacttttcgaatcccttactatgtaggtcccttagcaagaggaaaccgagactttgcttggctgacccgaaactcagatcaagccatcaggccttggaacttcgaagaaatcgtcgacaaagcatcctcagctgaatctttcataaacaaaatgacaaactatgatttatacttaccagaagaaaaagtattacccaaacattctttgttatacgaaacattcgctgtttataatgaattaactaaagtaaaatttatagcagaaggattacgggattaccaattcctggactcacgtcaaaagaaagatatcttttatacactatttaaagccgaagacaaaagaaaagtcacagaaaaagatataattcaatacctacataccgttgacggctatgatggaatcgaattaaaaggtattgaaaaacaattcaacgccagcttgtcgacttaccacgacctacttaaaattataaaagacaaagaatttatggacgaccccaataatgaagaaattttagaaaatatcgtacatacacttactatatttgaagatagagaaatgataaaacaacgactagcacaatacgactcattatttgatgaaaaagtaattaaagccctaacacgaagacattataccggatggggaaaattatcaagtaaactcataaacggcatcagagacaaacaaacaggaaaaaccatcttagactacttaatggacgacggctataataaccgaaactttatgcaactaataaacgatgacgaactcagcttcaaagaaataatcaagaaagcccaagtagttggcaaaacggacgatgtcaaacaagtagttcaagaactgcctggaagccccgcaatcaagaaaggcatcctccaatcgataaaattagttgacgagctagtaaaagtaatgggtcatgaaccagagtcaatagtaatagaaatggcaagggaaaaccaaacaacagcacgtggcaagaaaaattcccaacaacgctataaacgaatagaagactcgctaaaaatcctagcatcaggactcaacgctaaaattctaaaagaacatccaacagataatatacaattacaaaatgaccgcttatttttatattacctacaaaatgggagggatatgtatactggaaaaccgctagacataaaccaactttccagttacgacatagaccatattgtacctcaggcttttataaaagacgacagtctggacaatagagtacttacttcattaaaagacaaccgaggaaaatcggataacgtaccatccttagaagtagtagagaaaatgaaaacgttttggcaacaactcttagactcaaaactaatctcttatcgaaaattcaataacttaacgaaagcagaaagagggggtctagacgaacgtgataaagtaggattcatcaaaaggcaattggtagaaacaagacaaataacaaaacacgttgcacaaattttagacgcacgatataacaccgaagtcaatgaaaaagataagaaaaacagaactgtaaaaatcattacactaaaatcaaacttggtatcaaatttcagaaaagagttccggctatataagataagagaaataaacgactaccaccatgcacacgatgcgtacctaaacgcagtagtcgcaaaagcaatactcaagaaataccccaaactagaaccagaatttgtctacggagactaccaaaaatatgacctaaaacgctacatctcaagaagtaaagatccaaaggaaatagaaaaagcaactgaaaaatactttttctactccaaccttcttaactttttcaaagaagaagtgcattacgcagatggcaccatagtgaaacgcgaaaatatagaatattcaaaagataccggagaaatagcatggaacaaagaaaaagactttgcaacaatcaagaaagtgctgtccctaccacaagtcaatatagtcaagaaaagagaagtccaaactgggggattttcaaaagaatctatattacctaaaggaaattcggataaactaattcctagaaaaactaaagacatattatgggacacgacaaagtacggaggttttgactcgccagtaattgcatactccattttactcattgcagacattgaaaaaggaaaagccaaacgacttaaaactgtaaaaaccctagtaggcataacaataatggagaaagcgacctttgagaaaagccctatagcattcttagaaaacaaaggctatcataacgtgagaaaagaaaatatattatgtttacccaaatacagcctctttgaactcaaaaatggacgacgcagaatgcttgccagtgcaaaagaattacaaaagggaaatgaaatcgtattacccgtccacttaacaacgctattatatcatgccaaaaacattcaccgactagatgaaccagaacatttagaatatatacaaaagcatagaaacgagttcaaaggattactaaacctagtgagcgagttctcacaaaaatacgtattagccgacgctaatttggagaaaattaaaaatttatacgctgacaatgaacaagcagacatcgaaatactcgctaacagtttcatcaacttacttacatttaccgcactcggagccccagcagcatttaaatttttcggaaaagacgtagatcgcaaaagatacacaaccgtaagtgaaatactaaacgctactctaatccaccaatcaataacaggactatatgaaacacggatagacctctcaaaacttggcgaagattga

SEQ ID NO: 5486 - RNA, 4125 nt, synthetic construct
  misc_feature 1..4125: note = Cas9 variant
  source 1..4125: mol_type = other RNA
atggagactaaatttacatattacctaggtcttgatatgggaactgatagccttggttgggctgtaacagattcttcataccatatactgcgagctaaggggaaagatctatggggcgttagattgtttccaagcgcagagacgtccgttgaacgcagaacttatagagttaatagaagaagaagacaaagagaagtcgctcgaattggggcattgaaagaactatttgcagatgagatagaaaaagtagatccgggatttttcgtcagactagatgaatctaaattccacatggaagatcgatcagaaaataataaacaaaaatatggtctatttgcagataaactattttcagacgcaggatattataaaaaataccccacaatatttcacttacgaaaagagctactagaaagcgaagaaccacacgatgttcggctagtctacttagcactattgaacatgtttaagcaccgcggacatttcttaaattcgagtttacaaatagaaggagaaaacagcaacatagccgaaagctatcaaatgttcgtagacacactaacagatgaagatttggattttcccgagcaagtgagtggagaaagactacaggaaatattccgttcgtctgactcacgaaaaaaaaaagttgaaaaccttttagcggaaatgaacctatcaaaaaaacaaaaaagagaaatacaatttgttaacctcatctgcgggttaaagggaaagttaagtgaattattccccgacaaagaatatgacgaggagcagaaaaaaatcgcattctcatttcaagattcagactacgaggacaaagagaacactatacaagaattgctagacgagtcagaaatgaatatgatatatgctgtaaaagctgtacatgactccggagtactttcgggcataatgaacggtgaacggtacctttcagttgcccgagtagcatcctacgaaaagcacaaaaaagatttgcaaatattaaaagacattttaaaaaaatatgatacaaaagaatactttgaaatgttccgaaacgaatccgcaaaaagtgaatcttactcagcatacgtcggctcagtaaaatatcacgggacatttagacgaggattatcaggaggaaaacaggaagacctatataaacatatcaaaaaagtcctaggaaaatttccacaagacgacgaaggcgttacatatatcttagaagaaattgaaacagaaagcttcttacccaagcaattaacagcgtccaatggcgtcataccaaatcaagttcatgcaagggagatgctggcgatactcaaacatgctgaactatacttaccatttttacaggagaaagatgatacaggcttatcagtaagcgaaaagatactaaaattattcatgtttcaaataccatattatgtaggacctttaggtcaagaatataaagataaaaaaggatataatgtatgggccgaaaggaaagcatcaggaaaaatatacccctggaactttgaagacaaaatagacgttaaaaaatctgcagaaaaattcataggtagaatggtacggagatgcacctacctatccggggaacaagcgctaccaaaacaaagtttgctgtatgaaaaatttcaagtactaaatgaactaaataacctacgaataagaggagaaaaaattccagtatctctgaaacaagaaatatatcacgacttattcggagatggaaagaaagtaagtatgacacgactaactaattacttgttacaaaatggggtaatctcaggtgaagagaaagatagttgcatttcgggaatcgatggaggatttcacaactccttatcaagtgtaggtaaatttaaaggagtctttggagatacagtgcacacagatgaacaccgaaaaatgatagaagacatcatattttggggaactgtattcggagacggcaaaaaattattaaaagaaaaagttgaagaagtatacggaaaccaactcacagaagcacaaaaaaaaagaatatttggttttaaattttcctcatggggcagactatctaaagcattcctaacaatggaaggagcaagtaaagacgacggcgaaattaaaggattaatacaagcaatgtgggatactaactgcaacctaatggaattactatctgaccgtttcacatacaaagataaactaaacgaaatggtaaccacggcggaaaaacccttatgtgagtggaaaatagaagaccttgacgaaatgtatttgtcagcaccagtaaaaagaatggtatggcaaacgattagagttgtagatgaagtacaacaaataataggttgtccacccaaacgaatttttgtagagatgacaagaagcgacggagagaaaggtaaaaggactgtgtccagacaaaaaaagctcgtagatttatacaaagccctcggaaaagaaggaaaaacttggagtgaagaattaagcgacacacccgaatcgcaatttagaataaaaaaactttacttgtattacctgcaaatgggaaaatgcatgtacacaggcgaggcaatagaattagaacaacttatgaatgacaatctttacgacatagatcatatataccccagacacttcataaaagacgacaatatatcaaataacctcgttctagtaaaaaaagaaaaaaacgcacataaatcggacagtttcccgattgaaccagagataagaaataaaatgatgccattttggaaatctcttaggaagaaaggttttctgactgaagaaaaatacaatagacttacacggatgagtgccttcacagatgaagaaaaagcggccttcatcggaagacaactcgtagaaacaagtcaaggtacaaaagccataacgcaaatatttgaacaagcatttgcgaatagtgaaatcgttttttccaaagcttcggtagtcagtgcttttagacaaaagttcgactgctataaggttaggtgcgtaaataattatcaccatgctcatgacgcatatctaaacatagtggcaggcaacacatatagggttaaatttacaagcaatccattaaattttataaaagaagctaaaaaaaacccaaatagtagagagaataggtataatatggacaaaatcttcgaatgggacgtaactagaaatggagaaacagcatgggtcgcacaaacaaaagaacatccaggaaccatacaattagtaaaaaagtacttgaacaaaaacagtccattaattacaaaaatggtttacgaaaaacacgggggcataacacagaaggcaacaatatggagtgcaaaaaaagctgaaagcgggaatactgacgcatatataccagtcaaaatgaacgatcccagattagcagacgtcacaaaatacggaggagtaacgactatagccgtagcaggatatacgttattagaatataaagcaggaggaaagacggttagaagcctagaagcattgccaatctacttaggaggttcaaaaaagctgacagaagaacaaatggtggaatattttagcaatgtactacaacaagaaaataaagaaaaagtggttagtgacgttataatcagaaaaaagatgataccatcaggaagtctaatcaagtataacggattctactattatctagcaggaaaaacaggagataggataattctcatatctgcagtacagctatgcttaccaatggatacgatgttatatataaaaaagatagaaaaagcgtgttcaacaggaaattttgaagaaaaagataaaaatggcaagcaggtcctaagtaaacaacagaacgagtttgtctatgaacttataattcaaaagtaccaacaatctatattcaaaaaaaaagttggggcaataggagacacaataatcgaaaaaagggaaaaatttgccgaaatatcattagaagaacaatgcaaagttctcatgcaaatatttttgaatttccaatccggaataggtgtcgaattaaaaataattgaaggagggaagaaaagcggtgtaacttatcttaataaaaaagttatgaatgtacaagagctaaaactgatcgatcaaagtgtaacaggagtattctcccgtgaaatagatttactcacaatatga

SEQ ID NO: 5487 - RNA, 4125 nt, synthetic construct
  misc_feature 1..4125: note = Cas9 variant
  source 1..4125: mol_type = other RNA
atgaagaaacgttatagttattctattggtctagatataggaacaaattcagtaggctgggctgtaattaacgaagactataaagttccagcgaagaaaatgacagtttttggaaatactgaccgaaaaaccattaagaaaaatctattgggaacagtacttttcgacagtggagaaacagcacaagctcgacgactaaaacggacaaataggcgcaggtacacaagacgcagatatagattatgccaattacaaaacatattcgcgacagaaatggtcaaagttgacgacaccttctttcaacgtctgtctgaaagtttcttctactaccaagacaaagcgttcgataaacacccaatattcggaaactcaaaagaagaaagagcgtaccacaaaacatatccaacaatataccacttaagaaaagacctagcagacagagaccagaaagctgaccttcggctaatatacctagcattaagtcatataattaaattcagaggacacttcctgatagaaggaaaattgaatagcgaaaacactgacgttcaaaaattattcatcgcattagttacagtatacaatctactatttgaagaagaacctatcgctggtgaaacatgcgacgctaaagcactattaacagcaaaaacttcaaaatcaaaaagattagaatcacttataagtgagttcccgggacagaagaaaaatggtttgttcggaaacctgcttgcactagctctcggactacggccaaattttaaatcgaactttggactgtctgaagatgcaaaattacaaatcacaaaagacacatacgaagaagaattagataacctgctggctgaaattggcgatcattacgcagacttattcttagctgcgaaaaatctgtcagatgcaattcttttatcggacatactaaccctttctgacgaaaacacacgagcaccactaagcgcctcaatgataaaaaggtacgaagaacaccaagaagatttagcacttctcaaaaagctagtcaaagaacaaatgccagaaaaatattgggaaatattttctaatgcaaagaaaaatggatatgctggctatatagaaggcaaagttagtcaagaagatttctatagatatataaaacctatattatcacgtctaaaaggaggagacgaatttcttgcaaaaatcgacagggacgactttctgagaaaacaaagaacattcgataatggcagtatacctcatcaaatacatttgaaagaattacatgcaatactaagaaggcaagaaaaatactacccatttttagctgaacaaaaagagaaaatagaacaactattatgttttcgcattccatattatgttggaccacttgctaaaggcggtaactctagttttgcatggctaaaaagaagaagcgacgaaccaataaccccctggaacttcaaagatgtggtagatgaggaagcatccgcacaagcatttatagaaggtatgacaaattatgatacttacctacccgaggaaaaagtactaccaaaacactcacccttatacgaaatgtttactgtatacaacgaattaacaaaagtcaaatatatcgccgagaacatgacgaaaccactttacttaagtgcagaacaaaaagaagctatcatcgatcatctatttaaacaaacacgaaaagtaacagtcaaagacctcaaagagaaatatttcagccaaatagaaggtttagaaaacgtcgacgtaacaggtgtagaaggagcattcaacgccagcttaggtacatataacgacctcctaaaaattataaaagacaaagcattcctagacgatgaggcaaacgcagagatattagaggaaatcgttctaattctaacactatttcaagacgagaaactaatcgaaaaacgtcttgcaaaatacgctaacctattcgagaaaagtgtcttaaagaaattgcgaaaaagacactataggggttggggacgtttatcaagacaattgattgatgggatgaaagataaagcaagcggtaaaactattcttgatttcttaaaagctgatgacttcgcaaatagaaattttatacaattgatcaacgactctagcctagattttgaaaaactgattgacgacgcccagaagaaagctattaaacgagagagcttaaccgaagccgttgctaatcttgcaggatcaccagcaattaagaaagggatcttacaaagtttaaaagtagtagacgaaatagtcaaagttatgggccataatccagataacatcgtaatagaaatgtccagagaaaaccaaacgactgctcaaggactcaaaaatgcaagacaacgactgaaaaagattaaagaagttcataagaaaacagggagtaggatcttagaagacaactctgaaagaattacgaaccttactttacaggacaaccgattatatctatatctattacaagatggaaaagacatgtacacgggacaagatctcgacataaacaacctgtcgcaatacgacatagatcatataattccacaaagtttcataaaggacaattccattgacaatctcgtcctaactacccaaaaggccaatcgtggaaaatcagataacgttccatcaatagaggtagtaagagacatgaaggacagggtatggcgacgccagctagctaacggagcaataagcagacaaaaatttgatcatttaactaaagcagaaagaggtgggctagcagattccgacaaagcacgctttctcagaagacagctagtagagacacgacaaatcaccaaacatgtagcacagcttctagactcaagatttaattcaaaatccaatcagaacaagaaactggcaagaaatgtaaaaataataacgctaaaaagtaaaattgtaagcgattttaggaaggatttcggactatataaactcagggaggttaacaattatcaccacgcacacgatgcttatttaaacgctgtagtaggtacagcactactaaagaaatacccaaaactagaagctgaatttgtttacggagattacaaacattttgatctagttaaactaataagtaaatcagacccatcactaggaaaagctaccgcaaaagtattcttttatagtaacataatgaacttcttcaaagaagaactttcactcgcagatggtactctaatgaaaagaccagtcatagaaactaacactgaaacaggagaagtggtttgggataaagtaaaggactttaagaccatcagaaaagtattgtcctatccacaagtaaatatagtcaagaaaaccgaaatacagagtggagcattcagcaaagaaagtgtcttatctaaaggaaacagcgacaagctcatagaaagaaagaaaggctgggacccaaagaaatacggaggatttgactctcctaacacagcatatagtatttttgttgtagctaaagtagcaaaaagaaaagcccaaaaattaaaaacagtaaaagaaatagtaggtattacaataatggaacaagcggaatatgagaaggataatatcgccttcttggagaagaaaggttatcaagacatacaggaaaagctcttaataaaactaccaaagtactcgcttttcgaattagaaaatggacgacgtaggcttctagcctcagctaatgagttccaaaaaggaaacgagctagcactttcaggtaaatatatgaaatttctatacctagccagcagatatgataaactttcatcaaaaattgaatcagaacaacagaagaaattattcgttgaacaacatctgcactattttgacgaaatactggacatcgtagtcaagcacgcaacttgctacataaaagccgagaacaacttaaagaaaattatctcattatacaaaaagaaagaggcttactctataaacgaacaagctcttaacatgctaaacctattcatatttacatcacttggggctcccagcacatttgtctttttcgacgaaacaatagacagaaaaagatacactacatcaagcgatgtactcaacggtatattaatacaacaatcaatcacaggactatacgaaacaagaatagacttatcaagattcggcggagactga

SEQ ID NO: 5488 - RNA, 4125 nt, synthetic construct
  misc_feature 1..4125: note = Cas9 variant
  source 1..4125: mol_type = other RNA
atgaagaaacagaaattctccgactactatctaggattcgacatcgggacaaactcagttggatggtgcgtcacggacttggactacaacgtgctacgatttaataaaaaggatatgtggggaagtcgtttattcgatgaggcaaaaacagccgctgaacgaagggtccaacgtaacagtcgaagaaggttaaaaagaagaaaatggagactaaacctcctagaagaaatattctcggacgaaataatgaaaatagattctaacttcttcagaaggctaaaagagtcatcattatggcttgaagacaagaattcaaaagaaaaattcacactttttaacgacgacaactacaaagattatgacttttacaagcaataccccaccatattccacctcagagatgaactaattaagaatcccgaaaaaaaagatattaggttgatatacctagctctacatagtatttttaaatcaagaggacacttcctatttgagggacaaaacctaaaagaaatcaaaaatttcgaaacactctataataacctcattagctttctagaagacaacggaataaacaaaagcatagataaagataatatcgaaaagttagaaaaaataatctgtgacagtggaaaagggctaaaagacaaagaaaaagagtttaagggaatatttaactctgacaaacagctagtcgcgatcttcaaactttccgtcggtagcagtgtatctttaaacgacttatttgacacagatgaatacaaaaaagaagaagtagaaaaagaaaaaataagtttcagagaacaaatatatgaagacgataaaccaatatattattctatattaggagaaaaaatagaacttctggacatagcaaaaagcttttacgacttcatggtactcaacaacatactatcagactcaaattacataagtgaagctaaagtaaaactttatgaagaacataagaaagacctaaaaaacctcaagtacataatacgcaaatacaataaagagaactacgataaactattcaaagacaaaaatgaaaataactacccagcctacattggactcaacaaagaaaaagacaaaaaagaagtcgtagaaaaatcaagactcaaaatagacgatttgataaaagtaataaagggctatttaccaaagcctgaaaggatcgaagagaaagataaaacaatctttaacgaaattctaaacaagatagagctgaaaaccatactcccaaaacaaagaatttctgataacgggacactaccataccaaatacacgaagtcgagctagaaaaaatattagaaaaccaatcaaagtactatgacttcttaaattacgaagaaaacggtgtaagcactaaagacaaactactaaaaacctttaaatttagaataccatactacgttggccctctcaactcataccataaagacaaaggcggaaattcatggatcgtcagaaaagaagaaggaaaaattctaccgtggaattttgaacaaaaagtcgacattgaaaaaagtgcagaagaatttatcaaacgcatgacaaataagtgtacatacttaaatggcgaagacgttatacccaaagactcgttcttatacagtgaatacataatcttaaacgaacttaacaaagtacaagtaaacgatgaatttttaaacgaagaaaataaaaggaaaataatagacgaactattcaaagaaaacaagaaagtatcagagaaaaaattcaaggaataccttttagtaaaccagatcgctaaccggaccgtagaacttaaaggcattaaagactcctttaattcaaattatgtatcctacattaagtttaaagatatatttggagagaaattaaacttagatatctataaagagatttccgaaaaatcaatactatggaaatgcctatatggagatgacaaaaagatatttgaaaaaaaaattaagaatgaatatggtgacatacttaacaaagacgaaataaaaaaaattaattcattcaaattcaacacatggggacgcctgtcagaaaaactactgacagggattgaatttatcaacctagagacgggggagtgttactccagcgtaatggaggcactaagaagaactaactacaacctgatggaactattgagttcgaaatttacgctacaggaatcaatcgataacgaaaacaaagaaatgaatgaagtgagctaccgggatctaatagaagagagctacgtaagtccctccctaaaacgagccatactccaaacattaaagatatatgaagaaataaaaaaaataacaggtcgcgtaccaaaaaaagtattcattgaaatggccaggggcggggacgaatccatgaaaaacaagaaaataccagcgcgacaagaacagcttaaaaaactatatgactcgtgtggcaatgacatagctaatttctcaatagacataaaagaaatgaaaaactcactgtcatcctacgacaataactcattaagacaaaaaaaattatatctctactacttacagttcgggaagtgcatgtataccggaagagaaatagacttagatagacttctacaaaacaacgacacatatgacatagaccacatatatccacgttcaaaagttataaaagacgatagcttcgacaacctagtattggttctaaaaaacgagaatgctgaaaaaagcaacgaatatcctgtcaaaaaagaaatacaagaaaaaatgaaatctttctggagatttctaaaagaaaaaaacttcatctctgacgaaaaatacaaacggttaacggggaaagacgatttcgaactgcgaggattcatggcaagacaactagtaaatgtccgtcaaacaacaaaagaagtcggaaagatccttcaacagatagaacccgagataaaaattgtatacagcaaagcggagatagcatcatccttcagagaaatgttcgacttcataaaagtaagagaacttaacgacacacaccacgctaaagatgcttacctcaatatagtcgctggaaacgtatacaacaccaaattcacggaaaaaccctacagatatctgcaagaaatcaaagaaaactacgatgtaaaaaagatatataactacgatataaagaacgcatgggacaaggaaaacagcctagaaatcgtcaaaaagaacatggaaaaaaatacggtgaacataacgcgatttattaaagaagaaaaaggggaattatttaatctaaaccctataaaaaaaggagaaaccagtaacgagattatatcaataaaaccaaaactatacgacggaaaagacaacaaactaaatgagaaatacggctactacacgagtctaaaggcagcgtactttatttatgttgagcacgaaaaaaaaaacaaaaaagtaaaaacatttgaaagaatcaccagaatagattccaccctcataaaaaatgagaaaaatctaatcaaatatctagtatcacaaaaaaaactattaaatcccaaaataatcaagaaaatatacaaagaacaaaccctaataatcgacagttacccatatacattcacaggagtggatagcaacaaaaaagttgaactaaaaaacaaaaaacaactatacctagaaaaaaaatacgaacaaatcctcaaaaacgccctaaagttcgtagaagataatcaaggagaaacagaagaaaattacaaattcatatacctaaaaaaaagaaacaacaacgaaaaaaatgaaactatagatgcagtaaaggaacgatacaacatagaattcaacgaaatgtacgacaaattcctcgaaaaactctcaagtaaagattataaaaactacataaacaacaaattatacaccaattttcttaactcaaaagaaaaattcaaaaaacttaaattatgggaaaagagcttaatactacgggaattcctaaaaatattcaacaaaaacacatacggaaaatacgaaataaaagactcacaaacaaaagaaaagttattttctttccccgaagacacgggcagaatacggctaggccaaagtagcttaggaaacaacaaagaactactagaagaatctgtaacaggacttttcgtcaaaaaaataaaactctga

SEQ ID NO: 5489 - RNA, 4128 nt, synthetic construct
  misc_feature 1..4128: note = Cas9 variant
  source 1..4128: mol_type = other RNA
atgtcaaacaaaccatacagtattggtttagacataggaactaatagcgttggatgggctgttataacagacgactacaaagttccatctaagaaaatgaaagtattagggaacacagataaacatttcataaagaaaaatctaattggagcattactcttcgacgaaggcactacagccgaagacagaagactaaaacgaaccgcccgcagaagatatacaagaagaaagaacagactgcgatatttacaagaaattttcttcgaagaaatgtcaaaattagatagcgggtttttccaccgcttggacgatttctttttaattccagaagacaaacggggcagcaaataccccatatttgccaccctagctgaagaaaaagaatatcacaaacagtttcctacaatataccacctaagaaaacaactagccgattctaaagaaaaagccgacctcagactcatatacttaactttagcccacatgatcaaataccgaggccactttctatacgaagaaagttttgacatcaaaaacaacgatatccagaaaatatttaacgaatttatatccatatacgacaatacattcgaaggttcctcactaagcggacaaaatgcacaaatagaagcgatcttcacagacaaaatatccaaatcagctaaacgggaacgagtactaaaattattccccgatgaaaaatcaactggattattctcagaatttttaaaacttatagtaggaaaccaagccgacttcaagaaacactttgaactagaagaaaaagcaccactacaatttcccaaagacacctacgatgaagatctagaaaatgtcctagggcaaataggtgacgacttcgctgacttatttgttgcagcaaagaaattatacgacgctatattgcttagtggaatattaacagtaactgacccatcaaccaaagcaccactatcagcttccatgatcgaaagatatgaaaatcatcaaaaagacctggcagcactaaaacaattcataaaaacaaatctacccgaaaaatacgtagaagtctttagcgatcaaagcaaagacggctatgctggctatatagacggaaaaactactcaagaagcattttacaaatacatcaaaaatctattatctaaattcgaaggaacagactacttcttagataaaatagaacgagaagatttcctacgaaaacaacgtacattcgataatggatccatccctcatcaaattcacctacaagaaatgaatgcaatactaagaagacaaggtgaacattacccgtttttaaaagaaaataaagaaaagatagagaaaatacttaccttccgtataccatactacgtaggccctctagcccgaggtaatcgggacttcgcctggctaacaaggaactccgaccaagcaatccgaccctggaatttcgagaaaattgttgacaaagcatcgagcgctgaagatttcataaataaaatgacaaactatgacttatatcttccagaagaaaaagtactaccaaaacacagcctactctatgaaaccttcgcagtatataacgaactcacaaaagttaaatttatcgcagaaggactaagagactatcaattccttgacagtgggcaaaagaaacaaatagtcaaccagctctttaaagagaaacgcaaagttaccaagaaagatataatccactacctacatacagtagacggttacgacggaatagaacttaaaggcatagagaaacaatttaatgccagtctatcaacataccacgacctattaaaaatcataaaagacaagaaatttatggacgattctaaaaacgaagcaattctagaaaacatagttcatacattgaccatattcgaggatagagaaatgataaaacaaagattagcccaatacgatagtctatttgacgagaaagtaatcaaagcattaactcgccggcactatacaggatggggcaaactttcagccaaactaatcaacgggatctgtgataaacaaacaggtaacaccatactcgactacctaatcgatgacggggaaatcaacaggaatttcatgcaattaatcaatgacgacggcctctcatttaagaaaataattcaaaaatcacaagtcgttggcgagactgacgatgtaaaacaagttgtccgagaattaccaggtagcccggccattaagaaaggtatactacaatcaattaaaatagtcgacgaactcgtgaaagtaatggaccatgccccggaatccatagttatcgaaatggccagagaaaatcaaacaacggcacgaggcaagaaaaatagtcaacagcgatataaaagaatagaagacagtctcaaaaacctcgcctcaggtctagacagtaatatactaaaagaaaacccgaccgacaacatccaacttaaaaacgacagattattcctttattacctgcaaaatggaaaagatatgtacacaggcgaagcactagatattaatcaattatcatcctatgatatagatcacattattccacaagcattcataaaagacgattcattagacaatagagtattaaccagttcaaaagacaataggggaaaaagcgacaatgtaccatccctagaagtcgtacagaaaagaaaggctttttggcaacaacttctagattctaaactaataagcgaaagaaaatttaacaacttaactaaagctgaacgtggtgggctcaatgaacgagataaagttggattcatcaaacgccagcttgtagaaaccagacaaataaccaaacatgtcgctcagattctggatgctagatacaacactgaagtaaacgagaaagacaagaaaaatagaacagttaaaattataactttaaaaagcaatctagtaagcaacttcagaaaagagttccgactatataaagtaagagaaataaacgactatcatcatgcacacgatgcttacttgaacgcagtagttgcaaaagcgatactaaagaaatacccaaaactagaaccagaatttgtatatggagaataccaaaaatatgacctcaaacgctacatctcacgaagcagaaaccctaaagaagtcgaaaaagcaacagaaaaatatttcttctacagtaaccttctaaacttcttcaaagaagaagtgcattacgcagatgggaccatagttaaaagagaaaacatagaatattcaaaagacacaggagaaatcgcatggaatacagaaaaagatttcgcaacaatcaagaaaatattatcatacccacaagtaaatatagttaagaaaacggaagaacaaacagtgggacaaaatggaggactattcgataataatatagtctctaaagaaaaagtagtagacgcatccaaacttatacccatcaaatcaggcctaagtcccaagaaatatggaggatacgctagaccaacaatagcttactctgtattagttacatacaaacaaaacaacaaaatcaaaaacacaatggtaggcatccctgtattaacgaaactagaatttgaacgcgatcccaatttatacttaaggaatttgggaattaacaacgtatcccacgtaataaaattagtcaaatatacagtccttgaatttaagcacaaatacggtacgtacagacggttcatagtaagtaaccaggaactaaaaagagcaaatcaaatcttcgtaacaacaaagcaaatgaaactaatatctcagtataccacacttgacaaaaatgaacatgatagtctactgaaaaataatcaacaacttatacaatctatctggaaccaatttctagagttcatgctagcgactgacctggtcaataagaaacaatacgatgaattaatattaacaaacaaccaaacaatagaagagtgcagaaatattatgaatcgagtcatcacaacccttagttttacgaatattaacgccggacagaagaaaattatcttcgatgacactctatctttaccaataaagagatggcaattcactgactctgacaaaatggtcaagaaaataattgaaagcacactaatacaccaaagcatcactggactttacgaaacaaggattgacctatcaaaactcggagaagactga

SEQ ID NO: 5490 - RNA, 4128 nt, synthetic construct
  misc_feature 1..4128: note = Cas9 variant
  source 1..4128: mol_type = other RNA
atgaaagaataccatatcggtctcgacataggaacatcgagtataggctgggccgtcacagacagtcagtttaaattaatgaggataaaagggaaaacagcaataggagtccgactatttgaagaagggaaaacagcagcagaaagaaggacattccgcacaacacgacgacgtcttaaacgcaggaagtggaggttacattatttagatgaaatctttgcacctcatctacaagaagtagacgaaaacttcttaagaaggctgaaacaatcaaatatacacccagaagatccagccaaaaaccaagcatttataggaaaactactattcccagacctattaaagaaaaacgaacgaggatatccaacattaataaaaatgcgagatgaactaccagtagaacaacgagcacattatccagtaaccaacatatacaaactaagagaagcaatgataaacgaagatcgacaatttgatttacgcgaagtataccttgcagtacatcatatcgtaaaatatcgaggtcattttctaaacaatgcgagtgtcgataaatttaaagtaggtagaatagatttcgacaaatcttttaacgttttaaacgaagcatatgaggaactccaaaatggagaagggagcttcacaatagaaccatcgaaagtagaaaagattggacaactcctattagacaccaaaatgagaaaactcgaccgacaaaaagcggtagccaaactactggaagtaaaagtggccgacaaggaggaaacaaaacgtaacaaacaaatcgcaactgctatgagcaaattagtccttgggtacaaagcagatttcgcaacagtagcaatggtaaatggaaacgaatggaaaattgatctctcgtccgaaacaagcgaagacgagatagagaaattccgagaagaattatccgacgcacagaacgacatattaaccgagattacttctctattttcacaaataatgctaaacgaaattgtaccaaacggaatgtcaatatctgaatcaatgatggacaggtattggacccatgaaagacaacttgcagaagttaaagaatatttagccacacaaccagccagcgctcgaaaagagttcgaccaagtatacaacaaatatataggacaagcacctaaagaaaaaggtttcgacctagaaaaaggcttgaagaaaatattatcaaagaaagaaaactggaaagaaattgacgaactactaaaggcgggtgattttctgccaaaacaaagaatcagtgctaacggtgttataccacatcaaatgcaccaacaagaattagaccgaataatagaaaaacaagcgaagtactacccctggctcgcaacagaaaacccagcgaccggagaaagagacagacatcaagcgaaatacgaactcgaccaactcgtatcatttcgtattccatattatgtagggccattagttacaccagaagtacaaaaagcaacctcaggagctaagtttgcctgggcaaagaggaaggaagacggagaaataacaccatggaacctgtgggataaaatagatagagcggaatcagcagaagcctttataaaacgaatgacggtaaaagatacgtatctattaaatgaagatgttctcccagctaattcactgttatatcaaaaatacaatgtattaaacgaactaaataatgtccgtgtaaacggaagacgattgtcggtgggaatcaaacaagatatatatactgaactattcaaaaagaagaaaacagttaaagcatctgatgtagcatcattagtaatggccaaaacgaggggcgttaataaacccagtgtggaaggtctgtcggatccaaagaaatttaactcgaatttagcaacatacttggacctgaaatcaatagtaggggataaagtggatgacaatagataccaaatggacctcgaaaacattatcgaatggcgatcagtgtttgaggacggagaaatattcgcagataaacttacagaagtagaatggctaacagacgaacaaagaagcgctctagtaaagaaaagatataaaggatgggggagattaagtaagaaactactcacaggaatagtcgatgaaaatggccaacgaataatagatctaatgtggaatacagatcaaaattttatgcaaattgtaaatcaaccggtatttaaagaacaaatagaccaattaaatcaaaaagcaataacaaatgacggcatgaccttacgtgaacgggtagaaagtgtactagacgatgcatatacatccccgcaaaacaagaaagcaatatggcaagtagttagagtcgtcgaagacatagtaaaagcagttggcaatgctccaaaatcgatatccatagagttcgccaggaatgaaggaaataaaggagaaataacccgaagtagaagaactcaacttcaaaaactctttgaagaccaagcgcacgagctagtaaaagacacatccttaacagaagaattagaaaaagtacctgacttatcagatagatattacttttactttactcaaggaggaaaagacatgtacacaggggacccaataaattttgacgaaatatcaacgaaatatgatatagaccacattttaccacaatcctttgtaaaagatgatagtctagataatagggtattaacgtcccgaaaagaaaataataagaaatccgatcaagtacctgcaaaactttatgcagcaaaaatgaaaccatattggaatcaactccttaaacaagggttaataacacaacgaaaatttgaaaatcttacaatggatgttgaccaaactattaaataccgttcattaggatttgtaaaaaggcagctagtagaaacgagacaagtgatcaaactaacggccaacatacttggatccatgtatcaagaagctggcactgacatcatcgaaacaagagcaggcttaacaaaacaactaagagaagagttcgacttgccaaaagtcagagaagttaatgattaccaccacgcagtagacgcatacttaacaacatttgctggacaatacctaaaccgtagatatccgaaattgcgatccttctttgtatatggagaatatatgaaatttaaacatggaagcgacctaaaactaagaaactttaactttttccatgaattaatggaaggcgataaatcacaagggaaggtagttgaccaacagacaggtgaattaattaccactagagatgaagttgcagattattttgattgggtacaagacctaaaattgatgttagtaacaaaagaacttaaaagatccaacggaaagttattcgatgctaccatacaaaatgctaactatacaaaattaaatgaacgaaagaaagtatttgttcccctaaagaaagaactagataaaacattatatggatcttatagcggaatacagagtagctatatgacaatcgtaaagaaatttgataagaaagggtcaacttacgcagtgcaaagaataccagtaatgtactcaaaactattggaacttgaaaaagaacaatccaaactcaacagattagtccaaagcatagtgacaagtgatccacaagcccccaataattttgaagtgttaatgccatgtgttctgagcggccaactggtaatagacaacggccgaaaatttacactgacatcatacagataccaatgtagtacagcacagctctttttaccaaagaaagacctgaaatatatacaaaacaatttcaaagaacttaagaaaacgcccgataaacaagataaaatatttgaaactatatatgacgatatcttaaaacaagtagataaatatttcagcttatatgacattaacaaatttcgatccaaactccatgatggtaaagacaaatttctagcactcgaaaacttcggagaaaaagaaagcaaagataaagtcataacaaaaattcttagaggcctacatgctaacgcagaaagaacatccctaaaagaaatagggctgagcactccactaggtcaatttcaaagtggcgaagggggaattactctcagcgacaacaccaaaataatataccaaagtcctaccggtctttttgaacgccatgtctacctaaaagacctatga

SEQ ID NO: 5491 - RNA, 4128 nt, synthetic construct
  misc_feature 1..4128: note = Cas9 variant
  source 1..4128: mol_type = other RNA
atgagaaagaatcaggaaccatataatataggattagatataggaaccagttcaataggatggtcaattatgaatgataacttcgatctcatgagagttaaaggcaaaaaaggcattggagtccgtctatataatgaagggcaatcggcggcggagagaaggatgcaccgaacagccagacgaagatatgggcgaagaaaatggcgactaagattacttgaagacttttttgatgaacacatggccgaagtagacgacacatttttcgcgcgactaaaagattcaaatataagtccgaaggacgataaaaaatacagaaaaagtcttttatttccgaaatcaaaaggtgtaacgtatcaagatgatggcgaattttataaaaaatatcctaccatgtaccatttacggtacgccttgatgactgaacatcgtaaatttgacttgcgagagatatacttagcattccatcatatggtaaaatatagaggaaattttctatatgacacaagcgtcgactcgttcgaggcaaagaatctcgatataaaaggaaaattcgatgaaataaatgacttactctcatcatacacagacttttatgtagataactcaaacgctgcacttgtcgagtcaatcctgttagaaaaaaacacaacaagaaaagataaatcaaaaaaaatcgctaaattattacacgtagaagataaagaaaaaggcaaaaacaaaaaagcaaaagacttagccactcaaatatcgaatgcagtattaggtttaaaatgcaacttccacctaatcttcgagttacaacaaaaatactcatttgatttatgctcagaaaaaacggaagaaaacatcgctaaattaagtgaagtgctagacgaaaaccaaaagatgctactcatgatactaaaagaagtccaggatcaagtaatgcttaatgcattcgtacctagtggaatgagtcttagcgaagctatgatgcaaaaatatgatgattacggtgaacaacttaaaatataccacgaactagaacacagtgtaagcgatgacagcgcagccaaactaagaggcgcatatagagattataatgacaacataataaaacgcatcgatggagacaacaaaaaagacactttctacaaaagagttaaaaatattctaacaaaaatatccaaggagtatgtagaccaagatgtattagaatcatgtggtaaattaaaaaaactaatagatgaaaacaaactatttatcagacaaagaacagcggcaaacggcgttctaccccaccaattacatcaaattgaaatgagaaaaattattgataatcaaaaagagtattatccttggttagcggaaccaaacccaaacgaaaaacgtcgcgtatatagtaaatataaagtagaagagttaatagcttttagaatcccctattatgtaggaccattagtggatccaaacaacgcagacaaaaacaaagaagcacgattttcctggatggtaaggaagaaagatggagagataactccatggaatttttatgacaaagttgattgggcagaatccgcgaacaacttcatagaaagaatgaaatcaaaagatacctacttactaggggaagacgtggtacccaaagaatcaatgctgtaccaaaaatatgaagtactaaatgaactaaataatttaagaataaatgactcagggttatcagacagttttgaagacgtaaaactcaaacaagcaatatacaacgatctattcaaaaaacagaaaattgtaaagattaccgatttacaaaattacttagtccagaaccacaaatatttagttaaaccaaagataagtgggctagcagacgaaaacagattcttatcaagcctatccacatacagtgatctaaaaaccatctttggggataaagtagatgaccgaacttattttaatgacttcgaaaaaatggtagaatacagcacagtatttgaagacggacatgattacaaccaaaaacttgatgaatacacatggcttacaaaagaagaaaaatacaaaatcggaaaaaaacgatatagaggttggggcaaattaagtaaaaaattattaacgggactaagggataaaaacaatcatacaataatggacaacctatgggaaacaaatcgaaacttcatgcaaatacaaactgcagatgaatttagtaaacaaatagcagaagagaacgagagacacttaaaaggatcagttagtgacgcaataaatgacatgtacacatcccctgcaaacaaaaaagcaataagacaagttcttcgagtagtggatgatatacaaaaagcaatgggctacgcaccatctagtatatccttggaatttgcaagagaagatggcccatcagtacgaaccgtttcacgggccaatagaatgaagtctatttacgaaaaatacgctagtgaagtcagtgaggaagtaatgaaagatctcgatggagtaataaaggataaaaagggtttaaatgatcgactttacctctattttgaacaacaaggaaaagacatgtactcgggtcacccgttagacttcgacaaggtaatatccggccaagaatacgatatagatcacattttaccccaagcagtaatcaaagatgattcactagacaacagagttctgacgactaaagccctaaacaatgacgtaaaatctaaaggagtaccatgcagaatgtttaatggtatgcactctttttggaaaaacctatatgacaaaggattcatcagcagaagaaaatttaataatttaacaacaaatccagaaaacatagataaatacaaaatgaaaggatttgttaaccgacaactggtagaaactcgccaaattataaaattagttgcaaatgtactaaatgacaaatatcaaaacgatgacgtcgacatcatagaggtgcgtgcggaactgacacacgacgtcagaaagcatttcaagttctataaaaaccgcaacgtaaatgattaccaccacgcatttgatgcatatctaacctcattcataggacactacctcttcaaaaaatatccaaacctgcgaccgcttttcgactacaacgattttatgaaggtgagtgacaacgtatttaaacaactccgaggtaataatttcctaggcgaatttctcaacaaaacaggcgatataattagcacagacggaaatttcgtattaaacaaagaagagatgataaataaattgaacaaagcgtatgcctttaaaaaaatattagttactaaagaagtaggccaacgaactggagcaatgttcaacgaaacacgttaccctgcaccaaacagtaggaaagcagccttaaaatatagacgcatgccgaaaccagactcacttatatcagtaaaagactataaaaataccgatatatatggaggatattcaggaaaaaatgatgcatatatggtcattgtagacatgggaaaacaatacatggtagtaggggtacccgttagatacactgaaaaactggataaacttagaataaagcattcagaactatacagagatgagttgcgaaaagtactttcaagagataagacattattagactcaaaagggaacgttaaaagatttgatatagttctagaccgcgtcctatacggacaattaattgaagacggaaatgaattattcacattaggtagcagtaaatataaaagaaatttcagacagctatttttggacaagcagtgtatagaaatacttgactcctccgcaacacctcaacctacggacgaagaactcatatgggtatatgaccagatactagataaagttgacaagtacttcgaactatatgatattaacagacaacgggaaacgctcagaaaaggacgagctgcattttgttcactcccaaacatatcaatgaaaaaagatgacgttacaaaaaagaaaatactaaacgagatactagtcgcattacacgcaaatgaatcagaatccaactgtgaaaaaatcggtaaaaaagtcttcggacgtttgcaagtaccaggtgggataaaactttcaaaagaagccaaacttatataccaatcaccaacaggcttatttgaacgagttgtatacttgaaagacctttga

SEQ ID NO: 5492 - RNA, 4128 nt, synthetic construct
  misc_feature 1..4128: note = Cas9 variant
  source 1..4128: mol_type = other RNA
atggaaaacaagaaatatagcataggtcttgacataggaaccagcagtatcggatttgccgtagtagatgaaaacaatagagtaatgcgtgtcaaaggtaaaaacgcaatcggagtaagactcttctcggagggacaacctgcggctgatcgtagaagttttcgaacaacaagaaggagattgtctcgacgaagatggagattacgactacttcgagaaatattcgaaccttacatcaaccccgtagatgaagcattctttatgagactcaaagaaagcaacttatcacctaaagatgcaaacaaacattattctggagacattttatttaataatcaaaccgaccaagatttttacgaaaaatacccaacgatctaccatttgagacacgccttaatgacagaacacagaaaattcgatgtaagagaaatttacttagcaatccatcatatcgtaaaattcagaggacacttcttaaatgccgccagtgcttcaaacttcactgtcggaaaactaaacttagaaggaaaatttgatgcactgaatgaaatatatcagagagtccttactgatgacccattcgcattgagaacagataacttagaccacataaaagaaattctcattgataacaaaaggagtcaagcagaccgccaaagaacattaactggagacgtctaccagtcctccgaagaaaaagaaatagaaaagaggaacaaagccatagcaacagaaatacttaaagcagcagtcggaaacaaagcaaaacttaatgtaataacgaacgtagaagtggataaagaagcagctaaagattggtcactaaccttcgatagtgagaccatcgatgatgaattagccaaggttgacggccaaatgactgatgacggacgcgaaataatagagatattacgatcactatacagtggtataacactagccgcaattgtccccgagaatcatactctttctcaaagtatggtggaaaaatacaactcacacaaagcacatctcaaactcctaaaagatttaataaataacatgacagacactaaaaaggctaaaaatctcagggcagcatacgatggctatatagatggtgtaaaaggaaaagtacttacaagagatgacttctacaaacaaattcaaggaaatttagacgattctgcagaagcacagaaaatccaagatgttatggaccaagacgaatttatgccaaaacaaagaacaaaagccaacgggtcaataccccaccaactacaacaacaagaattagaccaaatagtagagaatcaaaaagaatactacccatggctagctgaagaaaacccaaatgaaacaagacgtggtgttgctaaatacaagttagatgaacttgtaaccttcagagtcccatattacgtaggaccgatgataactgccgaagaccaagaaaaacaatcaggagcgtcctttgcttggatgaaaagaaaagaaccaggtaacatcaccccatggaactttgatcaaaaagttgacagaatggcgtctgccaatcaattcataaaacgaatgacaacaaccgatacgtacctactaggagaagacgtcttaccggcacaatcacttttatatcaaagatttgaagtactaaatgagctaaacaaaattcgcatagatcgcaaacctatatcgatagagctaaaacagcaaatctttaacgatctatttaagaaattcaaaaacgtaaccataaaacatttacaagaatatcttgttgctactggaggatatgataaaaggcctagaattgatggcttagccgacgagaaacgatttaactcagggttatcagcctatcacgacttacatggaattttaggagcagaagtagtagatgcaaatgacaaacaagatgatcttgagaaaattatagaatggagcacaatctttgaagataagaaaatttacagagctaaattggacgaacttacatggctaaccgattcccagaaagagaaattggcaacaaaacgttaccaaggatggggaaggctaagcaagaaattactatctggtttacgcaattctgatcatagatcaatacttgatatactttggatcacgaacgaaaactttatgcaaatacaagcagatccagattttgcagaattggtcaaaaacgctaaccaaggaatgctgggcaaaaataactctcaagacgtaataaacgatttatacacatcacctcaaaataagaaagcaataagacaaatattattagtagtacatgatattcagaatgctatgcacggacaggcaccggccaaaattcatgtagaatttgcccgtggagaagaaagaaatccaaggagatcaattcaacgacaacatcagatagaagcagcgtacgacaaagtaacatctgatctattagtggacgcaggagtacgtcaagaactgaaagatgcgataaacgacaaaagagactttaaagatcgcttattcctatactttatgcagggaggaagagacatctacaatggagagcccatcaatatagacagattatcatcatatgatatagaccatattctcccacaggcattcgtcaaagacgattcactgaacaaccgcgtccttacagacgctgaaggaaatagaaggaaatcggacgcagtcccgagtgagctctttggagcaaaaatgaggtccacatgggaactaatgcgggaacaaggcttaataagcaaagcaaaatatcgcaacttaacaatgaacccagaaaacataaacgcgcataccgagaacggctttataaacaggcaattagttgaaacacgacaagttataaaactagcagtaaacattctagcagacgaatataccgaagacacccaaattgtaagtgtcaaagctgacttaagccatcaaatgagagaagatttcgaattacttaaaaatagagatgtaaatgactatcaccatgctttcgatgcttatcttgcagctttcataggaaattacctacttgaacgataccctaaattgcaatcatactttgtatacggagattttaagaaatttagccaaaaagacaccaaaatgagaagattcaatttcatttacgatctaaaacattcagatcaaatagcagataaaaatggaaagaaaatatggcataaaacaaacgatctagactacatacgacatctgtttgcttataagaaaatcttaatatctcatgaagttagtgaaagacgaggagcgctatataaccaaactgtgtataaagcatcggatgacaaggcttcaggtcagggcagtaagaaactcatcccgataaaagctaacaaaccaactgaaatatatggcggatatacaggaaaaaccctagcttatatggcaatagtaaaagttatcaaaggaaagaaaatcgcgtataaagtggtgggtgttcccacgtccgcacttgtacaattagctgggatagaacacggctcccaagaagaactcaacagattatacgacgttttaaaacctcagttcactcaattaaagaaaaacaacaaaacaggagaaataagcgaaacggtatccaaatttgaaattgtgatccccagagtaaaataccaacaattagtagaagacgatgataaactatttatgataggaagcgacacctatccatacaacgcacaacaactggtcctatcagaaggggcattgaaagtcattaacaatgtgtacaggaaaggagaaaattcagataaacaagaatcctataaactcgacgacgtatatgacgaaataataattgcaatgaagaaatactttccattatacgacaacagaggatttagggaaaaagtggccgaaggaaaatccactttcgagaatctacccatatcaaacgaatttaaaaacggaaaattaacgaaaataggaaagaaagaagttatcaatagaatgttacaaggactacacgcgaatgccaccatgacagatctaaaaatactaggaataaaaagtcctttcggttttatgcaacaaccaactggaatagccttatctgaaaatgcacagctcatttatcagagtccaacggatttatttgaaagaagagtccaactaaataaaattaaatga

SEQ ID NO: 5493 - RNA, 4128 nt, synthetic construct
  misc_feature 1..4128: note = Cas9 variant
  source 1..4128: mol_type = other RNA
atgaagaaaattctcggcttagacctgggcacaacaagcatcggctgggccctcgtatatgaaagtgaaaacacggacgaaaaatcgagcattgtacgacttggagtacgagtcaaccccctttcagtcgacgaaaaaggaaatttcgaaaaaggaaaagcgataaccaccaacgctgaccgccaacaaacacatggagcaagaatcaatttacaaagatacaaattaagacgcgaaaacctgaaagattgtctgcaaaaacaaggatggatcggtacagaagccctatgtgaagaaggaaaaacgagtacatttgaaacatatatgctacgagccaaagcagccgaagaagaaatcagtctacatgaattatgccgagtactcttcatgatgaataagaaacgaggctacaaatctaatcggaaagcaaacaacaaagaagatggaaaactcttcgacgggatgacagtggccaagaaactgtatgaagaacatctcacaccagcggaatatagtttccaactattatcaagcggaaagaaatttaaacaagaatattatcgaagtgacctgaaagaagagtttgaccgcatctggaacgaacaacaaaaatattatccagaaatcttaacggatgattttaaacaacaactacaaggaaaaagtaaaggaaacacgtcaaaaattttcttgggaaaatatggaatatactcagcagatctcaaaggactagaccgtaaactacagccactaaaatggcgtgtagaggctttaaaacaacaagtagataaagaagtattagcatttgttataagtgacctcaacggtcaaatagcatctacatcaggactcctaggagccatatctgatagaagtaaagaactatactttaacaaacaaacagttggacaatacctatggacttcattaaaagaaacaccccatgtatcaattaaaaacaaacctttttacaggcaagattaccttgacgagtttgagaaaatatgggaaactcaagcaacatatcacaaagaattaactcccgaattaaaacaagaaatacgagatataataatattctatcaacgaccattaaaatccaagaaaggcttgatatcagtatgcgagctagaacaaagaaaagtcaaagttaccattgatggaaaagaaaaagaaataagtattggcccaaaagtagcaccgaaatcatcccccatgtttcaagaatttcgtatatggcaaaatttaaacaatatactcttaatagataaaggtaacaattcaatacacccactatatgaagaagagaaaaacttgctatacgaagaactaagcgtaaaggagaagttaagtaaagcagaagccctaaaagtcttgaataaaaacagcaaacaatgggatctaaattacaaagaaatagaaggtaaccgcacccaagcagtcctttacgattgttacaatagaatcattgtaatgacaggacatgaagagtacaatttcaagaaattaaaagcaagcgaaataagaagctatgtgaaaacgacatttaccggtttaggttttaacacggacatcctagaatttgatagttcacttacaggtcatgaactagagaaacaacccatgtatcaactatggcacttactctattcctatgaatccgataacagcaggacaggcaatgatgccctattacgaaaactagaaacggcattcggctttcctaaagaatatgcagctgtactcagtgacgttgtttttgaagattcatacggaaatctatcagttaaagccatgaggaaaattttacctcatttacaagcaggattgaactactcacaagcctgtgaagaagcaggatacaaacactcaaggagaagtttaaccaaaaatgagcttgaccaaaaagaatataaagaaaaactagaacttcttccgaaaaattcactacacaacccagtcgtcgagaaaatcctcaaccaaatgataaacgttataaacgcggtgatagacgaatatggaaaaccagatgaaataagaatagaattggcaagagaattaaagatcggagccgcagaaagagaaaatatgaccagatcaatcaaccaaggaaatgcagaaaacaaaagaatacgcgaaatactagaaaaagagttcgcattaagttacataagtagaaacgacataataaaatacaaattatacgaagaattaaaatctaacggatttaaaaccttatactcagatacttacatatcaaaagataaactcttcagtaaagactttgacatcgaacacatcatacccaaagcgcgcctatttgacgatagcttaagcaataaaactatagaagcaagagatgttaacatcgccaaatcaaataaaacagcatttgactttatatcagaaaaatacgatcaacaaggaatcgaggcttacaaaaagaaattagatatactcctgcaggatggctctatatctaaagccaaatacaataggctattaatgaaagaagcagacataccatcaggttttatagatcgtgatctccgcgacacacagtacatagcgaaaaaggcatacgagatactttccgacctggtaagaaatgtaacacccaccaccggcgcggtcactagcagattaagagaagactggcagctagtagacgttatgaaagaacttaacttcgaaaaatatcaaaaactaggattagtagaagtcatagaagatcgtgacggaagaaaaatcaaacgaataaaagattggacaaaaagaaacgatcataggcatcacgcaatggatgcactaacaatcgcattcacaaagcctagttatatacaatatttaaacaacttaaatgcacggtcagacaaaaacagctcaatatatggaatagaaaataaagagctacacagagaagataataaacttcgatttaacgcaccattacccatcaacgagttcagagcggaagcaagaagacaccttaaatcaatactcgttagcgttaaagctaagaataaagtcatgacacaaaatgtaaatgtaataaaaactaaacacggagtaataaagaaagtacaactaacaccaagaggagaattacataatgccacattttatggtactaagaaaagacctataataaaaatggtaaaagtgggtgccgctttagacgaagtaacaataaagaaagtatccagtagttttatcagagaggctttactggaccgtcttcatgaatataacggcgatgccaagaaagccttcacaggtagaaactccatagacaaaaatcccatatatatcgacgaagaacataagaaaacagtaccagctttagttaaaaccatcgaatgggaaatgtaccaccccactagaaaactcatttcaccagatttaaaaattgacaaagtaatcgataaaggcataagggaaatacttaaaacccgactggctaaattcaacggcgacgcacaaaaagcgttttccaatctagacgaaaacccaatctataaagacgaagcgaagaaaataaccttaaaaagagtttcactcgaaggagtatcctcagtaataccactacacacactcaaagatagggaaggaaaactggtagtaggtaaagatgggaaaccagtactcggggactatgtacaaacatccaataaccaccatatagcattctatatggacgaaaacggaaacttacaagacaacgttgtatccttctttgaagcagcagaacgaaaatcccaaggagtaccagtaatagataaaaattataaccacgacaaagggtggaactttctatttacaatgaaacaaaatgaatattttgttttcccaaacgaagtgacgggctttaatcccagcgaagtagacctgatggatgaagcaaactactcaataatcagcccaaacttatatagagtacagaaaatgtcaaaagcatcaggaagagactattggtttaggcatcatctggaagctatgcttaacgacgacccaaaactaaggaactcaatgtttaaaagaataacaagcctaaaagctctagaaggaatagtaaaagtacgaataaactgtataggtaaaatagtagctgtaggggaatacgactga

SEQ ID NO: 5494 - RNA, 4128 nt, synthetic construct
  misc_feature 1..4128: note = Cas9 variant
  source 1..4128: mol_type = other RNA
atgtcaaacaaatcatacagcataggactcgatataggaacaaattcagtcggatgggcagtaataacagatgattataaagtgccgtcaaagaaaatgaaagtcttaggaaataccgacaaacattttatcaagaaaaatctaataggagcattactatttgacgaaggtaccacagcagaagacagacgcctcaaacgcacggcacgaagacgttacaccagaaggaaaaatagactaagatacctacaagaaatattttcacaagaaatatctaaagtagactcctcctttttccatagactagacgatttcttcttagtaccggaagacaaacgcggatccaaataccctattttcgcaacattagtcgaagaaaaagaatatcacaagaaatttcccactatatatcacttacgcaaacaccttgcagactctaaagagaaaactgatctacgattaatatatctagccctcgcacatatgataaaatatagaggccactttctctacgaagagagcttcgacatcaaaaataatgatatccagaaaatattctcagaatttatcagcatatacgacaacacgtttgaaggtaaaagtttatccggacaaaacgctcaagtcgaagcaatattcactgataaaatttcaaaatcgacaaaaagagaacgagttttaaaattattcccagatgagaaaagtacaggactattcagcgaatttctgaaactaattgtcggtaatcaagctgacttcaagaaacattttgacttagaagaaaaagctccactacaattttcgaaagacacatatgacgaagacctggaaaacttactcggtcaaataggggacgattttgcagacttattcttagttgccaagaaactatatgacgcaatactactatctggcatattaacggtgaaagatctaagcacaaaagctccattaagtgcttcaatgatcgaacgttatgaaaatcaccaaaaagacctagcggccttaaaacaatttatccaaaacaacctccaagaaaaatacgatgaagtattcagcgaccagtcgaaagatggatatgcaggatacatagatggaaaaacaacgcaagaggctttctataaatatatcaaaaaccttttgtctaaatttgaaggagcagactacttcctagataaaatagaacgtgaagactttttgaagaaacaaagaacatttgacaacggatcaatcccgcaccaaatacacctacaggaaatgaacgcaataataagaagacaaggggaacattacccattcttacaggaaaacaaagagaaaatcgagaaaatcctaacctttaggataccctactacgtcggccccctagccagaggaaacggagatttcgcatggctaactcgcaactcggaccaagccataagaccatggaacttcgaagaaatagtagatcaagcaagcagtgcagaagacttcatcaataaaatgacaaattacgacttatatctccccgaagaaaaagtactgccgaaacatagcctactctatgaaacttttgctgtatacaacgaactaacaaaagtcaaatttatagcagaaggactaacaagatatcagtttttagacaagaaacaaaagaaagatatatttgacacattcttcaaagctgaaaacaaacgaaaagtaactgaaaaagacataatccactatctacacaacgttgacggctatgacggaatagaactcaaaggcatcgaaaaacagtttaacgcatcattatcaacttaccacgatctgcttaaaataattaaagataaagcctttatggatgattctaaaaatgaagaaatactggaaaacataatccacacgctaacaatcttcgaagatagagaaatgattaaacaacggttagctcaatacgattcattattcgacgaaaaagtcattaaagctctgactagaagacactataccggatggggaaaactcagcgcaaaattaataaacggcattagggacaagaaatccggcaaaacaatcctagactatttaattgatgatggggaaataaacagaaacttcatgcaactcatacacgacgacggcttatctttcaaagaaataatacaaaaagcacaagtcttcggtaaaactaacgatgtgaaacaagttgtccaagaacttccaggatctccagccatcaagaaagggatactacaatcaattaaaatcgtagatgaattagtgaaagttatgggccatgccccagaaagcatcgttattgaaatggctagagaaaatcaaactacggcccgaggcaagaaaaattcacaacaacggtataaaagaatagaagatagccttaaaaatttagcctctggtctagactctaacattcttaaagaaaaccccacagacaatattcaacttcaaaacgacagattattcttatattatcttcaaaacggcagagacatgtacacaggaaaaccgctagaaatcaatcaattatcaaactacgatatcgaccacataatcccccaagcattcataaaagatgattcactcgacaaccgtgttttaacctcaagcaaagataatagaggaaaatctgacaacgtaccatcactagaagtcgtcgagaaaatgaaagcattctggcaacaactcctagactcaaaattaatttcagaaagaaaattcaacaacctcacaaaagccgaacgagaaagaggcggcctaaatgaacttgataaagtaggcttcatcaaaagacaattagtagaaacacgccagataacaaaacacgtagcgcaattcttagacgcaagattcaataaagaagttacagaaaaagacaagaaaaatagaaacgtaaaaataataacactgaaatcaaatttagtgtcaaattttagaaaagaatttggactctataaagttagggaaataaatgactaccatcatgcacacgatgcctacctaaacgcagtactagcgaaagcaatactaaagaaatatcccaaactggaaccagagttcgtctatggcgattatcagaaatatgatctacaaagatatatttcaaaaagtcgagaaccaaaagaagtggaaaaagcaacccagaaatactttttctattcaaatttacttaatttctttaaagaagaagtgcactacgcagatggaaccatagtaaaaagagaaaacatcgaatactcaaaagatacaggagaaatagcctggaacaaagaaaaagacttcgctacagtaaagaaagtcttaagcctaccacaagtcaacatagtgaagaaaaccgaagttcaaacgggtggattcagcaaagaatcaatcctaccgaaaggaaattcagataaactaatacctcgcaaaacaaaagaaatcctctgggatacaacaaaatatggaggcttcgattcaccagtaatagcatactctatcctattaattgccgatatagaaaaaggcaaagctaagaaattaaaaactgtcaaaactttagttggcattacaataatggaaaaagcaacctttgagaaaaacccaataactttccttgaaaataaaggatatcataatgtaagaaaagaaaatatactgtgcctacctaaatacagtttattcgaactcgaatctggccgccgacgaatgctagcttctgcgaaagaacttcaaaaaggaaacgaaatagtgttgcccgtttacctaactaccctattgtaccatagtaaaaatgttcacaaattagacgaaccagaacacttagaatatatacaaaaacacagatacgaatttaaagatctcctgaacttagtaagcgaattttctcagaaatacgttctggcagacgcaaacctagagaaaatcaaaaacctgtatgcagacaatgaacaagccgacatagaaatattagcaaacagtttcataaatctactgacttttacagccttgggcgccccagcagcctttaagttcttaggaaaagacgtagatagaaaacgctacaccacagtcagcgaaattctcaacgccacactcatacaccaatcaataactggattatatgaaacgagaatagatctttctaaacttggagaagattga

SEQ ID NO: 5495 - RNA, 4128 nt, synthetic construct
  misc_feature 1..4128: note = Cas9 variant
  source 1..4128: mol_type = other RNA
atggaaaagaaatactccataggattagatataggaacaaatagcgtaggatgggcagttattacagatgattacaaagttccgagcaagaaatttaaagttcttggaaacacaaatcgcaaatcaataaagaaaaatcttatgggcgcattattatttgattccggagaaacagcagaagcaacacgactaaaacgaacggctagaagaagatatacaagacgcaaaaaccgaattagatatttgcaagaaattttcgcaaacgaaatggcaaaactagacgactctttctttcaaaggttagaagagtcattcctagtagaagaagacaagaaaaacgaacgccacccaatatttggtaacttagcagacgaagtagcataccaccgtaactatcccacaatatatcatttaaggaagaaattagcagatagccccgaaaaagctgacctaagattaatatacttagccttggcacacatcataaaatttagagggcacttccttattgaaggtaaactaaacgcagaaaattcagacgttgccaaattattctatcaactaatccaaacatataaccaattgttcgaagaatcacctttagatgagatagaagttgatgcgaaaggaatacttagcgctagattatcaaaaagcaaacgattagaaaaacttatagctgtatttccaaatgaaaagaaaaatggtctattcgggaacataatagccctagctttaggtttgactccaaactttaaatcgaactttgatttaacagaagatgccaaacttcaattatccaaagatacatatgacgatgacctagacgaactcctaggtcaaataggtgatcaatacgccgatttatttagtgcggccaaaaatttatccgatgctatactattaagtgacatactacgtagcaactctgaagtaacaaaagccccgttatccgccagtatggtgaaaaggtacgatgaacatcatcaagatctagcacttctaaaaaccttagttagacaacaattcccagaaaaatatgcagaaattttcaaagacgataccaaaaacgggtacgcagggtacgttggaattggaataaaacatagaaaacgaacaacaaaacttgccacccaagaggaattttataaatttattaaaccaatacttgagaaaatggacggcgcagaagaactattagccaaattaaatcgagatgacctgttaaggaaacaaagaacattcgacaatgggagcattccacaccaaatccacctaaaagaactccacgcaatactacgcagacaagaggagttctacccattcttaaaagaaaacagagagaaaatagagaaaatattaacattccgaatcccctactacgtcgggccattagccagaggcaatagtcgattcgcatggctcacaagaaaatcagaggaagcaataacaccttggaactttgaagaggtcgtagacaaaggagcaagcgctcaatcgtttatagaacgtatgactaatttcgacgaacagcttcctaataagaaagtattaccgaaacattcactattatatgaatactttacagtatacaatgagcttactaaagtcaaatacgtaactgaaaggatgagaaaaccagaatttctttcaggcgaacagaagaaagccattgtagacctattattcaaaacaaatcgaaaagtgactgtaaaacaacttaaagaagactattttaagaaaattgaatgctttgactctgtagaaataataggcgtggaggataggttcaatgccagcttaggaacatatcatgatttattaaaaataatcaaagacaaagattttctcgacaatgaagaaaatgaagacatcctggaagatatagtattaaccttaactctgtttgaagaccgggagatgatagaagaaagattaaaaacttacgcccatttattcgacgacaaagtgatgaaacaactaaaacgtagacattacacaggatggggtcgtctatcgcgaaaaatgatcaacggaataagagataaacaatctggaaaaacaatcttagatttccttaaatcagatggattctcaaatcgtaactttatgcaacttatacacgatgacagcctaacattcaaagaagaaattgaaaaagcacaagtaagtggccaaggcgattctttacacgaacaaatcgcggatctcgcaggaagtccggctatcaagaaagggatattacaaacagtaaaaatagtcgacgaactggtaaaagttatgggacacaaaccagagaacatcgtcattgaaatggcaagggaaaaccaaacgaccacaaaaggcttacaacaatcacgagagcgaaagaaacgtatagaagaaggaataaaagaattagaatcccaaattttaaaagaaaacccagtagaaaatacacaactgcaaaatgaaaaactatatctatattatctacaaaacggaagagatatgtatgtagaccaagaactagacataaatagattatccgattacgacgtggatcatatcgtcccacaatcgttcataaaagatgacagcatagacaataaagtattgacaagaagtgtcgaaaatcgaggcaaatcagataatgtcccaagtgaagaagtagtcaagaaaatgaaaaactattggcgacaactcttaaatgccaaattgatcacacaaagaaagtttgataacctcacgaaagcagaaagaggagggctatcagaagcagacaaagctggattcatcaaaagacaattagtggaaacacgacaaattacaaaacacgtggctagaatccttgactcccgcatgaacactaaacgcgacaaaaacgataaaccgattagagaagtcaaagtaataacacttaaatcaaaactcgtatcagactttagaaaagatttccaactatataaagtgcgagatataaataattatcatcacgcccacgacgcatatctaaatgctgtagttggaactgcccttataaagaaatatccaaaattagaatcagaatttgtgtatggagactataaagtatatgacgtacgaaaaatgatagcgaaaagtgaacaggagatagggaaagcaaccgccaaacgctttttctattcaaatataatgaacttctttaaaacagaagttaagttagcgaacggagagattagaaaacgaccacttatagaaacaaacggtgaaacaggagaagtggtatggaataaagaaaaagacttcgcaacagtacgaaaagtactagccatgccacaagtaaacatagtcaagaaaactgaggtacaaacaggcggattttcaaaggaatccatcttaagcaaacgagagagtgcgaaactgatccctagaaagaaagggtgggatacacgtaaatatggtgggtttggtagtccaaccgttgcctacagtatattagtagtagctaaagtggaaaaaggaaaagccaagaaattaaaatccgttaaagttttggtaggtataactatcatggaaaaaggatcatacgagaaagaccctataggctttttagaagcaaaaggatataaagacatcaagaaagaactcatctttaaattaccaaaatattccctgttcgaactagagaacggacgaagaagaatgctagctagcgccacagaactgcaaaaagcaaatgaattagttttaccacaacatttagtaagactactatattatactcaaaatattagcgcaacaacaggatcgaacaacttaggatatatcgaacagcatagagaagaatttaaagaaatttttgagaaaataattgacttcagtgaaaaatatatcctgaaaaacaaagtgaatagtaatctaaaatcgtcttttgacgaacaattcgcagtgtctgatagcatactacttagcaatagttttgtcagtttacttaaatatactagcttcggagcgagcgggggatttacattcctggacttagacgtcaaacaaggaagattaagataccagactgttacagaagtacttgatgcaactttaatctatcaatctataaccggcttatacgaaactaggacagacctgtcccaactaggcggagattga

SEQ ID NO: 5496 - RNA, 4128 nt, synthetic construct
  misc_feature 1..4128: note = Cas9 variant
  source 1..4128: mol_type = other RNA
atgaagaaaattctaggactagacttaggaacgacatcaataggatgggctcttgtcaacgaaagtgaaaacaaagatgaacaatcctcaatagtacgattaggagtaagagtgatccccctaacagttgacgaaaaaggtaacttcgaaaaaggtaaagcaataacaacaaatgctgacaggcaacaagtacatgcagcaagaatcaatctccaaagatacaaattacgtcgtgagaacttacgagactgtctccaaaaacaaggatggataggtagcgagccaatgtgtgaagacggaaaatcatcaacatttgaaacctataaattgagagcaaaagctgccgtcgaagaggtcagtttacatgagttcgcccgagtcctattcatgttgaacaagaaaagaggctataaaagcaacagaaaagccaacgataaagaagaaggaaaattatttgatggaatgacaattgctaagaaactctacgaagaacatctaactcccgcagaatactcactacaacttcttaacactggtaggaaatttacgccggaatattaccgctcggacctaatagaagaatttgagaaaatctggaatgaacaacaaaaatattatcccgaaatactaacagatgaatttaaacaacaattagaaggaaaagctaaatctaacacatcaaaactcttcctaggaaaatatggtatatactcagcagatactaaaggactagatagaaggttacaaccacttaaatggagagtcgaagccatgaaacaacaagttgacaaagacgtcctagcattcgtcatcagcgatcttaaaggacagatagcaaatacatctggactattaggagcaatctctgaccgaagcaaagaactctacttcagtaaacaaacgataggacaatatttatgggcgtcactacaggaaaatccacacataagcataaagaatcaaccattctatcgacaagactaccttgacgaatttgagaaaatatgggaaacacaagctacatatcacaaagaattaacgtcagaactgaaacaagaaataagggatataattatattttatcagaggccattgaaatcaaagaaaaatttgattgcagtatgcgaactagagcaaagaaaagttaaagtaaccgtggacggaaaagaaaaagaaataaccatcggacccaaaattgcccccaaatctagccctatgttccaagagttccgaatttggcaaaatctcaacaacatcttactgttagatcacgaaaccaactcaaaaagacctctatatgaagaagaacggaatttactctatgaagaactaagtgtaaaagaaaaactctctaaaacagaagctctaaaagtattgggaaagaaatccaaacagtgggacttaaactacaaagaattagaaggcaatcgcacccaggcagttctgtatgattgttacaatcgtataatagtaatgagtggacatgaagaatgtaattttaagaaattaaaagcgtccgatatacgtcactacgtgaaaatgatatttaaaaatttagccttcaatacggacatcttatgcttcgacagctctttaaaaggtcatgaactagaaaggcaacccatgtgtcagctatggcacttattatactcctatgaaggagataattctcgaacaggaaatgatgcactgttaagaaaattagaaacttcatttggattcccgaaagagtatgctgcagtattggctgacgtaatttttgaagatagttacggaaatctcagtgtcaaagcaatgcgaaacatactaccccacctacaagcaggcaaagattattcacaagcatgtgaagaagcaggatataaacacagcagacgatcattaacaaaagaagaattaaatcaaaaagtttacaaggaaaaactagaactactgcctaaaaattcattgcataacccagtagttgagaaaatacttaaccaaatggtcaacgtgattaatgctgtaatagaagaatatggcaaaccggatgaaattcggattgaattagcaagagacttaaaaataggagcagccgaaagggaaaatatgacaaggagtataaaccagggaaacgccgaaaacaaacgaataagggaaatattagaaaaggaatttgcactttcatatttatcgcgtaatgatattataaaatacaaactatacgaagaactaaagagtaatggatttaagacactctacagtgatacatatatctcaaaagacaaactcttctcaaaagacttcgacatagaacacataataccaaaagctagactattcgacgatagcttatccaacaaaacaatagaagcaagggatgttaatatagcaaaaagcaacaagacagcttttgatttcatactggaacgctatggggaacagggcgtaaaaacttataaaacgaagttacttagactattggaagacggggcaatcagcaataaaaagtataataatttattgaaaacagaagcagatataccatctggcttcatcgaccgagatttaagaaacacccaatatatcgcaaagaaagcatacgaaatactatcagaattagtaaaaatagtaactcctaccactggatctgttacaaatagactaagggaggattggcagctagttgatgtaatgaaagaactaaacttcgaaaaataccaaaaactaggccttgcggatgtcatagaagacagagatggacgaaaagttaaaagaataaaagactggacaaaacgaaacgaccatagacaccacgcgatggatgccctaacaattgcattcacaaaaccatcatatatacaatacttaaacaatctcaatgcaagaagcgacaaatcatcgtccatatacggaatcgaggtaaaagaattacaccgagaagaaggaaaattcagatttaacgcaccattaccaatcaatgaatttcgagccgaagcaaaacgacacttaaaatctgtattagtctcaataaaagctaagaagaaagttatgactcaaaacgtaaacaaaataaaaacaaaacacggtataattaagaaagtacaactaaccccacgaggggaactccacaacgctacttactacggaacgaagaaacgacccctagtccgaatggtcaaagttggagctgcactagatgaagctacaataaaaagagtctgttctccagcaatacgggcagcactacttaaaaggttaaatgcttacaatggagacgcgaaagaagcattcactggtcgaaacagcatcgacaaaaatccaatttatctagacatagaacagacgaaattagtaccagtgctagtaaaaacaatagaatggggaatgtaccacccaatacgcaaaaggattactccagatctaaaaatagacaaagtaatcgacaaaggaatacgtgagaaactaaaagccagactggcagaatttaacggagatgctcaaaaggctttttccaaccttgacgaaaacccaatatatatggacgaagctaaaagaataactttgaaaagagtcagtatagaaggagtattatcggctatcccactccacaccttgaaagacaaagcagggaaaccagttataggtagcgatggcaaacccgtatttggagattacgtgcaaacaagcaacaaccaccacatagctttctatatagatgacaaaggaaacctgcaagacaaccccgtcagcttcttcgaagccgcagaacgaaaatcacaaggcgtacccgtgatcgatagaagatacaactgcgataagggctggcatttcgtctttacaatgaaacaaaacgaatacttcgtatttcccaacgaagcaaccggcttcattccaagtgaagttgatctactagatgaagctaactattgcatcatatcaccgaatctctatagagttcaaaaactgagcaaggcttccggtcgtgactactggtttagacaccatcttgaaacaatgttaaacgatgatctacgactcaaaaacagtacattcaaacgaatacaaagtctaaagggactagaagacattgttaaagtccgaattaatagcattggtaaaatcgtagctgtggggaaatacgattga

SEQ ID NO: 5497 - RNA, 4128 nt, synthetic construct
  misc_feature 1..4128: note = Cas9 variant
  source 1..4128: mol_type = other RNA
atggaaactaaattcacatattatcttggattagacatgggtacagacagtctaggatgggcagtaacagactcatcatatcatatactaagagcaaaaggaaaagatttatggggggtcagattatttccggcagcagaaacatcagtggataggagaacgtatagagtgaatcgtcgacgaaggcaaagagaagttgctaggataggagcattaaaagaactatttgcagacgaaatagaaaaagtagatccagggttttttgtccgtttagacgaaagtaagtttcacatggaagatagatcagaaaataacaaacaaaaatatggactatttgccgacaagctcttcagcgatgccgaatattataaaaaataccccacaatatttcacttaagaaaagaactattagaatcagaagaaccacatgatgtccgtctcgtatacctagcactattaaatatgttcaagcatagaggacattttttaaatagcagtctacaaatagaaggagaaaatagtaacatagcagaatcatatcaaatgtttgtggatactttaaaggatgaagaattagacttccctgaacaagtatcaggagaaagactacaagaaattttcagaagttctgactccagaaaaaaaaaagtagaaaacctcttggcagaaatgaatttatcaaaaaaacagaaaagagaaattcaattcgtaaatttaatatgtggattaaaaggaaaattatccgaattatttcccgataaagaatatgatgaggaacaaaaaaaaatagctttcagctttcaggactcagactatgaagataaagaaaacacaatccaagaactattagatgaaagtgaaatgaatatgatttacgcggttaaagcagtccatgactcaggggtactgtcaggaatcatgaatggcgaacgatacctgagtgtagctcgagttgctagctacgaaaaacataaaaaagatttacaaatattgaaagatatactaaaaaaatacgatacaaaggaatattttgaaatgttcaggaatgaatcagaaaaaagtgaaaactattcagcatacgtgggctctgtaaagtaccacggtacgtttagaagaggtctctcaggaggaaaacaggaagacctatataaacatatcaagaaggtactaggaaaatttccacaggatgatgaaggagtaacctatgtcctagaggagatagaaacagaaagcttcctacctaaacaactaactgcaagcaacggggtaatacccaaccaagtacatgcgagagaaatgctagcaatactaaaacacgcagagttgtatctacctttcttacaagaaaaagacgatacaggtctaagcgtatcagaaaagatattaaaattatttatgtttcagataccttactacgtaggacccctcggacaagaatataaagacaaaaaaggctacaatgtatgggcggaaagaaaagaaccagggaaaatttacccatggaatttcgaagaaaagattgatgttaaaaaatccgcagaaaaattcattggcaggatggtacgaagatgtacgtacttgtccggcgaacaagcattaccaaaacaaagcttactatacgaaaaattccaagtactcaacgaactgaacaatctgagaatacgaggtgaaaaaatacccgtctctttaaaacaagagatttaccacgatttgttcggagacggaaagaaagtcagcatgacaagattaaccaactatctgttacaaaacggggtaatatcatccgaagaaaaagacagttgtatatcaggaatcgatggtggatttcacaactcactgtcaagcgttggaaaattcaaaggggtctttggcgataccgtacataccgacgaacatcgtaaaatgattgaagacattatattttggggcacagtattcggcgacggaaagaaacttttaaaagaaaaagtggaggaagtatacggtaatcaactaacagaagcacaaaaaaaaagaatattcggattcaaattctccggatggggacgcttaagtaaagcgttcttaacaatggagggtgcctcaaaagataatggtgaaataaaggggttaatccaagctatgtgggatacaaattgtaacttgatggaattacttagcgaaagatttacgtataaagacaaactaaacgaaatggtaacaacagcagaaaaaccgctatgcgaatggaaaattgaagacctagatgagatgtacttaagcgcacctgtaaaaagaatggtatggcaaactattagagtcgttgacgaagtccaacagataatgggatgcccaccaaaaagaatattcgtagaaatgactagatctgacggggagaaagggaaaagaacagtgagcaggcagaaaaaactagtagacctatataaagccctaggaaaggaaggcaaaatctggtccgaagaactaaataacacaccagaagggcaattcagaataaaaaaactctatctatactacctacaaatgggaaaatgtatgtacacaggtgaaagtattgagttagaaccactaatgaatgacaaccatctatatgacatcgatcacatctatccccgacatttcatcaaagatgacaatatatcaaataacctagtcttagtaaaaaaagaaagaaacgcccataaatcagattcatttccaatagaaccagaaataagaaataaaatgatgcctttctggaagtcgctccgaaagaaaggatttttaacagaagagaaatacaataggctaactcgaatgtcagcatttactgacgaagagaaagcggcttttatctctagacaattagtagaaaccagccaaggtacaaaggctattacacaaatatttaaacaagcgtttgccgactctgaaatcgtattcagtaaagccagcgtagtatcagcgtttagacaaaaatttgactgctataaagttagatgtgtaaatgattaccaccacgcccatgatgcgtacctcaacatagttgcaggtaatacgtatcgagtgaagttcactagtaatcctttgaattttattaaagaagcgaaaaagaaccccaatagcagggaaaatcgctataacatggataaaacatttgaatgggatgttacaagaaatggagaaacagcttgggtagcacaaagtaatgagaatccagggaccatacaacttgttaaaaaatatttgaataaaaatagcccgctaatcacaaaaatggtatatgaaaaacacggaggaataacacaaaaagccacaatctggagtgcaaaaaaagccgagagtggcaacacagatgcatatataccagtgaaaatgaatgacccaagattagcagatgtaacaaaatatggaggagttaccacaattgctgttgccggatacaccctattagaatataaagccggcgggaaaaccgtgagatctttagaggctttacctatatatttaggaggatcaaaaaaccttacagaagaacaaatggtagaatactttagtaatatacttcaacaagagaacaaagaaaaagtagtaagcgacgtaataataagaaaaaaaatgataccctcaggaagccttataaaatacaatggattctattattatttggcaggtaaaactggtaataggattgtactaattagtgcagtacagctatgtttaccaatggacaccatgttatatatcaaaaaaattgaaaaagcatgttcgaccggaaatttcgaagaaaaagataaaaacgggaaacaagtattaagtaaacaacaaaacgaattcgtatacgaactaattatagaaaaatatcaacaatctatatttaaaaaaaaggtaggcgcaataggtgatacaatcattgaaaaaagggaaaaattcgcagagataagtctagaagaacaatgtaaagtcctgatgcaaatattcttgaactttcaaagtggaataggtgtagatctcactagcgtagatggatcaaataaatcaggtgtaacctatctaaataaaaaaataatgaacgcacaagaactcaaactgatagatcaaagcgtaacgggcgttttctcaagagaaattgacctgttaacaatatga

SEQ ID NO: 5498 - RNA, 4128 nt, synthetic construct
  misc_feature 1..4128: note = Cas9 variant
  source 1..4128: mol_type = other RNA
atgagtaataaatcatacagtatcggtttagacatagggacaaacagcgttggatgggcagtaataacagacgactacaaggtaccttcaaagaaaatgaaagtcttaggaaacacagataaacactttataaagaaaaacctaataggcgcactactattcgacgaaggaacaacagcagaagatagaagattaaaacgaactgcacgcagacgatacacacgacgcaaaaaccgacttcgatatctgcaagaaatattttcagaagaaatgtctaaagtcgattcatcatttttccatcgtttagacgatagctttcttgtccctgaagataaacgaggctctaaatatccgattttcgcaaccttagccgaagaaaaagaataccacaaaaagtttcctacaatttatcatctacgcaaacacctcgccgactcaaaagagaaaactgatctaagactaatatacttagctctggctcatatgataaaataccgagggcacttcctatacgaagaatcattcgacattaaaaacaacgatatacagaaaatattcagcgagttcatcagtatttatgataacacttttgaagaaagttctttaataggccaaaacgcacaagtagaagcaatattcacagacaaaataagcaagtcagcaaaacgtgaaagagtcttaaagctatttccagatcaaaaatcaactggcctcttctctgagtttttaaaactaatattaggaaatcaagcagacttcaagaaacatttcgacctagaagaaaaagcaccactacaattcagcaaagacacctacgacgaagacttggaaaaccttctaggacaaatccgagacgacttcgcagatttatttttagttgccaagaaactttacgacgctatactgctatccggcattctcacagtcaaagatttatctacaaaagcacccctctccgcctccatgatagaacattacgagaatcatcaaaaagacctcgccgcacttaaacaatttatccaaaacaacctacaagaaaaatatgacgaagtgttttcagaccaatccaaagacggatatgcaggatacataaacggtaaaacaacacaagaagccttctacaaatatattaaaaacttgctttctaaattcgaaggtgcagactacttcctagacaaaatagaaagagaggatttcttaagaaaacaaagaacatttgataacggatctataccacaccagatacacctacaagaaatgaacgcaattctgcatcgccaaggagaacactatccattcttaaaagaaaacaaagaaaagatagagaaaatattaatcttcagaataccttattatgtcggaccccttgccagaggaaacagagacttcgcttggctaacacgcaactcagatgaagcaattagaccatggaattttgaagaaatagtagataaggcatcaagcgcagaagattttataaacaagatgacaaattacgacctttacctaccagaagagaaagttctcccaaaacactcgctcctatacgaaacattcgccgtatacaacgaactaacaaaagtcaaattcatagccgaaggtttgacgcgataccaatttctcgacaagaaacaaaagaaagacatattttacactttcttcaaagcagaagataaacgcaaagttacagaaaaagacattatacactacctacataccgtagatggatacgatggaatagaactagagggaattgaaaaacaatttaacgcctcactttcgacataccacgatttacttaaaataataaaagacaaagaatttatggatgacgataaaaatgaagccatactagaaaacattgtacacacccttaccatattcgaagatcgcgaaatgataaagcaacgacttgcccaatacaactccctatttgacgaaaaagttataaaggctttaacacgaagacattacactggctggggaaaattatccgcaaaattaatcaatgggattcgcgacaagaaaagtggaaaaacaattttagactacttaatagatgacggagaaattaacagaaattttatgcaattaatacatgatgacggactatcattcaaagaaataatacaaaaagcacaagtattcggaaaaactaatgatgtaaaacaagttgtacatgaactcccaggatctccagccataaagaaaggaatactacaatccatcaaaatagtagacgaactcgttaaagttatgggacacgctcctgaatcaatcgtaatcgaaatggcgagagaaaatcaaaccacagcgagaggcaagaaaaattcgcaacaaagatataaaagaatcgaagattctctcaaaaatcttgcgtccggcttagactccaacatactcaaagaaaatccaacagataatgtccaattacaaaacgacaggctatttctatattacctacagaacggacgagatatgtacacaggaaaaccattagaaatcaaccaactctcaaattacgacatagaccatattattccccaagcgttcataaaagatgatagcttagacaacagagtactcacatcttccaaagacaatcggggaaaatccgacaatgttccatcactagaagttgtcgagaaaatgaaagccttttggcaacaactgctagatagtaaactcatctccgaaaggaaattcaacaatctaactaaagccgaaagagagaggggcggactaaacgaacttgacaaagttgggttcataaaaagacaattagtagaaacccgacaaattacaaaacacgtagcacaaatattagatacaagatttaacaaagaagttactgaaaaagacaaaaagaacagaaatgtgaaaataataacactcaaatccaatctggtcagtaatttccgaaaggagttcggactatataaggtcagagaaatcaacgactaccatcatgcacatgacgcttacctcaatgccgttgtagccaaagctattctcaagaaatacccaaaactggaaccagaatttgtttatggagaataccaaaaatacgacttaaaaagatatatcagtagatcaaaagacccaaaggatatagaaaaagcaaccgaaaaatacttcttctactcaaatttattaaatttcttcaaggaggaagtacaatatgccgatggcaccattgcaaaaagggaaaatattgaatacagtaaggacacgggtgaaattgcatggaacaaagagaaagacttcgcaaccgtaaagaaagtattatcactcccacaagtgaacattgtgaagaaaagagaggttcagacaggtggattcagtaaagaatccatacttccaaaaggcaattcagacaaactaataccaagaaagacaaaggacatcttatgggaaactaccaaatatgggggatttgactctcctgtcatagcatacagcatcctcttaattgcagatatagagaaaggaaaatcaaaagaattaaagacagtaaaaacgctggttggcataactatcatggaaaaagcaacattcgaagaaaacccaattacttttctagaaaacaaaggatatcacaatgttaggaaagagaacatactctgccttcctaagtactctctattcgaactcgagaatggaagacgaagactactagctagtgcaaaagaactccaaaagggaaacgaaatagtactaccagtatatctaactacattactataccattccaaaaacttacacaaattagacgaaccaggacaccttgaatacatacagaaacatcggaacgaatttaaggacctgctaaatctcgtgtcagagttctcccaaaaatacatcctcgcagatgcaaacctggaaaagatacaaaatttatatgcagacaacgaacaagccgacatcgaaattctggctaacagtttcataaacttactaacattcacaacgctaggtgccccagcagcattcaaatttttcggaaaagacatagatagaaaacgctacactacagtctcagaaattctaaatgctacactcatacaccaatcaataacaggtctctacgaaacaagaattgatttatctaaactaggagaagactga

SEQ ID NO: 5499 - RNA, 4128 nt, synthetic construct
  misc_feature 1..4128: note = Cas9 variant
  source 1..4128: mol_type = other RNA
atggaaaaatcctatagcatagggctagatataggaacaaattcagtaggatgggcagtaataacagatgattataaagtgccagccaagaaaatgaaagtattaggaaatacagataagaaatatatcaagaaaaatttattaggggctctattattcgactccggtgaaacagcagaagtcacaagattaaaaagaacagcacgaagacgatatacaagaaggaaaaacagacttcgatacctacaagaaatattcgctaaagaaatgactaaagtcgacgaatccttcttccagagactagaagaatcattcctcactgacgatgataagacctttgactcacacccaatcttcggaaataaagcagaagaagacgcatatcatcaaaaatttccaaccatatatcatcttagaaaatacttagctgattcccaagaaaaagctgacttaaggctggtttacttagcattagcacacatgataaaatacagaggtcacttcttgatagaaggagaattaaacgcggaaaatacagatgtgcaaaaactttttaatgtatttgtcgaaacatacgacaaaatcgtcgatgaatctcatttgagcgaaatagaagtagacgcgtcatcaatactcactgaaaaagtctcaaaatccagaagattggaaaacctgataaaacaatatccaacagagaagaaaaatacactattcggaaatttaatagcattagcccttggactgcaacctaattttaaaacaaacttcaaactctcagaagacgcgaaactacagttttcaaaagacacatacgaagaagacttagaagaacttctgggtaaagtaggtgatgactacgccgatttatttatctcagctaaaaatctatatgatgcaatactattaagtggaattttaaccgttgacgataattcaacaaaagcaccactctcagcttcgatgattaaaagatatgttgaacaccacgaagatctagaaaaattaaaagaatttataaaaataaacaaattaaaactgtaccatgacatattcaaagacaaaaccaaaaacggatatgcagggtatatagacaacggcgtcaaacaggacgaattttacaaatacttgaaaacgattcttaccaaaatagacgactcagattattttcttgataaaatagaaagagatgattttctaagaaaacaacgaacattcgacaacggatcaattccacatcaaatacacttacaagaaatgcattcaatactacgacgacaaggagattactatccattccttaaagaaaaccaagccaaaatcgagaaaattttaactttcaggataccatattacgttggcccactcgcaagaaaagattcgagattcgcatgggcaaattatcactcagatgaaccaataaccccgtggaattttgacgaagttgtagataaagaaaaatcagcagaaaaattcataacacgtatgactttaaacgacttatacctaccagaagaaaaagttcttccaaaacactcacatgtttatgaaacttttacagtatacaatgaattaacaaaaataaaatacgtaaatgaacaaggagaatcattcttctttgatgcaaacatgaaacaagaaatattcgaccacgtcttcaaagaaaacagaaaagtgacaaaagcaaaacttctctcctacctgaacaatgaatttgaagaatttagaataaatgatcttataggattagacaaagactcaaaaagttttaatgcatctctaggtacctaccatgatcttaagaaaatattagataaatcatttctagacgataaaacgaacgggcaaataatcgaagacattgttcttacacttactttatttgaagacagagatatgattcacgaaagactgcagaaatattcggacttctttacaagtcaacaactaaagaaactagaacgccgacattatacaggatggggaagattatcgtataaacttataaacggtattagaaataaagaaaacaacaaaacaatactagattttctaattgatgacggacacgcaaacagaaacttcatgcaacttataaatgacgagagcttatcgttcaaaacaataattcaggaggcccaggtagtaggcgatgtcgacgacatcgaagctgtcgtacatgacttgccaggctccccagcgatcaagaaagggatactccagtctgtaaaaattgttgacgaactcgtcaaagtaatgggagacaatccggacaatatagtaatagaaatggcaagagaaaaccaaaccacaggctacggcaggaataaatcaaaccaaagattaaaacgtctacaagactccctaaaagaatttggaagcgatattctcagcaaaaagaaaccatcttacgtcgatagcaaagtagaaaacagccacttacaaaacgacagattattcctatactacattcaaaacggcaaagacatgtatacaggagaagaattagacatagatagactaagcgattacgatatcgatcacataatcccccaagcgttcattaaagataacagcatagataacaaagtactaacctcatccgctaaaaatcgtggaaaatctgatgatgtcccatcaatagaaatagtccgaaatagaagatcatactggtataaactctacaaatccggacttatatcaaagcgaaagttcgacaaccttactaaagctgagcgaggagggttgacggaagcagataaagcagggtttataaaacgacagctagtagagacccggcaaataacaaaacatgttgctcaaatattagatgcacgatttaacacaaagagggacgaaaatgacaaagtaataagagatgtaaaagtaatcactttgaaaagcaatcttgtgagtcaatttcgcaaagaatttaaattctacaaagtgagagagataaacgactatcaccacgcccatgatgcttacctcaacgcagtagtaggaactgcactactcaagaaataccccaaactaacaccggaatttgtatatggagaatataagaaatatgatgttcgaaaacttatagcgaaaagcagcgatgattacagtgaaatgggaaaggccactgcaaaatacttcttttatagtaacttaatgaacttcttcaaaacagaagttaaatatgctgatggtagagtattcgaaaggcctgatatagaaacaaacgcagatggagaagtggtatggaataaacaaaaagacttcgatatcgtccgaaaagtcctctcgtatccccaagtaaacatagtcaagaaagttgaagcccaaacaggtggtttttctaaagaatccatcctttcaaagggagacagtgataaactaatacccagaaaaaccaagaaggtatactggaacacgaagaaatacggaggctttgactctccaaccgtagcatactccgtattagtcgtagcagacattgaaaaaggtaaagccaagaaactaaaaactgtaaaagaattagtggggatatcaattatggagcgatcctttttcgaagaaaacccagtaagtttcctagaaaagaaaggctaccacaatgtacaagaagataaattaataaaactaccaaaatattctttattcgaatttgaaggaggaagaagaagattgctcgctagtgcgacagagcttcaaaagggaaatgaagtaatgctcccagcacatttggtagaactattatatcatgcccatcgaatcgactcatttaattcaacagaacatctcaaatacgtatcagaacacaagaaagaatttgaaaaagtactatcatgtgtagaaaacttctcaaacctgtatgtagatgtggagaaaaatctttctaaagttagagcagcagcagaaagtatgaccaacttttcattggaagagatcagcgcctcattcataaacttactaacactaaccgctcttggggccccagctgatttcaatttccttggagagaaaatacccagaaaaaggtacacctctaccaaagaatgtttatcagcgacattaatacatcaatccgtaacgggtttatatgaaacccgaatcgatttatcaaaacttggcgaggagtga

SEQ ID NO: 5500 - RNA, 4128 nt, synthetic construct
  misc_feature 1..4128: note = Cas9 variant
  source 1..4128: mol_type = other RNA
atgacaaagataaaagacgactatatagttggactagatataggaacagattcatgcggctgggtagcaatgaattcgaacaacgacatattaaaattacagggaaaaaccgcgataggaagtagactattcgaaggaggcaaatcagcagcagagagacgcctgtttcgtacaacccatagacgtatcaagagaaggagatggagattgaaattactagaggagtttttcgatccatatatggcagaagtcgatccatacttttttgctagactgaaagaatcaggattatccccattggataaacgcaaaacagtatcaagcatcgtatttccaacatctgcggaagacaagaaattctatgatgactacccaacaatatatcacctaaggtacaaactcatgacagaagacgaaaagttcgacctacgagaagtatacctagctatacatcatataataaagtatagaggaaatttcctctacaatacatctgtaaaagactttaaagcatcaaaaatagacgttaaatcaagcatcgaaaaacttaatgaattatacgagaatctgggcctagaccttaacgtagaatttaacattagcaacacagcagaaatagaaaaagtgttaaaagataaacagatatttaaaagagacaaagtaaaaaagatagccgaactatttgccataaaaaccgacaataaggaacaaagcaaaagaattaaagatatatcaaaacaagtcgcaaatgcggttttaggatacaaaacaagatttgacacaatagcactcaaagaaatttcgaaagatgagttaagcgattggaacttcaaattatcagatatagatgcagacagcaaatttgaagcactgatgggaaacctggatgaaaacgaacaggcaatattactcacaataaaagaattattcaacgaagtgaccctgaacggaatagtcgaagacggaaacacattatcagaatctatgataaacaaatacaacgatcaccgagatgatctgaaattgctcaaagaagttatagaaaaccatatagaccgcaaaaaggctaaagaattggcactagcatatgacctctatgtaaataataggcacggacaactattacaagcaaagaaaaaactaggtaaaatcaagcccagaagtaaagaagacttttacaaagttgtaaataaaaacctcgatgattcacgagcgtctaaagaaataaaaaaaaaaatagaactagactccttcatgccaaaacaacgaactaacgcaaatggggtaatcccctatcaactacaacaattggaacttgataaaatcatagaaaaccaatcaaaatactacccattcctaaaagaaataaatcccgtatcatctcacttaaaagaagcaccatacaaattagacgaattaataagattcagagtaccatactatgtaggaccactgattagtccaaacgaatcaaccaaagatatccaaaccaagaaaaatcaaaattttgcgtggatgataagaaaagaagaaggaagaatcacaccctggaatttcgaccaaaaagtcgataggattgagagcgccaacaaatttattaaaagaatgacaaccaaggacacgtacttattcggagaagacgtcttacctgcaaatagcttgctttaccagaaattcacagtcttaaacgagttaaataacatacgaataaacggaaaaagaatctctgtcgacctcaaacaagaaatatatgaaaacctcttcaaaaaacacaccactgtaacagtaaaaaaactcgaaaactacttaaaagaaaaccacaacttagtcaaagtagaaattaaaggattagcagacgaaaagaaattcaactcaggtttaacaacatacaacagatttaaaaacctcaatatattcgacaatcaaatcgatgatttaaaatacaggaatgactttgaaaaaatcatcgaatggtccacaatatttgaagataaatctatctacaaagaaaaactgaggagcattgattggctaaatgaaaaacaaattaatgcattaagtaatatcagactccaaggatggggaagattaagcaaaaaactcttagcccaacttcacgaccacaacggtcaaacaataatagaacaattatgggactcccaaaataacttcatgcaaatcgttacacaagctgactttaaagacgcgatagcaaaagccaatcaaaacctactagtagctacatcagtagaagacatcttaaataatgcctatacatcccctgctaataaaaaagctattcgacaagtaattaaggtcgttgatgatatcgtcaaagcggcatcaggcaaagtacccaaacaaatagccatagaatttacaagagatgccgatgaaaacccaaagcgatcccaaacacgcggatcaaaactacaaaaagtttacaaagacctatccacagaactagcaagtaaaacaattgcagaagaactaaatgaagcaatcaaagacaaaaaattagttcaagataaatactacctttatttcatgcaattaggaagagacgcatatactggagaaccaatcaatatagacgaaatacaaaaatatgacatagaccatatcctcccacaaagtttcatcaaagatgatgctctagataaccgcgtactagtatctagagcagtaaacaacggaaaatcagacaatgttcccgttaaattatttggcaacgaaatggccgccaatctaggcatgacaataagaaaaatgtgggaagaatggaaaaatatcggactaataagcaaaactaaatacaataacttactaaccgatcccgatcacataaataaatacaaatcagctggattcataaggcgccaattagtggaaacctcacaaattataaaactagtatccacaatacttcaaagccgctaccccaacacagaaataataactgtaaaagcaaaatacaatcattacttaagagaaaaatttgacctatataaatcacgagaagtaaacgactaccaccacgccatagatgcttacctatctgctatctgcggaaacctactataccaaaactaccctaacctacgaccattctttgtttacgggcaatataaaaaattctcctcagacccggacaaagaaaaagccatattcaataaaacaaggaagtttagctttattagtcaactactaaaaaataaaagcgaaaatagtaaagaaatagccaaaaaactcaaacgtgcatatcaatttaaatatatgctagtttctagggaaacagaaacacgcgatcaagaaatgttcaaaatgactgtatatcctagattctcacacgacacagtaaaagctcctaggaacttaatcccaaaaaaaatgggtatgtctcctgatatatacggaggatacacaaacaacagcgacgcatatatggtgatagttagaatagataaaaaaaaaggaacagaatataaaatattaggtattcctacacgagaacttgtaaacttaaaaaaagcagaaaaagaagatcactacaaatcatacttgaaagaaattttaacacctagaatcttatacaataaaaacggtaaaagagacaaaaaaatcacatcattcgaaattgtaaaatcaaaaataccgtataagcaagtaattcaggacggagataagaaattcatgctcggatccagtacatatgtctataatgctaaacaactcacgctctcaacagaaagtatgaaagcaataacaaataattttgacaaagacagcgatgaaaatgatgctctcataaaagcctacgacgagatactcgacaaggtcgataaatatctgccactatttgatatcaataagttccgagaaaaactacacagtggacgggaaaaattcataaaactatcattagaagacaaaaaagataccattcttaaagtattagaaggactgcacgacaacgcagttatgacgaaaattccaactataggactctccacgccattaggattcatgcaattccctaatggtgtaatactaagtgaaaacgcaaaacttatctatcagtcacccaccggcctatttaaaaagagcgtaaaaatttcggatctctga

SEQ ID NO: 5501 - RNA, 4131 nt, synthetic construct
  misc_feature 1..4131: note = Cas9 variant
  source 1..4131: mol_type = other RNA
atgtctaattttgacaaccacaaagactcaatctgcaaacacaaaggactaaagaaagggaactattatattggattagatatcggaacaaactcagttggatgggcagcaacaaatgaacaatatgaattactcaaattcaagtcacacaaaatgtggggatcaagactttttgctgaagcgcaaacagcagttgacacgcgaatgaaaagatcggcaagaagaagattacaaagacgcaaatttcgattaatattacttgaatccctattttcaaaagaaataaatgccgtagatgaaacattcttcatgagattacacgaatcgaactatcacgttgaagacaaaacaaatcttgttaaatacacccttttcatagacaaaaattacacagatgtagactactataaagagttcccgacgatttaccatctacgccaccacctaatgacagaaggaacaaaagatatccgacttcttttcttagcaatacaccacattctgaaatatagaggaaactttctatacggaaagaaagaattttcagtagacggagaaatgtattcagtactcaggtctacactagaagaactcggatttggaagttacgtagaagatgaaaacgtacttcaatcaatagcaaatctagtactagatcgaggaattgcccgttctgaaaaagtcaaacaaattgagccactaattgcgcaaggcaagaaactaagctctgtagagaaaaatcgattaaaagcatgggcttacctcataatgggcttaaaagcgaacttggttaacttatttacagacgaagacgttgaagtagtattaccagaagagaaagaatttaaatcaatcaatttacatgagggaatatacgaagatgtacgagacgcttacgaagatgcttggggcgaccgatttgccattgtcgaccaatgtaaagtcctacacgacatcattgttatatcgagcattattaaaccagggcaatccctaagcgaagcaaaaatcgaatcatacaaccaacataaagaagacttagtactacttaaaagcgtactaaaagaagataagaaactatatgacgatatgtttgttgtagatatagataaaggaactaactacgtgaaatacatcaaacaaggagtcaacggtaacacatctaccactcaagaagcgttttataaatatgtaagaaaagtagtctcagttctcccagaaaccgaaaatactcgctgtatagtccaaaaattagaggaaggaacattccttccactccaacgaattagtaaaaacggagtcgtaccttaccaattacataaagaagaactcgtcagaattttagaaaaagcaaaattaaacttcccctttctgaatgaggtagaagatggtctcacagtagcggacaaaatcattagcatactcgagttcaaaataccctattacgtaggacctctaaacccaacacactccatagagaatggaggtttcgcctgggtagtacgaaaagaagcaggtcaagtacttccatggaattttgaacaaaaagttgatgtacaagcatcagccgtcaaatttatagaaaacctgacaaacaaatgtacatatctaatcgaccaagatgtcctaccaaaatatagcctcctatatgcggaattttctctactaaacgagttaaacaatataagggtaaacgataaacctttaccagcagacgtcaaacaggctttcataagagatcacttcataagtctacaagactccaaaaccgcaaccaagaaagtagtagctaaatatctagtagacaacaactacgtatcacaaccgccaataataacaggcatggatcaacaaatagcaacaaaactaacaagccaccgcgatatgacacggatactcggagaacattttgactacgctatggccgaagatataatcagatacattacaatcttcggagaatccaaagatatgttaagacaagtccttaaaaattattatggagatcgtctaacaacggaacaaattaagaaactagggaaattgacatatacaggctggggtcgacttagcaagaaattcctttctgacatatggggcatgaagaaaaatgacgatgacgctgaagcaggtacaatcatagagcacatgagagaaggccaagagaacctgatgcaactgctctcatctagttattcattcatagatgtagtccaggaatacgtaaccaacgttctaggggcgaaagagaaaaccgcatttgaaatgttagaagacctatcactcagcccaatggttaaaagatctgtttggcagacattaagaatactcgatgaaattgtatcaatcagaaaagaactacccaagaaaatctttgtagaagtagcaagaacgaacaaagccgataagaaacgaacccagtctcgaaaagcgttactcgaagaactttacgaacaaatcaaagacgaagacgttcatgtattacaacaagaactcgaatcaaaagaagactcagctctaaacagcaagaaactgtacctatattttacacaaatgggaagatgtatgtactctggacgccgtatagatatacacgaactattcacagacacttacgacatagatcatatatacccaagatcgctaacaaaagacgattcatggcataacattgtacttgttgaaaaacaattgaacgccgagaaaacagatcgatttccaatattaagcgcaatacaatcaaaacaaaaaggattctggaaactattatgggatagaggattcatatcagaaaagaaatatgacagacttgtaagaaccactgacttaaccgacgaagagttaaatcaattcataaatcgacaaatagtcagcacaaatcagagtgtcaaagccgtgaccacgctcttacaccagctttaccctgaaacagaggttgtattttcgaaagcagaaaacatatccgattttagaagagactatggattcgtaaaagtacgtagcataaaccaccatcatcatgcgaaagacgcctacttaaatatagttgtaggaaatgtgtatcatgaaaaatttacgaaaaactttttgtcttttgcaaaacaaaaaggcactcatagaacgtacaatttaacaaaaatgtttgaatatgagataaaactaacagaggaatcgaagaaagtaatatgggatccaaatatacatatggacatagtaaagaaaatgatgaaaagtaacgatgttagggtaacacaaagagcagttccgcaaaaaggcgggctaagcgacgaaacaatatacaagaaaggcatagcaaaaagaggagtatatctaccactaaaaagctcagacgaaagagtcagagatgtagaaaagtatggaggtagaacatcaataacaataagcgaatacattatactaaacatccgcgatacatccgaccaagatagaatagaaatatttagcctacctttatacatagcaggcaagaaagacatccacaaagccattgaagaagcctatctaagtacatgcaagaaaccagcatcagtcgtagacatccaaatactatatagaggattgtatataggatccaaagtcaacataaacggattcacatactatatgggtggaaaaacaggatcaaacgtcagcgtggactcagccgttgacgtagtaatggatatcacatcatcagtttacataaaactccttgaaaaagttgcaatcaagaaaatcgaaaattcaaaaacatttaggatcgaaaatataaaaacctcatacaaccacaaagaagtcactgtctctaaggaacaaaatatcgctctataccaagaactcctcaagaaattagacactcctttattctcaaaaatgaaaggtaacaaactagaagagttcagaaccgtaggctttgacacatttatagcactatcattagaagaccaagcatcagtcctactagaagtcctaaacgtactaacaaattttaaaacaaaacgagacattactaaaataggtatgacctcatcacgaagtacgttggggattaatatatctaacacggaacaattctcagtaatcaccacttcaataactggactatatgaacaagaaataaaaataaaatga

SEQ ID NO: 5502 - RNA, 4131 nt, synthetic construct
  misc_feature 1..4131: note = Cas9 variant
  source 1..4131: mol_type = other RNA
atgaccacaaaaaacagagaaaaaaataacaaatttcataaagcatcccccttatatacattaggcctagatataggtacaacctcagtcggattcacagcaatagatgaagcccaaagaccaatgagagctaaaggcaaaaccgttattggagtacgactcttccaagaaggacaatcagcggtaggaagaaaaaactttagaactacacgccgacgactaaaaagacgaagaagacgactgaatttactcaaacaatttttctcagccccattaaggaagatagatcctacatttttcaaacgactcaaagcatcatcactatctcctgccgataaaagaagataccttgcaccaggactattccctaatggtggcgatattaaattctaccaaaaataccccaccatatatcacttaaggctagctctgatgacagaaaaaagaccctttgatttacgcgaagtctatctagctatccaccacatagttaaatataggggaaactttctaaacccactacccgtttctgcatttagaggacgaaaccaaagatttgaggaccaattcagcgaacttaatcaactatataaatcactcgaaggggaatcaccctttcaatttgatgaaaaaatattctcagaactagacaaacaactattagtaaacgatggtagaaaaattgataggcaaaaacaactcgctaaacgcgtatttataaaaacgaatgaaaagcgcatagattcccaccatcaaaaaatagcttccgctttttctaaagcagtctttggatataagttcagaccagatgtactgttaaactcagatcccaacgaaagcatagatgaatttatcaagtttggagatgaagatttcgacgacaaactagtaatattacgcgaatcactaaacgcaactcaaaaagaaattttagcagtcacacaaagaatctattcccaaattattcttaacgaaatagttccatctcgcgagacgttaagcgaggcaatggtatctagataccaaaaacaccattcagatttacaacttttaaccgaagcatgtaaaaagatgactaaagcaaaagcggccagaattcaagcagcatacactgactatatcgggaaaggggacggccacaaactggttcacgatcaatttgtagcactcataaaaaaaaacttagatcctagtgaagaaggaagggatttagcagaaaggttagcgcaagatgacttcatgcccttacaacgcacgcccctgaacagagttataccccatcaactccaacaagaagaactcgaccgaatcatagaaaatcaaggtgaatattacccattccttaaaacacttaatccaaaccgatctcgagctggagtcgcgaactatcaactcgacgaactcgtatcattccgaatcccatactatgttggtccactaatcacggcaactgaccaactacacacatccggagcaaaattcgcttggatgacaagacgcgccgcaggtgaaatcaccccctggaacttcgatcaaaaagtggatcggctagcatcagctaatcaatttataagacaaaatatgccaaaagacaaccatctgctagaagcagatgtattaccggcaaactccctaacatatcaaagatatctcgtcctagacgagttaaatgcagttaaagtaaaccacaagtcgctcaccgtctcgcaaaagcagcgaatctttaacgacctatttaaacgccaaagaaccgtaacagtactcaacctacaaaactacttaaaatcaatagaaaaactaccaaccctcccagtcatcactggagtctccgactcagaaagatttaaaactacactatcaacatatctcgacttcaaaaatatcttcggtggaaaagttgatgactctagtcaaaaggaaaaattcgaaaaaattatcttatacgctacaatatttgaagatcatgcagtatataaagcaaagctagatcaaatagactggcttggacaacaacaaaaaactgatttactatcaaaaaactaccaaggttggggacaactatccgaaaaactactcctgggtttaaaaaaccaggcagggcaaagcatattagatgaactgtggcaaactaataaaagattcagagaaataatgaacgaagcacactttgctaaacaaattatggcatccaacgcagccctattacgtaaaaaaggtttagatgatgtcttatcaactgcatttctatcaccacagaataaaaaagcaataagacaaactgtggaagttgtcgacgacatagtaaaagctattggttgtccaccacagaaaatatctctccacttcagtaaagccccagccgacgcaatacgccatgagagagataacgcaaacataatcctacgaacttaccgaaacttacctgccaaaatggtagatgaccaacttaaggcagaactacaagcaacagcagaaaaacatcaagtattgtcagataaattgtatttatattttacacagctgggacgagatctatatacaggagaaatgcttaaaatgagcgaactagaaaacgacatgattgatcacatcatgccccaaacattcgcatacgatgactctgtcaacaatcgcgtacttgtatcgcaaaatcattcttcacaactaggaaaaacatccggtgaaaaatctgacgctaaaatgatccgattctggcaagtattacgcgacaataaactgatcagtgaacagaaatatcaaaaccttactctcgacagcgatcacctctcaaaaagcaccagggaacaactcttaaaccgatacttagtagagaaaaacccaataacacaatgggtcgcatcagttcttacagaaaagtatggagataatggcaccagggtattaaccataaatccgcgaatggtataccaaatgagaagacaattcaatctagttaatcttcctgaggttaacgactatgaccatggactcgatgcatacttagcagcattcatcggaaattatgtagatcgaagataccctagactcagatcctattttgtatacggagacttctcatcatcaaaagaaatagtctttcgactcaacaggttcaatttcttattcgacctcgggcaagcagaacccaatgagctaacggactgggaaacaggggaaatgatatgggacaaagctgcagcaaattcagtcttacgagatgtataccaatacaaatttatgctgatatcacaagcagtttactcccgacaaggagcaatgttcaatcaaactatatatcctgcttcacaagctgccgggcgtcaactaattcccgtaaaaaaaaacagagccactaaattgtacggcggttacagcggaaacgtagatgcctatttagcaattgttcgattaggtggaccaaaatcagaccagtatcgcgtagtaggaatcccaacaagaatggtaggaaggttacaatctgccatgaagcaaggtgctgacacatatgcaaatacattacacaaaatattgcaaccccaatttaccaaaaggaaaaaaaatcgccaaactggttactatgaagagacaactgagccattcgcagtaatcttggataaagtatactacagacaattaataatagacggacagcaaaaatttatgttaggcagttctacttatcaattcaacgcaaagcagctagtattatcttcacgcgcaagacaaatactctcaggcgaagaacggttaacagacgaaaacgggagccaagacctgatcgacgtatacgatgagatcctaacgaaaatagacagatacttcgaattatacgaccaaagacactttagacaatcactccatgatggaagaaaacagttcatatccctccctatccataacgtttacagagccaatcgacttatcgagcacggaaaatacgagacattaagccaaatcctaaacggacttcatgcaaacaccatgatgacaaatttaagatatcttggaatatcgtcaccttttggtaaatttcaatctcccaacggcataaaactctcaaaagatgccgtgttagtataccaatcaccatcagggctcttcgaaagaagagtgagactaagagacttatga

SEQ ID NO: 5503 - RNA, 4131 nt, synthetic construct
  misc_feature 1..4131: note = Cas9 variant
  source 1..4131: mol_type = other RNA
atgaacaataaaccatactcaataggacttgacataggaacaaattcagtcggatgggcagtgataacggatgactacaaagtaccaagcaagaaaatgaaagtacttggaaataccgacaaacacttcatcaagaaaaacttattaggtgcacttttatttgatgaaggaacaacagccgaagacagacgactaaaacgaactgcacgaagacgctacacaagacgcaaaaatagactccgatatctacaagaaattttcactgaagaaatgagcaaagtagatatatcatttttccaccgtctagacgattcattcctggtgccagaagataaaagaggatcgaaatatccaattttcgcaacccttgaagaagaaaaggaataccacaaaaatttcccgacgatataccatctgcgcaagcaccttgcagactcgaaagaaaaagcagacttcagattgatataccttgcattagcccatattataaaatataggggacatttcctttacgaagaatccttcgacatcaaaaataacgatattcagaaaatatttaacgaatttatatcaatatacgataatacctttgaaggatcctcactaaacggccaaaatgcgcaagttgaagccatattcacggataaaatatctaaatcagcaaaaagagaacgcgttcttaaactatttccagacgaaaaatccacaggcctcttttctgagttcttaaaactaatagtcggcaatcaagcagattttaagaaacatttcgatcttgaagaaaaagcaccccttcaattctcaaaagatacatatgacgaagacctagaaaacctcttagtacaaattggtgacgactttgcggacctatttctagtagctaagaaactttacgatgccatactacttagtggcattttaacagtaactgatcccagtacgaaagccccactttccgccagtatgatagacagatatgaaaatcaccaaaaagatttagcagctctaaaacaattcataaaaaccaaccttcccgaaaaatacgatgaagtattctcagaccaatcaaaagacggctatgcaggatacattgatggaaaaacaacacaagaagcattctataaatacattaaaaacttattatcaaaactcgaaggtgcagactattttcttgacaaaatagaacgagaagacttcctcagaaaacaacgcacatttgacaacggttcaataccccatcaaatacatttacaggaaatgaatgctataataagacgacaaggagaacactatccctttctccaagaaaacaaagagaaaatagagaaaattttaacattcagaataccctactatgtaggacccctagctcgaggaaatagagacttcgcttggcttacaagaaatagtgatcaagccattagaccatggaacttcgaagaaatagtggataaagcaagatcagcagaggattttattaataaaatgacaaattatgatttatacctaccagaagaaaaagtactaccaaaacactcactactttatgaaactttcgcagtctacaatgaactcacgaaagtaaaatttatcgccgaaggacttagagactatcaattccttgacagtggacaaaaacaacaaatagttacccaattatttaaagagaaacgtaaagtcacagagaaagacatcatacaatacctgcataacgttgactcctatgacggaatagaattaaaaggaatcgaaaaacaatttaacgcatcgctatcaacataccatgatctactcaaaataataaaagacaaagagttcatggatgattccaaaaacgaagccatccttgaaaatatcgtacacactctaacaattttcgaagaccgcgaaatgatcaaacaaagattagcacattacgcaagcatattcgacgaaaaagttataaaagctctcactagacgacattatacaggatggggtaaattaagtgccaaactgattaacggaatatacgataaacaaagcaagaaaaccatactagattatctaattgacgatggcgaaataaaccgaaatttcatgcaactaatcaacgatgatggactatcatttaaagaaataatacagaaagcacaagtagtaggaaaaactaatgacgtcaaacaagtagtccaagagcttcctggaagccctgcaataaagaaaggaatcctccaaagtatcaaactcgtcgacgaattagtgaaagtaatggggcatgcaccagaaagtatagtaatagaaatggcacgcgaaaatcaaaccactgcgagaggcaagaaaaatagccaacaacgttataaaagaatagaagacgcccttaaaaatcttgcacatggcctagactcgaacatcctaaaagaacaccctaccgataacattcaactccaaaacgaccgactttttctatactacctacagaatggaaaagacatgtatactggaaaaagcctcgacataaaccaattgtcttcatgcgatatagatcatatcattccgcaagcattcataaaagatgacagccttgacaaccgagtattaacctcatcaaaagacaatagaggaaaaagtgacaatgtaccatcactagaaattgttcaaaaacgaaaagcgttttggcaacagttactagactcaaaattaatatcagaaagaaaattcaacaatttaacaaaagctgaaagaggtggactcgatgaaagagataaagtaggatttataaaaagacagctagtcgaaacccgacaaataacgaaacacgtagcccaaatactagacgcacgtttcaacaccgaagtaacagaaaaagacaagaaagatagatcagtgaaaataattacgctaaaaagcaatctagttagcaactttaggaaagagttccgcttatataaagtacgagaaataaatgactatcaccacgcccatgatccttacttaaacgccgtcgtagccaaagcaatactaaagaaatacccaaaactcgaacccgagttcgtatatggtgattaccagaaatatgacttaaaacgttatatatcaagaacaaaagaccccaaagaggtcgaaaaagcaacagaaaaatatttcttctactcaaacttactaaatttcttcaaagaagaagttcactacgccgacggaaccatcgtaaaaagagaaaacattgaatacagcaaagacacaggagaaattgcatggaataaagaaaaagacttcgcaaccatcaagaaagtcctctcattacctcaagtaaatatagttaagaaaacagaagaacaaacagttggacaaaacgggggcttatttgacaataatatagtaagcaaaaagaaagtcgttgacgctagcaaactaaccccaataaaaagtggactttccccagaaaagtacggaggatatgctagacctacaatcgcatactccgtactcgtgatagccgacatcgaaaaagggaaggccaagaaactgaaaagaatcaaggaaatggtaggaataacagtacaagataagaagaaatttgaagcaaacccaattgcatatttagaagaatgtggctataaaaacataaacccgaacctaatcattaaactaccaaagtacagcctttttgaatttaataatggacaaagacggcttctcgcgtcatccattgaactgcaaaaaggaaatgaattaatcgtaccctatcacttcacagccttattatatcacgcgcaaaggataaataaaatcagcgaaccgattcataagcaatacgtggaaactcatcaaagtgagttcaaagaattactaaccgcaatcatttccctaagcaagaaatacattcaaaaaccaaacgtagaatcactcttacaacaagccttcgatcaaagtgataaagatatataccaactatctgaatcttttatcagcttattaaaactcatcagcttcggtgcacccggcacattcaaattcctcggagtagaaataagccaaagtaatgttcgttatcaatcagtatctagctgttttaacgcaacacttatacatcaaagtattacaggactatatgaaactagaatagacttatccaaactaggagaagattga

SEQ ID NO: 5504 - RNA, 4131 nt, synthetic construct
  misc_feature 1..4131: note = Cas9 variant
  source 1..4131: mol_type = other RNA
atggacaagaaatacggaataggattagacatcggaacctcgtccataggatggactgttgtagacaaatatggacatatcataagagttaaaggccaaactggaatcggagtacgattattcagagaaggtcaaactgcagcagaaagaagaacatttagaacaaccagaagacgtttatctagacgtagatggcggctgagactactacgagaaatattcgatgaaccaatatcagctatagacgaaaatttctttgctcgtcaaaaggcttcatcactcgcaccaggtgatgcacgatatcaacaagcattccaactctttaatgatagaactgatcaagccttttactgtaaatatcccaccatataccatctcagacaagcacttatgactgaaagtagacaatttgacatcagggaaatttacttagcactacaccaaataataaagtatcgcgggcactttttgctaggaggagcggcaaaagattttcaatcagacaagctcgatttagaagcgtacttcacaacaatcaacgctcaactagcagggatctactcagacggtagcgtgcaattacccacactagactggaaccaggcctgtcaagagcttacagatacatcaagaacacagtcagaccgtaaaaattggcttgtcaaagaattaaagagctacggagattcacaattaaaaccgatatacactcaaatcgccaacgcgatactaggattcaaaacagacttagccaaaataatgggcatcaacgacccagaaaaagcacttagttttaacctcgatgcactagatgatcatagggatgacgtcgcggaattattaacggatgagcaaatacctctagtgaacttattagctaaactacatactgcattggaacttgcagcaatcctaccagacggtcaaacactaagcggaaaaatggtagagatatatgaaacccacagaaaacaattaaaaacatacaaagccttcataagacaattaccggaccgccaacagcgactagctctaaaacaggcatatgaccattatatcgatcaaggtctaaatagagaggcattctattctgaagtcaaagctatactcgaaaaacaaaaacccttaaccgcgacaggtcaagcaatgaagaaagctatggatcaaaatgctttcttactaaaacaacgaacaaaaaccaatatagcaatcccttatcaagtgcaacagcaagaaatggaccaaataatcgctaaccaatcgaaatactatccatggctagcaacacctaatcctgtaaaatcaagaagagtaatagcaccatacaaactcgatgaattagtatgcttccgtgtcaattactacgtaggaccattagtacaatccaagccaggagaagctacaaaagaagcaaaatttgcctggatgacccgtaaagatccacaatcaactgtagcgatcactccttggaactttgatcaacaagtggacagacaagctagcgcaaatgcgttcattcaacgaatgaaaactacagatacatacctacttggagaggatgttatccccaaaaactctttattataccaaaagtatgaggttttaaatgaacttaataatgttagagttaatggagactggttagacccccaaagaaagcaatatctattcaagaaattatttatggatcaaccacaaagtgtagttacagttaaagcattacaaaagactctagtagttattggagcatgtcccacactaccaacagtagaaggattagccaacccaaagagattcctatcccaattgacaacataccacgatttttgtaaactactaccggacgatatccaaagagcagatagacaagcagatatcgaaaagataataaattggagtacaatcttcgaagatactgctatctttaaagaaaaattacgagacataaaatggttatccgcagatcaaataagacgattaagttcgcgtccaagatatagaggttggggacgcttcagtgcaaaactcttgtgtggacttcacgaccgacaaggtaataccgtaatggacgaattatggcagacctcacgaaactttatgcaaatcatcagacaatccgactttcagacagctatagcagcagtaaatcaacaagacttgggacgacaagatctccagagagtaattgacgacttatatacctcaccacaaaataagaaagctataagacaagtcctagccgttgtaacagatatccaaaaagcaatgcatggaaaggcaccatcttggctatttgtggaagtagccaaaggcgcacagaaaaaccctcaaagaacgcaaagccgacaatctaaactagcagaagcataccgagaatccgctcgagagctagtagatgaagcagtaaaggaacaattactaaccctaccagatgaccgccaaacatttagcgacaggctagttctatatttccaacaaaacggaagagacatctacaccggagaaccactcgatttcgaacgactctcaaattatcacatagaccacattatcccacaagcagtagtaaaggatgatagtttagacaaccgagtacttacaagtaaccaagcaaaccttgaaaaaggagctcatgttcccacaatatttagagacaaacaagagccagtgtggcaagagctttatcgcgtcggactcattagccatagaaaacttcgaaacctactaaccacaccagatgacttagacgatagagggagagcaacgggattcatcgccaggcagctagtcgaaacacgacaagtcatcaagttagttatggaagtactctctcaatactatgacacaacggaaactgaattaatatcaataaaagcaggactttcccatcaatttcgacaagaattaaacctacccaaactgagagcactaaatgattaccaccatgcccaagacgcctacctagctgcacgcataggtacttacttacttcaacgatatccaaatttaaagcgtttctttgtatacggagatttcaagaaaacccactttgatctacaacgaagatttaacttcataggaggtatgatctctcgcgaaaaacaaccgtacaaccttatcaaaaaccctgtaacccaccaagtaatatgggacgaagaaatggagatcggcgattgccaaaagaaaaatcccgaacaaccaaaacacgatgctacagtaaaaatgatgaatctaaccaaaataatgaatttaaaacacatcctcgtaacccacgaggtctacgaaaatcatggggctctttttaatcaaaccatataccctgcaagccaagcacacaaaaagaaattaataccacagaaaaccgaaaaacctatagaactgtacggaggacattcaagcgaacaagcaggatatatggcgatcataaggcttcttggcaagagacctggatacaaagttatgagagttccagttcgatatgtttcacaactacaacaccaagatgtcgcagaacaaaagaaattactatacaagatatttgtctcagaactaacatcaagaaataaagtaaagccttttgaagtagttgtacctcacgtctgtttaaaccaacccgtagaagacatgataaaaggacaatggcaccgattcgcactaaggacaaatggatattatcaaaaccaacaacaactcatactaagtctcgtggctcaacgaacactggcaggttacaaacccaaagacgacgaactaatggcagtatatcatgaaatttgcaaacaagtaaaatattattttcccctatacaaaatgaataaattccaatcgagattattcgcagcagaagaactattgcagaaaagatcaaccgtcaattcatttagtataacgataggaaagaacggaaaagaaaacaaaacattgaatttaggtaaacgtgaactgctattaagattacttgggggcttacacgcgaacgcaactcgagtagatttgaaagatataggatgtacaggccaatttggccaactacaagtaaagaatggcatcaaactaacagaacaagcagtcttaatacatgagtcgccaacaggtttattccaccggcgagtaagattaaatgatctttga

SEQ ID NO: 5505 - RNA, 4134 nt, synthetic construct
  misc_feature 1..4134: note = Cas9 variant
  source 1..4134: mol_type = other RNA
atgacaaagaaaaactattccataggactcgacataggaacgaatagcgtaggatgggcagtaattacagatgactataaagtcccagccaagaaaatgaaagtgttaggcaacaccgataagaaatacattaagaaaaacctattaggagcactactttttgactcaggcgaaacagcagaagccacacgattaaaacgaacagctagaagaagatacacaagacgtaaaaatagactaagatatctacaagaaatattcgcagaagaaatgactaaagttgacgagagtttcttttacagattagatgaatccttcctaacaacagatgaaaaagactttgaaagacatccaatattcggaaataaagcggatgagattaaatatcatcaagagttccctactatataccatctgcgtaaacatttagctgactcatccgaaaaagcagacctaagattagtatacctagcactagcgcacatgataaaattccgagggcactttctaatagaaggcgaactgaatgccgaaaacacagatgtacagaaaatattcgcagatttcgtcggagtatacgatcgaacttttgatgattcacacctaagcgaaatcacagtggatgcagcatcaatcttaacagagaaaataagtaaaagtcgacgactagaaaatctaatcaaatattaccctacagaaaagaaaaacacactcttcggtaatttaatagcactagcattaggactacaaccaaattttaaaatgaactttaaattatccgaagacgccaaattacaattttcaaaagattcatacaacgaagacctggaagaactcttagggaaaataggagacgactatgcagatctcttcaccagtgcgaaaaatctttacgatgccatattgctcagcggaatcttaacagtggatgacaactcaacaaaagcaccactcagcgcctcaatgataaaacgatacgccgaacatcacgaagatctcgaaaaattgaaagagttcataaaagcaaataaatctgaactctaccacgatatatttaaagatgaaaccaaaaatggatatgcaggatacattgaaaacggagtaaaacaagatgaattttataaatatctcaaaaataccctaagtaaaatcgctgggtccgactactttctagacaaaattgagagggaagacttcctccgcaaacaaagaacatttgataatggatccatcccacaccaaatacacctccaagaaatgcacgcaatactgcgacgccaaggagattattatccattcctgaaagaaaatcaagaccgaatagagaaaatcctcacgtttagaatcccatactacgtagggccattagcacgaaaagacagtaggttctcctgggcagaataccactcagacgagaaaataactccgtggaactttgataaagtaatcgacaaagaaaaatctgcagaaaaattcatcacaagaatgacacttaacgatctatacctaccagaagaaaaagttctaccaaaacacagtcacgtctatgaaacgtacgcagtctacaacgaattaacgaaaataaaatacgtaaacgaacaaggaaaagatagtttcttcgattcaaacatgaaacaagaaatatttgaccacgtctttaaagaaaatagaaaagtcactaaagaaaaactattaaattaccttaataaagagttcccagaatatagaataaaagatttaatcggacttgacaaagaaaataaatcttttaacgcatcattaggaacataccacgacctaaagaaaattctagacaaagcatttcttgatgataaagtcaatgaagaagtcatagaagatataattaaaactttgaccctatttgaagataaagatatgatacacgaaagactacaaaaatattccgatatatttactgcagatcaattaaagaaattagaacgaagacattacactggttggggcagactcagctataaactaataaacggaataagaaataaagaaaataataaaacaatactagattacttaattgacgacggaagcgctaataggaatttcatgcaactaatcaatgacgacacattgccattcaaacaaataatacagaaatctcaagttgtcggagacgtagacgacatagaagcagtagtgcatgacctaccaggttcacccgcaatcaagaaagggatacttcaaagtgtaaaaatagttgacgaattagtaaaagtgatgggagacaatcccgacaacatagttattgaaatggctcgcgaaaaccaaaccacaaatcgtgggagatcccaatcacaacaaagacttaagaaactacaaaactcattaaaagaactcggatccaacattctaaatgaagaaaaaccgagttacatagaagataaagtcgaaaatagccacttacaaaacgaccagctctttctttactacatccaaaacggaaaagatatgtatacaggcgatgaacttgacatcgaccatctaagtgattatgacatagaccacataatcccacaagcctttataaaagacgattcaatagataacagagtactaaccagttccgccaaaaatagaggaaaatctgacgatgtccccagtctagatattgttagggcaagaaaagcagaatgggtcaggctatataaaagcggattaatcagcaaaagaaaatttgacaatttaactaaagcagaaagaggcggcttaacagaagctgacaaagcaggatttataaaaagacaattagttgaaaccagacaaataacaaaacacgtcgcccaaatccttgatgcaaggtttaacactgaatccgacgaaaacgataaagttattagagacgtcaaagttataacattaaaatcaaacctagtctcccagttcagaaaagactttgagttctataaagtcagagaaataaatgattaccatcatgcacatgacgcgtacttaaatgcagtagttggaacggcattactaaagaaataccccaaattagcatctgagttcgtctatggagaatacaaaaagtatgatgtacataaactaattgcgaaaagctctgatgaccactcagaaatgggaaaagctacggcaaaatacttcttttacagtaatctaatgaactttttcaaacgagtaatccgatactccaacggaaaagtgatcgtaaggccagtcgtagaatattcaaaagacaccgaggacatagcgtgggacaagaaaagtaactttaggacaatatgtaaagtactctcctatcctcaagtcaatattgtcaagaaagttgaaacacaaacaggaggcttcagcaaagaaagtatcctaccaaagggggactcagacaaactaataccaagaaaaaccaagaaagcatactgggatacaaagaaatatggcggctttgattcacccacggttgcttacagcgtcttcgtagtcgccgacgttgaaaaaggtaaagcaaagaaattaaaaacggtcaaagaacttgtaggcatatctattatggagcgatcatttttcgaagagaacccagtagagttcttagaaaacaaaggatatcacaacatcagagaagataaactaattaaactcccaaaatatagcctgtttgaatttgagggaggaaaaagaagattattagcgtccgcctcggaattacagaaaggcaatgaaatggtaataccaggacatttagtaaaacttctatatcacgcacaacgaataaattctttcaatagtacgaaatatttagattacgtatcagcacataagaaagagttcgaaaaagttttaagttgtgtggaagattttgcaaatctatacgtagatgtagagaaaaacttgagtaaaatacgcgctgtcgcagactcgatggataatttcagcatagaagagataagtaattcgtttataaatttactcacactaaccgcattaggagccccagcagattttaatttccttggtgagaaaattccacgaaaaagatacacatccacaaaagaatgtcttaatgctacattgatacaccaatcgatcaccggactatacgaaactagaatcgatctatcaaaaataggtgaagaatga

SEQ ID NO: 5506 - RNA, 4134 nt, synthetic construct
  misc_feature 1..4134: note = Cas9 variant
  source 1..4134: mol_type = other RNA
atgaaaaaaccctactcgatcgggctagacataggaacaaattcagtcggatgggcggtcataaccgatgattacaaagtaccatccaaaaagatgaaagtcctaggtaacacagacaagcactttataaaaaaaaatctgataggtgcactattgttcgatgaaggaaccacagcggaagacagaagattaaaaaggacatctcgacgccgatacacgagaagaaaaaacagattaagatatctccaagaaattttctctgaagaaatatcaaaactagacagctcattcttccaccgtcttgacgatagctttctcgtcccagaagataaaaggggtagcaaatacccaatattcgcaacacttgaagaagaaaaagaataccacaaaaagttcccaacaatctaccatctacgaaaacacctagcagattcaaaagagaaaaccgacctcagactaatctacctcgctcttgcacatatgataaaatacaggggacatttcttatatgaagaatcgttcgatataaaaaataacgacattcaaaaaatattcaacgaatttatatcaatttacgataacacattcgaaggctcaagtctctccggacaaaatgctcaagtcgaggcgatctttacagacaaaatatctaaatcaactaaacgcgaacgcgtattaaaacttttcagcgatgaaaaaagcactggcctattctccgaatttctcaaactaatagtaggtaatcaagcagatttcaaaaaacattttgacctagaagaaaaagcacccttacaattctctaaagatacttacgacgaagacttagaaaacctcctaggacagatcggtgacggttttgcagatctattcctcgtggctaagaaactatacgacgcaatcctattaagtggcattttaaccgtaacagacccatccacaaaagctcctctatcagcaagtatgatagaacgatacgaaaaccaccaagaagatcttgctgctctaaaacaattcatcaaaaataatttatcagaaaaatatgcggaagttttcagcgatcaaagtaaagatggttacgctggctttattgacggtaaaacgacacaagaagcgttttacaaatatataaaaaacctactatccaagctagaaggagccgattactttctcaataaaattgaacgagaagattttctaagaaaacaacgaacatttgataacggatccatcccacaccaaatacacttacaagaaatgaatgcaattctcagacgacaaggcgaacactacttattcctaaaagaaaatcgagaaaaaattgaaaaaattcttgcatttagaataccctattatgtaggacctttagcaagaggtaatagagatttcgcctggcttacaagaaactcagaccaggctataagaccttggaacttcgaagaggtagtagataaggcatcatcagcagaagacttcataaataaaatgactaactacgacctctatcttccggaagagaaagtgctgccaaaacattctttattatacgaaaccttcgctgtatataacgaactaacaaaggttaaatttatcgccgaaggtctacgagactatcaatttcttgactccggtcaaaaaaaacaaatagtcaaccagctattcaaagacaaacgtaaagtaacagaaaaggacatcatacattatctgcataacgtggacgggtacgacggtattgaacttaaaggtatagaaaaacaattcaacgcatctctaagcacttatcatgatttattaaaaattataaaagacaaagaattcatggacaatccaaagaacggagaaatacttgaaaacatcatccacacgctaacaatttttgaggatcgtgaaatgataaaacagaggctagcacaatatgataccctattcgatgaaaaagtaataaaagccctaacaagaagacattatacagggtggggaaaactaagtgcaaaattaatcaatggaattagagacaaacagactggaaaaactatactcgaatatttaatcgatgatggtgattgtaaccgaaattttatgcaactgataaatgatgacggcctatcatttaaagaaattatacaaaaagcacaagtcgtaggtaagaccgatgacgtcaaacaagtagtgcaagaaatacctggttcacccgccattaaaaaagggatcctacagagcataaaaatcgtagatgagctagttaaagtgatgggtcacaatccagagtcaatcgtcattgagatggctagagaaaatcaaacgacagcaaaaggaaaaaaaaactcacaacaacgttataaacgtatagaagacgctctaaaaaaccttgcaccagggctcgactccaatatactaaaagagaatccaacagacaacatacaactacaaaacgaccgtctcttcctctactacctccaaaacggcaaagacatgtacacaggtaaagctattgatatcaaccaactttcgaactatgacatagaccacattataccacaagcttttataaaagacgattcgctagacaacagggtattaacatcctcaaaagataatcgtggaaaatcagacaacgtcccatcaatagaagtggtacaaaaacgcaaagccttctggcaacaacttttagattccaaattaatatcagaaagaaaattcaacaacttaacaaaagcaaagagggggggactagatgagagagacaaagtaggctttataaaacgacagttagtagagacgagacaaataaccaaacatgttgcccaattactcgatacaagatttaacacagaagtcaacgaagaaaaccaaaaaataaggaccgtaaaaataatcacactaaaatctaacttagtttctaacttcagaaaagaattcggattatacaaagttagagaaatcaatgactatcaccacgctcacgacgcctacttaaacgcagtcgtagcaaaagcaatacttaaaaaatatccaaagctcgaaccagaattcgtatacggcgactaccaaaaatacgatctaaaacgatatatattaaaatccaaagcatcaaacacaatcgataaggcaaccgaaaaatacttcttctactccaatctacttaactttttcaaagaaaaagttagatacgctgacggaacgataaagaaaagagaaaacatagaatatagcaatgatacaggagaaattgcctggaacaaagagaaagacttcgccacaataaaaaaggtactcagtttaccccaagtaaatatcgtcaaaaaaacagaagagcaaacagtaggacaaaacggcggcttatttgacaataacattgtcagtaagaaaaaagtagttgatgcgtctaaactaatacccatcaaatcctcattaagcccagaaaaatatggcggctatgcaagacctactatcgcgtactcagtattagtcatcgcagacatcgaaaaggggaagggaaaagcaaaaaaattaaaaagaatcaaggagatagtaggaataacaattcaggacaaaaaaaaatttgaatcaaatcccgttacatacctcgaggaatgcggttataagaatattaactcaaatctaataattaaactacccaaatactcattatttgaatttaacgacggacagagacgactactagcctcttcaattgaattacagaaaggaaatgaacttattttgccataccacctcacagctttactctatcacgcacaaagaattaataaaatctctgaaccaatacacaaacaatacgtcgaggcacaccaaaacgagttcaaagaactactgaccacaatcatcagcctatcgaaaaaatacattcagaaacccaatgttgaacttctcttacaacaagcattcgaccaggcagacaaagatatataccaattatccgaatccttcatttcacttttaaaattaacatcatttggtgcaccaggagcattcaaatttttaggagtagaaattagtcaatcctctgtccgctacaaaccaaactcgcaatttttagataccacacttatacaccaatcgattacaggactctatgaaacgagaatcgacctaagtaaactcggagaagactga

SEQ ID NO: 5507 - RNA, 4134 nt, synthetic construct
  misc_feature 1..4134: note = Cas9 variant
  source 1..4134: mol_type = other RNA
atgaataacaaaccctactccataggactcgatattggaacaaacagtgtgggttggagcgtcatcacagatgactacaaagtaccatctaaaaaaatgaaagtacttgggaacactgacaaaagattcataaaaaaaaatctcataggagccctgctatttgatgaaggtacaacggcagaggcaaggagactaaaacgcacagcacgaagacgctacacccgcagaaaaaacagactgcgatacttacaagaaatttttgcagaggaaatgtcaaaagtagacagctccttttttcatcgtttagatgatagttttctaattccggaagataaaaggggctcgaaatatcctatattcgccacgttggttgaagaaaaagaataccacaaacaatttcccacgatataccacttaagaaaacagcttgcagactcaaaagaaaaagcagatctgcgattaatctacctagtattagctcacatgattaaatatcgaggacacttcctatacgaagaagcatttgatataaaaaataatgatatccaaaaaatcttcaatgaattcatctcaatatacgacaacacgtttgaaggtagttctctgagcggacaaaatgcacaagtagaaaccatatttacggataaaatatccaaatcagcgaaaagggaacgcgtgctaaaactctttccagatgaaaaatcaaccggattattttcggaattcttaaaactaattgtaggcaaccaagctgattttaaaaaacatttcgatttagaagaaaaagctccactacaattttcaaaagatacatacgatgaagatttagaaaatttactcgaacaaataggtgatgactttgccgacttattcgtagccgccaaaaaactatatgacgcaattctattgtcaggcatcctcacagtcacagacccgtctaccaaagcaccattatcagcctcaatgatagaacgctacgaaaatcatcaaaaagatttagctgtactaaaacagttcatcaaaactaacctacccgaaaaatatgtcgaagtattctcagaccaatcaaaagatgggtacgcaggatacatcgacggaaaaactacacaagaagcgttctacaaatacataaaaaacctcttaagcaaattcgacggagcagactactttttagacaaaatcgaaagagaagtatttctccgtaaacagcgtactttcgataatggaagtattccacaccaaatccatttacaagaaatgaatactattctaagacgccaaggagaacattacccttttttaaaagaaaataaagaaaaaattgaaaaaatccttacattccggatcccataccatgtaggaccactagctcgtggtaatcgagacttcgcatggttaacaagaaactccgatcaagctattagaccgtggaactttgaagaaatagtcgacaaagccagtagtgcagaagactttatcaacaaaatgacaaattatgacctatatctgccggaagaaaaagtacttccaaaacatagcctactctacgaaacctttgcagtatacaacgagttaacaaaagttaagtttatagccgaaggaatgcgggattaccaatttctggactcaggccaaaaaaaaaaaataataaatcaattatttaagaaaaaacgcaaagtaactgaagatgatataatagactgcttacaaaaaattgataattatgacggaatcgaattaaaaggaatcgaaaaacaatttaacgcttcactttctacctatcacgacatcctgaaaataatacgagataaggaatttatggatgacccaaaaaacggtgacatactagaaaatgttatccatacactcacaatctttgaagaccgagaaatgattaaacaacgattagcacaatataacagcatatttgacgaaaaagtaattaaagcattatcacgcaaacattacacaggatggggaaaactttcagccaaattaattgatggcattagagataaacagacaggtaaaactatcctcgattacttgatggatgatggtaagtcaaacagaaacttcatgcaactaataaaagatgatgaattatccttcacagaaataatccagaaagctcaagtcgtcggggacacagataacctcagacaagtcgtacaaaaccttcctggcagtccagccataaaaaaaggaatcctacaatcgataaaaatagtcgatgaactcgttaaagtcatgggacacgcacctgaaagcatagttattgaaatggcaagagaaaaccaaacaacggccaggggcaaaaagaattctcaacaaagatacaaaagaatagaagattcccttaaaaacttggcaagtggattagactcgaacattcttaaagaaaaccctacggacaatattcagcttcaaaacgaccgtttattcctatactaccttcaaaacggaaaagacatgtacacaggagaagccttaaatataaaccaactaagcagctatgatatagaccatatcataccacaagccttcataaaggacgattcactagacaacagggtcctaaccagttcaaaagataacagaggaaaatcagacaacgtaccatccttagaagtagtagaaaaaatgaaagcattttggcaacaattactggatagcaaattaatctctgaaagaaagtataataacttgaccaaagcagaaagagaaagaggaggactaaacgaattagataaagtaggattcataaaacgacaattagtagaaacacgacaaataacaaaacacgtcgcacaaatcttagatgcacgcttcaataaagaggtaaccgaaaaaaacaaaaaaaaccgtaacgtcaaaattataacattaaaaagcaacatggtatctaacttccggaaagaattcggactatacaaagtaagggaaatcaatgattatcaccacgcgcacgatgcgtacttaaacgcggttgttgcaaaagcaattctaaaaaaatacccaaaactagagccagaatttgtgtatggggattatcaaaaatacgatctaaaacggtatataagtagaagtaaagatccaaaagaagtagagaaagctacagaaaaatattttttctattcaaacttattaaatttcttcaaagaagaagtgcattatgcagatggtacaatagtaaaacgagaaaacatagaatacagcaaagatactggtgaaatcgcatggaacaaagagaaagattttgcaaccataaagaaagttctatcgctcccccaagtcaacatcgtgaaaaaaacagaagaacaaacagtaggacaaaacggaggtctatttgacaacaatatcgtaagtaagaaaaaagttgtagacgcctcaaaactaatacctataaaaagcggattatctcccgaaaaatacggcggatatgctagaccaacaatagcatacagcgtactagtaacatacaaacaaaataataaaataaaaaataccatggtaggcataccagtgttaacaaaattagaatttgaacgagatcctaatttgtatttgagaaatttgggaattaacaacgtcagccacgttataaaactagtcaaatacacagtactcgaattcaaacacaaatatggaacatacagacgattcatagtatcaaatcaagaactcaaacgagcaaatcaaatatttgtaaccactaagcaaatgaaacttatatctcaatacaccacattagataaaaatgaacatgactcattactgaagaataaccaacaactaatacaaagcatttggaaccaattcctcgaattcatgttagctacagatcttgttaataaaaaacagtacgacgaattgatactaacaaacaatcaaacaatagaagaatgccgtaacattatgaacagagtgatcactacactaagcttcacaaatataaacgccggacaaaagaagataatctttgatgacacactctccctaccgataaaacgatggcaattcactgactccgacaaaatggtcaagaaaataatagaatcaactttaatacaccaatccatcacgggcctttacgaaacccggatagacctaagcaaactgggagaagattga

SEQ ID NO: 5508 - RNA, 4134 nt, synthetic construct
  misc_feature 1..4134: note = Cas9 variant
  source 1..4134: mol_type = other RNA
atggaaagtaaccacgatggagaacaagtaaaatatacattaggtctagacatagggacaagctctatcggctacgcggcgatcgacaaacatcaaaaaccaataagagcaaaaggaaaacatgtaataggtgtccgattattccaagaaggacaaaccgcagctgacagacgagcttttcgaacaaccagaagaagactaaaaagaagaaaatggagactcaacttgcttaatcgacttttcgatccatatctatcagaagtggatccaaactttttgccccgactaaggcaaagtaatctaagtccaaaagacgacaataaacatttcaatgggtcaacactttttcctgataaaaccgatgctgcattctatagacaatatcccacaatgtaccacctaagatacgcattaatgaccgagaaaagaaaatttgacataagagaagtatacttagcaattcaccatattgtaaaatacagaggtaattttctcaatagcgcgactgtagactccttcaaaacaagtaacatagacttcacttcccaatttgacagattaaacgaactatatagacaagtgatacttgacgaacctttccaaataaacatggatcaagtagacgaaatgacaaataaattgctcgacaatgacgccctcaaacttgatacccaaaaacaagtagcgaaattactcccggtaatatacaatgacaaaccaatagataaacaatatactagaattgctacagagttcagtaaagccatcttagggtataaaacaaaattagatgtaattcttaacctcgacacacaaaatgccaaagactgggtaattcgactagatgacgaagacatagacgacaaattaccagccttagtagaaaaccttgacgaatcacgccaggaaatagtaacaataatacgcgatctatatgcccaaatcactttaaatgctatagttccaaaaggaaaaagtctctcagaaagcatggttgataaatacaacgatcataaagaccacctggacctattaatgggcctaatccacgaactaggggacgactcggcaaaaggaataaaactacgagaagcatatacacaatatgtaggtaaatcagacgacaaaacactgaatcaagatgatttttatgcagctattaaaaagaatctagatgaagactcaaagcgatctccaaaaatacaacgactcatagaacaagcatcctttatgccaaaacaaagaacctctgcaaacggagtaataccacaccaactccaccaactagaactcgatcgtataatagaaaaccaaggacggtattacccctttctcaagaaaccaaatcccaatactcataaaccaaacggaggaaaatacaaactagatgaactcgtggcatttcgaataccctattacgtcggtccactaattacaaaacgtgaccaagagaaaacatccggagcagactttgcatggatgataaggaaaccaggtcaagaaggagaaataactccgtggaatttcgaccaaaaggttgaccgaatggcctctgcaaatcgtttcatcagaagaatgacaacaaaagattcatatctggtcgcagaagacgtactcccagacgcctccttaatatacgaaaaatttaaagcacttaatgaattaaacatgctcaaagtaaacgattctcgattgagtccatcccaaaaacaagatctctttaacaatctatttaagaaacagaaaaccataagaacaaagaaattacaaacatatataagaactaattgggaattgccaagtgtcatgatatcaggactagccgacccagacaaatttaattccagtctatcaacgtacatagacttccgtgacatatttggagaaaaagtcgacgatccaaatcgacaagcagactacgaagaaatcattgaatggtccactgtttttgaagacagaaaaatataccaagcaaaacttaaccaactagactggctaacagaacctcaaagaaaagccttactaacaaaaagatacacaggctgggggcgattatcaaagaaattacttacaggtctcaaagatcaaaatggtgacagcatcttagatcaattatggaaaacaaatgataactttatgcaaatccaatcgcgagacgagttcgcaaaacaaatacatgatgaaaacgcaaaacaattccacgaagccaacaatgtagatgatatactagatgatgcctttacatctccacaaaacaagaaagcaatcaggcaagtcgacaaagtggtacaagacgtagtaaaagccgttggatacgccccagacaaaatcgctatagagttcacaagatcattggaaaataatccacaaagaactgtatcgagacaacgacaactacaagccgcatacaaaaacatacctcgtgaaatcatgaaatcaggtttaatggctgaactaggatccgtagcagattcaaagaaagtactatccgacaaactatatctatattttactcaaatgggcaaagacatgtatgaagataaaaccataaacatcgacaacctgccgaattatgatatcgaccacatactaccacaagcatttataaaagacgatagcatagataatagagttcttatctccaaagaagaaaatgcgagaaaatcaaaccgagtaccattaaaattctttggtgcaaaaagaatgggattttggaaagatttactaaacaatggactcatttcgaaccgcaaattccaaaacctaacaaccgacccagagaaaatatcaaaatatagcgcgaaaggatttattcacagacaattagtcgaaacttcccaagtaataagattggtggcaaacatactaggaaatgaatactcacaagccggcacaacaataatagaagtaagcgcaaaaatgaaccgacaactaagagaagactttcatttaatcaaaaatagaaatgttaatgactaccatcatgcaatggatgcttacttaacagcttacgtcggtgattatttatatctaagatatccaaaactaagaccatacttcgtatacggtgatttcaagaaagcagaagaccaagaccttaatataagaaattttaacttcttacatgaccttaaagataatgaaagtctcgataaaatagttgattctgaaactggtgaaatagtttgggaaaaacacggctcagttaaacaactcaagaaagtctatcactataaattcatgctggttagtcaagaagtatatacaagacaagatgctttatttaatcagacaatctatcccgcaagtgatgcagataaaagaaaattaatccctattaaaaactcaaaaccggtggacgtgtacggagggtactccggaaatatcgatgcttatatggccattgtacgtgtccacggaaagaaagaagataactacaaagtggtcggaatccctatgagagctgtaacgaaactaaagaaagcagaaaaagaaggtcatgatagttatctgaatgccgtacatgaagtactaaaaccacaatttaccaaaaagaagaaaaaccgtaaaacaggcgaaattacagaaacagtagatgagttcgatgtactattagggaaagtctattacagacaactcatcgtagatggaaataagaaatttatgcttggttcatcatcttatcaatataacgcaaaacagctagtccttagtgataaagcgatgcaagtactaagcaaaaacggcaaagttaaatcacaagacgaaaaccaaaatttaatagacgtatatgacgaaatattagaaaaagtagaccaatactttgaactatatgatcaacgccactatcgagaatcactacacaaaggaaggggaatctttgtaaatttgccactatcaaaccaatatgatggaagcaaacttacatcatatggtaaatacgaaacgattgacgctatcctaaacggactacacgcaaatgcaacaatgagcaacttaagatacttagggatatcatctccatttggaaaaatgcaagcctctaacggattaacaatcgacccagatagtataatttgttatcaatcccctacaggactgttcgaacgacaaattaaattgtcggacctctga

SEQ ID NO: 5509 - RNA, 4134 nt, synthetic construct
  misc_feature 1..4134: note = Cas9 variant
  source 1..4134: mol_type = other RNA
atgaataaaccatactcaataggacttgatatcggtaccaattcagtgggatggtccatcataacagacgattacaaagtacccgccaaaaaaatgagagtattaggaaatacagacaaagagtacatcaaaaaaaatttaatcggtgcactactattcgacggagggaacacagccgccgaccgaagattaaaaagaacagcaagacgacggtacacgagacgaagaaaccgtatactatacctccaagaaattttcgccgaagaaatgtcaaaggtagacgattccttcttccatcgactagaagacagctttttagtcgaagaagataaacggggatcaaaatatccaatcttcgcaacaatgcaagaagagaaatactaccatgaaaaattcccaacaatctaccacctgcgaaaagaactagcagacaaaaaagaaaaagcagacttaagattagtataccttgcactagcccacatcatcaaattcagaggtcacttccttatagaagacgaccgatttgacgtgagaaatacagacatacaaaaacaataccaggcttttttagaaatattcgatacaaccttcgaaaataatcacctattatcacagaatgtcgacgtagaagctatactcactgataaaatatcgaaaagcgcaaaaaaagatagaattctagcacagtatcccaaccaaaaatcaacaggaatatttgcagaattcttaaaactcatagtaggaaatcaagcagatttcaaaaaacacttcaacctagaagataaaacaccactacaatttgctaaagactcctacgacgaagacttagagaatctgctaggacaaatcggcgatgaattcgctgacttattctcagtggcaaaaaaactatacgatagtgtacttctgagtggtatattaacagtcactgatctatctacaaaagcacccttaagcgcctccatgatacaaagatatgacgagcaccacgaagatctaaaacacttgaaacaattcgtaaaagccagcctcccagaaaactacagagaagtatttgcagacagtagtaaagatggatatgctggttacatagaaggaaaaactaaccaagaagcattttataaatacctcttgaaattattaacaaagcaagagggctctgagtacttcctagaaaaaataaaaaacgaagacttcctgcgaaagcaaagaacctttgacaacggatctattccacaccaggtacacctcaccgaattgcgcgcaatcataagaagacaaagcgaatattaccctttcctgaaagaaaaccaagatcggattgaaaaaatattgacattccgcataccatactacgtaggaccacttgcccgcgaaaaaagcgacttcgcatggatgacacgtaaaactgacgactcaataagaccatggaatttcgaggacctcgtagataaagaaaaaagtgccgaagctttcattcacagaatgacaaacaatgatctctatctaccagaagaaaaagtactgccaaaacactcattaatttacgaaaaattcacagtttacaacgaactaactaaagtcagatttttagcagaaggatttaaagatttccaattcttaaaccgcaaacaaaaagaaacaatttttaactcgctattcaaggaaaagagaaaagttactgaaaaagatataatctcattcctcaacaaagtagatggttacgaaggaatagcaataaaagggattgagaagcaatttaacgcgtccctctctacgtatcatgatttgaaaaaaatactaggtaaagactttttagacaacaccgataatgaattaatactagaggatatagtacaaacactcactttatttgaagacagagaaatgatcaaaaagtgccttgacatttacaaagatttcttcacagaaagccaactaaaaaagctctatagaagacattacacaggatggggccgtctgagtgctaaattaataaatggtattagaaacaaagaaaatcagaagacgatcctagattacttaatagacgatggtagcgccaatagaaatttcatgcaactaataaatgacgacgacctaagtttcaaaccaataattgacaaagcaagaacaggatcacattcagataatttaaaagaagtcgtcggtgaactagcaggatcaccagcaataaaaaaaggaatactacaatcccttaagattgtcgacgaattagtaaaggtgatgggatacgaacctgaacaaatagtagtagaaatggccagggaaaaccaaactacagcaaaaggcctatctaggtcccgacaacgattgacaacacttagagaatctttagcaaatctaaagtctaacatcttagaagaaaaaaaaccaaaatacgtaaaagatcaagttgaaaatcatcacttatcagatgatcgactcttcctttactaccttcaaaatggtcgagacatgtacacaaaaaaagcactcgacatcgataatctatcacaatacgacatagaccacataataccacaagcattcataaaagatgattcaatagacaaccgtgtactagtcagctcagcaaaaaatagagggaaatcagatgacgtaccgtctatagagatagttaaagcacgcaaaatgttctggaaaaacttattagacgcaaaattaatgtcccaacgcaaatacgacaacttaacaaaagcagaaaggggaggcctcacatcagatgacaaggcacgctttatacagagacaacttgtagagacgagacaaataaccaaacatgtagcaaggatactagacgaaagatttaacaatgaagtagataacggtaaaaaaatatgtaaagtaaaaatagtaacactaaaatccaatttggtaagtaatttcagaaaagaatttggtttttataaaattagagaggtaaacgactatcatcatgcacatgatgcatatctaaacgcagtagttgcaaaagccatactaaccaaatacccacaactagaaccagagtttgtgtatggaatgtaccgacaaaaaaaactatcaaaaatagtacatgaagacaaagaagagaaatattcagaggcgacaagaaaaatgttcttctattccaacctgatgaatatgtttaaaagagtggtccgattagcagatggatcaatagttgtacggccagttatagaaacaggacgatacatgcgaaaaactgcctgggacaaaaaaaaacatttcgcgacagtcagaaaagtactatcctatccacaaaacaacatagtaaagaaaacagaaatccaaacaggaggcttttcaaaagaatccatactagcacacggaaattcagacaaactcatccctcgaaaaacaaaagacatatacctagaccctaaaaagtatggaggattcgattcgccaatagtcgcatacagtgtactcgttgttgcagacataaaaaaaggaaaggcacaaaaattaaaaacagtcacggagctcctagggattacaataatggaaagaagtagattcgaaaaaaacccatcagcctttctagagagtaagggctatctcaacataagggatgataaattaatgatattaccgaaatacagtttatttgagctcgaaaacgggcgacgaaggttactagcaagcgcaggagaactgcaaaaaggtaatgaactagcactacctacacagttcatgaaattcttatatctagccagccgatacaacgaaagtaaaggaaaacccgaagaaatcgaaaaaaaacaagaatttgtgaaccaacacgtatcctatttcgacgatatactacaactaatcaacgatttttcaaaacgagtaattctagccgacgcaaacttagagaaaatcaataaattataccaggacaacaaagagaacattcctgtagacgaattggccaacaacatcataaatttattcacgtttacttcattaggagcgccggctgcattcaaatttttcgacaagatagttgatagaaaacgatatacttcaacaaaggaagtattaaactctaccttaatccatcagagtataacaggattgtatgaaacccgtattgacttaggcaaattaggggaggattga

SEQ ID NO: 5510 - RNA, 4134 nt, synthetic construct
  misc_feature 1..4134: note = Cas9 variant
  source 1..4134: mol_type = other RNA
atggaaaagacatactcaataggactagatataggcaccaattcagtagggtgggcagtcataacagacgattataaagtgccagccaagaaaatgaaagttctaggaaatacagacaagaaatacatcaagaaaaatttactcggagcactattatttgattcaggcgaaaccgcagaagcaactagattaaaaagagcagctcgacgaagatacaccagacggaaaaacagactcagatatctgcaagaaatatttgcaaaagaaatggcaaaagtagacgaatctttcttccaaagattagaagaatctttcttaacagatgatgataaaacatttgactcccatcccatattcggcaacaaagcagaagaagatacgtaccaccaagagttccctaccatataccacctacgaaaacacttagcggattcacccgaaaaagtcgaccttaggttagtatatttagcacttgcccatatgataaaattcagaggacatttcctaatagaaggacaactcaacgcagaaaataccgacgttcagaaaattttcgcagacttcgtcggagtatacgaccgaactttcgacgattcacacttatccgaaataacagttgatgccgccagcattcttacagaaaagatttccaaaagcaggaggttagaaaatttaattaaacaatacccaaccgaaaagaaaaacacacttttcggcaatcttgtagcattagcattaggcttacaaccaaatttcaaaacaaacttcaaactatcagaagatgcaaaattacaattttctaaagacacatacgatgaagacctggaagaattattgggcaaaataggagatgattatgcagatttatttacagcagccaaaaatctatacgatgctatcctactcagtgggatcctaaccgttgatgataactccactaaagcacctctgagtgcatcaatgataaaacgttacgaagaacatcacgaagatctagaaaaactcaaaacattcattaaagtcaataactttgacaaataccacgaaatattcaaagacaaaagcaaaaatggctacgcagggtacatagaaaacggagtaaaacaagacatattttacaaacatctaaaaagcatcatctcagagaaaaatggaggacaatactttttggacaaaatagaaagagaagatttcttacgaaaacaacgaacctttgataacggctccattccctatcagatacacttacaagagatgcgtactatactaagacgccaaggagaatattatcctttcttaaaagaaaaccaagcgaaaatagagaaaatacttactttccgcattccatactacgtaggaccactagcaaggaaaaattcaaggttcgcttgggccaaatatcacagcgacgaaccaataacaccctggaatttcgatgaagtagtagataaagaaaaatcagccgaaaagtttataacaagaatgacgttaaatgatttatatctaccagaagaaaaagtattgccaaaacactcttacgtctacgaaacattcgcagtatacaatgagctaacaaagatcaaatatgtcaacgaacaaggaaaatcattcttctttgacgccaacatgaaacaagagatatttgatcatgtatttaaggaaaacagaaaagttactaaagcaaaattactatcatacttaaacaatgagtttgaagaatttcgcattaacgacctcatcggactagataaggacagtaaaagtttcaacgcaagcctaggaacatatcacgacttgaagaaaattttagataaatcatttctagatgacaaaacaaacgaacaaattattgaagacatagtattgacactcacactattcgaagatagggacatgatacatgagcgtttacaaaagtactcagatatattcacatctcagcaactaaagaaattagaacgacgacactatactggatgggggcgactttcctacaaactgataaatggaataagaaacaaagaaaataataaaactatattagatttcctaatagacgatggcgatgcaaacagaaatttcatgcaacttataaacgacgattcgttatcctttaagacaacaatacaagaagctcaggtcgtaggagacgtcgatgacattgaagcagtagtacatgatttaccaggctcaccagcaatcaagaaaggaatattacaaagcgtcaagatagtagatgagttagtcaaagttatgggacacaacccacaaaatatagtaatagaaatggcaagagagaaccagataaccggatatggacgaaatcggtcaaatcagaggttaaagcgattacaagactccctgaaagaatttggtagtgatattctcagcaagaagaaacctagctatgtagatagcaaagttgaaaactcacacctacaaaatgatagactgttcttatattacatccaaaatggaaaagacatgtacaccggtgaagaactggacatcgatcacttatcggactatgacatagaccatattataccacaagccttcatcaaagacaattctatagataatagagttctaacgtcctcagccaaaaatagaggtaaaagtgatgatgtaccctccatcgaaatagtaaggaatcgcaaatcttactggtataaactatacaaatccggactaatatcaaaacggaaattcgataatttaacgaaagctgaaagaggaggattaactgagactgataaagccggattcataaaacgtcaactcgtagaaacaagacaaatcacaaaacatgttgcgcaaatactagatgctagattcaacacaaaatgcgatgaaaacgataaagtcatccgagatgtaaaagtcataacattaaaatcaagcctagtatctcaattccgaaaagagttcaagttctataaagtacgagaaattaacgattaccaccatgcccacgacgcctacctcaacgcagtagtcggaacagccctgctgaagaaataccccaagttagctcctgaatttgtgtacggagaatataagaaatatgacgtcagaaaacttgtcgcaaaatccagcgataaccattccgaattaggaaaagcaacagcaaaatacttcttttattcgaacctaatgaacttcttcaaaaccgaagtaaagtatgcagatggtagggtattcgaaagaccggacatagaaaccaacgcagacggcgaagtcgtatggaataaacaaagggattttaatatagtacggaaagtactctcttacccacaagtaaatatagtaaagaaggtagaagtccaaactggcggcttcagcaaagaatccatcctcccgaaaggagattcagataaattaataccccgaaaaacaaagaaacttcaatgggaaacacagaaatatggaggatttgactcacctacagtagcctacagcgtacttgtagtagcagacgtagaaaaaggaaaaacaagaaaattaaaaacagtaaaagagctagtaggaatctcaattatggaaagaagctctttcgaagagaacccagtctccttcctagaaaagaaaggctatcacaatgtccaagaagacaaactaataaaacttccaaaatattcgctgttcgagttcgaaggtggtcgtcgacgcttacttgcctctgcaacagaattgcaaaaagggaatgaagtagtattaccccaatacatggttaaccttttataccattcgcaacatgtaaataattcacataaaccagaacatctaaactacgtaaaacagcacaaagacgaatttaaagatatcttcaacctaatcatatctatagcgagaatcaatatattgaaacctaaagtggtagataatctgataaatgagttcacagaatacggacaagaagacatttcatccttatcagaatcatttatcaatcttctgaaattcatttcatttggagctccaggcgccttcaaatttctaaaattagatgtaaaacaaagcaatctgagatacaaatcaacaacagaagcactatctgcaacattaatacaccaaagcgtcacaggactctacgaaacccgaatcgacttatcaaagctaggggaagagtga

SEQ ID NO: 5511 - RNA, 4137 nt, synthetic construct
  misc_feature 1..4137: note = Cas9 variant
  source 1..4137: mol_type = other RNA
atgaaaacttttgcagaagaatacgtaatggataaatcgaaaccttacggaattggcctcgatataggaaccaattctgtgggatttgtagcaacggatgctgaaggacacctaataagattaaaaggtaaaacagtaattggcgcatacctctttaacgcaggaatttcagcagcagaacgacgaggatttagaacgacaagaagaagattaagtagagtaaaatggagactaggacttctacgcgaaatatttgagacacacttccaagaatcaatgggagaaaacgaggacaacgactttttcttacgatttaagtattcaaacatctcgccaaaagatcctcaattcagcactgctaaaggtctatttaatgaccgaacagataaagagttctacgaccaatacccaacaatctaccatttaagacgagcactaatgacagaagaccatcaattcgatataagagaaatctatatcgcaatgcaccacatcgtaaaatacaggggacatttccttaaagaaggtagggcaaaagactttaaagtgggagatctaagactattagataacttcaaaatgatgaatgaacaaatcgaagaaattaacccactatggcagcttaaacttcccacggacgacgcaagtataaaatcaataacagcaatattgctcgataacacgcaaagccaaaatgataggcaaaaagctgtaacgaaagtaatattggcaactttggtaaaagcaagcgacaaagatataaatgctgcaagaaaaagatttgtaggggaattatccaaagcaatggttggtttaaagaccaaattatgggttttagccgatgttagtcaaaatggtgactgggaaatcaaatacgaaaattacgcagactttgcagaaactataggttccggagaaagtgacacaatacaatcactatttaacgaaataaatgatctatacggcgtaatcacactcgcaggtattataccaaaggaagcagaatctttcagcgatgggatggtacgaaaatacgaacatcataggaaaaaccttgaacttttaaaagtgtattgcgccgaacaaagtgacggaaaaagaggccgccagattcggcaaacttacgataaatatatagacggagtagatagcaaacagtttacacaagaagatttttacaaagcattaagcaaatttacagccaaggacgaagcgactagcgaaaatgcgaaactcatagctcaagaaattgcagtaggaacatttatgcccaaattaagaacaaaagcaaatggtacaataccacatcaactccaccaaaaagaactggatgcaatcatagaaaaccaaaagaaatactacccatggctaggagaagtaaacccagtagaatcacaccgaagggccttaccatacaaactagatgaacttgtgtcttttcggatcccatactatgtaggacccatggtaacgccaacgaaaggagatccagagaaaagtaaattcgcctggatggtaagaaaagaaccaggaactataacaccatggaatttcgaccaaaaagtagacagatccgcctcgggtgaggctttcatccaacgcatgaaaacgacagatacatttctcattggagaagatgtactaccacaacaaagcctattataccaaaaattcgaagtacttaatgaattaaacaaaattatgattaatggcaaaccaatctgtagagaacagaaacagagactgtttaaacaactcttcatgcagtacaaaacagtaacagtaaagaaagtacaacaaaatctcattgccaatggcgaagaatcggaaaacgtaccaattacaggtctaagcgatccccttagattcaattcctcatttagtacatacatagactacaaagacattcttgggaccgcagctgtcaacgataacgcgaaacaaagcgatatcgaacaaatcattgcctggagtacaatttttgaagacgcagccatatttagagaaaaattaaatgatataacgtggctaaatgacgatcaaagaaacaaactaagccataaaagatatcgcggatggggacggcattcgcgaaaattattagcaggattaagagatggtgaaggacaaactataatagaacggctctggaatacaaatgataatttcatgcaaatacaaaacgactccgaaatagccagacaaataacagaggctaattcaagcaaaatggcaacagctgaaggtacagacgaaataatagacggtttttacacctcaccagaaaataagaaagcccttcgagaagtcatgaaagtagtcaaagatattcaaagagcacatcatggtcaagcgcccgcctgggtttacatagaatccccaagagaaactccacgtccagggcaaagaactgtgagcagagaacaacaactaacagacttatatgaaggagcagcaaaagaaatagtagatgacgccgtattaaacgaactaaaagataaggtaaaatcaaaagaaaacttcacagataaattagtattatactttttacagaacggacacgatatatatgcaaacgattcaatcaacattgacaacctcaacgcatatgatatagatcacgtactaccacaatcacttataaaagatgattcattagacaatcgagtattaacgacccatgaaagaaatctgaagaaaagcaacagattcgctacagaactatttgcggatcaaagaaagaaatgggaaaaatggcatcggctaggactaatctcatctcgaaaattaaaacatttaactatgcaaccaaatagcgtagagaaattcgcacacggttttatagcaagacaactaaccgaaacgagacaaataattcacttaacagctaatgtgctctcaaacctttatcaagaaaatgacacgaaaatcgtcatgatcaaagctggccttaattccgagttccggagaacattcgactttcctaaaaatagaagtgtaaacgactatcatcacgcattcgatgcattcctaacagcaaaaataggacgatacttattagcaagatacccaaaactagaacctttctttgtgtacggtaactttgtcaaaaacccaaaagcgatgaaaaggctaagtagttttgacttcattgcacaactagctgccaaaaccgacgacacgtctcacatagatcaaagatccttaaaacaagttccagtcgtaaatgaagaaacgggagaaattgtctgggacaaagatatagagcttgcagaattagacaaaacgtataattacaaaacgatgttagtcaaaagagcacaaacagaaaacaacgctcaaatgttcaaacaaacagtcttcaaagcaagagacaatcaaaataaaaccctaataccagtgaaaaatggtttatcgaccgatgtatatggaggacattcgcagcaagcaataagctatttatgcattgtatgggtgggacaaaagaagaaatacagagttctcggaataagcaccgcacatgccgggatcttaaataatttcgagaaaaattacggccgtttcgaagcgaaaaagaaattacaagaaatcgtatcaaatacattggataatgcagatcgaaatgacttcaaaatcgtagcacccaaagtactattcgaacaagtcgtcgaagacgacaatatgaaatttggacttggatctgcttcagattacagaaacgtccaacaactattcctttcacgtaaaaaccaactacttctagctaatatgatgacagatcaaatacacgaccaagacctagttcacctattcgatgaaatagtaggacaaatgaacgcgcacttccccatttttgatagaggaggatatagaagctcgctaactcagtcaagggacaaatttctaaaactaccatttaagaaaaatgaagatctaattacaaaacaggaagtcattcgacggatcctcgacggtctccacgcgaacgcaaacagaaaagatctaaaaatcataggatctaaaggagactttggtagattaggaactaagaaaatatatctatccaaagacgcaaaattaatatacactagcccaacctgcctctttactcgtacagtacctcttagctcattatga

SEQ ID NO: 5512 - RNA, 4137 nt, synthetic construct
  misc_feature 1..4137: note = Cas9 variant
  source 1..4137: mol_type = other RNA
atgacaaacgaaaaatatagcataggcttagacattggaacgagttcaatcggattcgccgtagtgaacgacaacaacagagtaattagagtaaaaggcaaaaatgcaataggggttagactattcgatgagggaaaagcggccgccgatcgaagatccttcagaacaacacgcagaagactctcaagaagacgctggcggctaaaattgctcagagaaatatttgacgcctatataacaccagttgacgaggctttcttcatacgattaaaagaatctaatttatcgccaaaagatagtaagaaacaatactcaggtgacatcttatttaacgaccgaagcgataaagacttttatgaaaaatacccgacgatatatcacttaagaaatgcgttaatgacggaacacagaaaattcgacgtacgcgaaatatatttagcaatccatcacatcatgaaattccgcggccatttcttaaacgcaacaccagctaataattttaaagtaggtcgactaaaccttgaagaaaaattcgaagaattaaacgacatataccaacgagtgttccccgatgaaagtattgagttccgaacagacaacttagaacaaataaaagaagtacttctagataacaaaagatccagagccgatcgccaaagaacattagtcagtgacatctaccaatcttccgaagacaaagacattgagaaaagaaacaaagcagtagcaaccgaaatactaaaagcatcactaggcaacaaagcaaaactcaatgtgatcacaaacgtagaagtcgacaaagaagcagctaaagaatggagtatcacattcgactcagaaagcattgacgatgatctggcaaagatcgaaggacaaatgacagacgatggacatgaaataatagaagttttaaggtcattatattctggaattacattatcagcaatcgtacccgaaaatcatacactttcacaatcgatggtagcaaaatatgatttacacaaagatcatctcaaactgttcaagaaacttataaacggtatgacagacacaaagaaagccaaaaacttaagggcagcgtatgacggttatatcgacggcgtgaaagggaaagttcttccacaagaagacttttataaacaagtacaagtaaacctagacgactcggctgaagcaaatgaaattcaaacatacatcgaccaagatatatttatgccaaaacaaagaacgaaagccaacggctcaatcccgcaccaattacaacaacaagaacttgatcagataattgaaaaccagaaggcttactatccatggctcgctgaattaaacccgaatcctgacaagaaacgacaacaattagcaaaatacaaactcgacgaactcgtaacctttagagtaccgtattacgtcggacccatgataaccgcaaaagatcagaaaaatcaaagtggagcggaatttgcatggatgataaggaaagaaccaggtaatataacaccatggaatttcgatcaaaaagtagaccgaatggccacagcaaaccaatttattaaacgaatgacaacaacagatacgtacttactaggtgaagatgtactcccagcccaatctctattataccaaaaattcgaagttcttaatgaattaaacaaaatccgaattgaccataaaccaatttcaatagaacagaaacaacaaatattcaatgatttatttaaacaatttaaaaatgtgactattaaacatctacaagattacttagtgtcccaaggccaatactcgaaaagacccttaatcgaagggcttgcagacgaaaaacgatttaactcatcactaagcacatattctgacctatgcgggatatttggtgccaaattagtggaagaaaacgatagacaagaagacctagagaaaataatagaatggtcaacaattttcgaagataagaaaatataccgagcaaaactaaacgacctaacatggttgacagatgatcaaaaagaaaaactggcaacaaaacgttatcaaggatggggtagattaagccgcaaactattggtagggctcaaaaatagtgaacatagaaatataatggatatattatggattacaaatgaaaatttcatgcagatccaagcagaaccggattttgcaaaactcgtcaccgacgcgaataaaggcatgttagaaaagacagattctcaagacgttataaacgacctatatacctcaccacaaaacaagaaagctatacggcaaatcctactcgtagtacacgatatacaaaacgctatgcatggccaagcccccgcaaaaatacacgtagaatttgcccgaggagaagaaaggaatcccagaagatcagtacaaagacagcggcaagtagaagctgcttacgaaaaagtatcaaatgaactggtatctgcaaaagtaagacaggagttcaaagaagcaatcaataataaacgagactttaaagatagactactactttatttcatgcaaggagggatagatatatacacaggcaaacaactaaatatcgatcaactatcatcataccagatagaccatatccttccccaggcctttgtaaaagacgacagcttaacaaaccgagtactaacaaacgaaaatcaagtaaaagcagacagtgtaccaatagatatattcggaaagaaaatgctatcagtttggggaagaatgaaagaccaagggttaatcagtaaaggaaaatacagaaaccttaccatgaacccagaaaatataagcgcccacactgaaaatggttttattaaccgacaattagtggaaactagacaagtaattaaactagcagtaaacatactggcagatgaatatggagattcaacgcaaataatatccgtgaaagcagacctcagtcatcaaatgcgagaagatttcgaattgttaaagaatagagacgtgaacgactaccaccacgcatttgacgcctatttagcagcatttattggcaattatctcctaaaacgatatccaaaacttgaatcgtattttgtatacggagatttcaagaaatttactcaaaaagaaaccaaaatgcgaagattcaactttatttatgatctaaaacactgcgatcaagtcgtaaacaaagaaacaggtgaaatattatggacaaaagatgaagacattaaatatatacgacatctattcgcatacaagaaaatattagtgtcacatgaagtgagggagaaaagaggagcactctacaatcaaactatatacaaagcgaaagatgacaaaggatcaggacaaggatcaaagaaacttattcgtataaaagatgataaagaaacaaaaatatacggaggatactcaggaaaaagcctagcttatatgactatcgtccagattactaagaaaaacaaagtatcttatagggtaataggtatacccacacttgcactagcaagattaaataaattagaaaacgattcaacagaaaataatggggaattgtataaaataataaaacctcaatttacccattataaagtagataagaaaaacggagaaataatagagacgacagacgactttaaaattgtagtatcgaaagtaagattccaacaattgatagacgatgcgggtcaattctttatgctcgcgagcgacacttataaaaacaacgcgcaacagctagtaataagtaataatgcgctaaaagcgataaacaatacaaatataacagactgtccaagagatgacctcgagcgattagacaacctgagattagatagtgcatttgatgagatagtcaagaaaatggacaaatacttctcagcatatgatgcaaataattttagagagaaaattagaaactcaaacctaatcttctatcaactaccagtagaagaccaatgggaaaataataaaatcacagaattaggaaaaagaaccgtactcacaagaatcttgcaaggactacacgccaacgcaactacaacggatatgtcaattttcaaaataaaaactccattcggtcaactacgacaaagatcaggaataagtctatcagaaaatgcacaacttatctaccaatcaccaactggattatttgaaagaagagtacaacttaataaaatcaaatga

SEQ ID NO: 5513 - RNA, 4137 nt, synthetic construct
  misc_feature 1..4137: note = Cas9 variant
  source 1..4137: mol_type = other RNA
atgaaaaacaaagactattcaataggcttagatataggtacttcctcaatcggattcgccgtagttgatgagaataatcatgttatgagagtcaaaggcaaaaatgccataggcgtaagactattcgacgaaggaaaaccagctgcagaccgacgtgcctttcggaccacacgtcggagactgtcacgaagaagatggagactcaaattactaagggaaatatttgattcatatatcacaccagtggacgaggcttttttcataaggttaaaagaaagcaatctatccccaaaagactcaaaaaaacaatatagtggagacatactatttaacgatagaagcgacaaagacttttataccaaatatccaaccatataccatctaagaaatgcattaatgacggaacaccaacgtttcgatatcagagaaatatatttagctatccaccacatagttaaattccgaggacactttttaaacgcaacacctgcgaataattttcaagtaggaaaacttgacttggaccaaaaattcgaagaccttaatgatatatatcaaagagtattcccagacgacagtatagaattcagaatcgacaacctcgaacaaataaaagccgtattattagactcaaaaaggtcacgcagcgacagacaacgctcacttgtagacgacgtatatcaaacttcagaagacaaagaagtagagaaacaaaacaaagcagttgcaaccgaagtcttgaaagccatactaggcaacaaagcaaaacttaacataattgcaaatgttgaagttgacaaagaggcagcaaaagagtggactataacattcgactccgaatcaatagacgacgacctcgcaaaaatagacggtcaaatgacagacgacggaagagctatagtggaaatactcagatccttatacagtggaattaccctttctgcaatagtgcctgaaaatcacacccttagccaagcaatggtagcaaaatatgatctacataaaaagcatctcacattactcaaaaaattaatcaattcgatgaccgacactaaaaaagctaaaaacctccgcgcagcctacgacggatacgtagatggcgtaaaaggaaaagtactaactcaagatgaattctataaacaaatacaatccaatttggacgaatcagtagaagcatccgaaatacaaacatatatagatcaggacatttttatgcctaaacaaagaaccaaagcgaacggtagcattccacaccaattacaacagcaagaactagaccaaataatagaaaaccaaaaggaatactacccctggttagctgaactaaatcctaacccagacaaaaaaagacaacaattagcaaagtataaacttgatgaactcgttaccttcagagtaccgtactatgtaggcccaatgataacagcagaagcacaaaaaaaacagtccggagcagaattcgcatggatgattcgcaaggaaagcggcaacataactccttggaactttgaccaaaaagtagatagaatggctacagcaaatcaatttataaaaagaatgacgactaccgacacatatttattgggagaagacgtattaccatcgcagtctctgctttaccaaagattcgaagtattaaacgagcttaacaaaatccgaatagatcgaaaaccaatatccgtcgagcttaaacaacaaatctttaatgacttatttaaaaaattcaaaaatgtaacaatcaaacacctacaagactatttagtagctcaaggacaatactcaaaacgaccattgatagaagggctcgcagatgaaaaaaggttcaactcaggcctctcaacctacaacgacttctgtgggatatttggggctaaactggtcgatgagaatgacagacaagccgatttagaaaagataattgaatggtctacaatctttgaagacaaaaaaatttaccgagcaaaactaaacgatctagcatggctaactgatgaacaaaaagataaacttgcgacaaagaggtatcaaggatggggacgactatcaagcaaattattaataggactacaaaacagcgaacacagaaacataatggacctcctttggattggaaacgaaaacttcatgcaaatacaagcagattctgactttgcgaaattaataaaagatgcaaatcaaaacgccttacaaaacaatgactctcaagacgtgatcaatgacttgtatacgagtccgcaaaacaaaaaagctatcaggcaaattttgttagtcgtacatgacatacaaaacgctatgcatggtcaagcccctaccaaaatacatgttgaatttgcaaaaggtgaagaaagaaatcccagaagatcagtccaaagacaaaggcaagtagaggcagcttacgaaaaagcatcaaacgaacttgtaggtgcaaacgttcgagaagaactaaaagacgcaataactaataaacgagacttcaaagatcgtctattcctatacttcatgcaaggcggggttgatatgtatagcggagaacccataaatatagacaatttatccagatacgatatcgaccatatcctaccacaggcgtttgtaaaagatgattccttaaataacagagtattaaccgatgcagagaaaaataggagaaaaagtgatgcagttcccaatgaattatttggagccaaaatgagagtaacatgggaacgcatgaaagaacagggcctaatctcaaaaggtaaataccgtaacctcactatgaatccagaaaatataaataaatacaccgaaaacggtttcataaataggcaattagtagaaacgcgacaagtcataaaattagcagtaaatatactagccgacgaatataaggaaaacacccaaataatatccgtaaaggcagatttatcgcaccaaatgagagaagattttgaattattaaaaaacagagatgttaatgactatcatcatgcatttgatgcttatttagctgcgtttatgggaaactacttattaaaaagatatccaaaactcagatcctacttcgtttatggagactttaaaaaatttactcaaaaggaaataaaactaagacgttttaacttcatctatgacttaaaacacgaagatcaagtaatcgacaaagaaaccggagaaatactttggaacaagaacgaagacatcgcatatataaggcacctatttgcctataagaaaatattaatttcacatgaagtttctgaaagaagaggcgcgttgtacaaccaaacagtctacaaagctagtgatgacaaggcatcaggacaaggatcaaaaaaattaatacccataaagtcagataaaccaacagaaatctacggaggatacaccggcagaacactagcttatatgacaatagttaaggtaacaaagggcaaaaagatatcctataaagtagtaggagtgccgacagcagtattagcgaaaatggcgggagtacgacagggatcccaagaagaacaagacaaattatacggggtgctaaagccccaatttactcaccaaaaagagaacaaaaaaacaggcgaaataaccgaaacagtagacaagtttgacatcattgtcccaaaagttaaatatcaacagttagtaaatgacaacggacagctcttcatgataggatcagataccctcccttataatgcagaacaattggtgctttcaaaagaatcagtccaaaccatcaacaatcccggaataaaagacgagggaagtgatgaagaaagcgaaaacaaaaaattagacaatgtatacgacgaaatagtattatgtatgaacaagtattttcctttatatgacaacagaggtttccgaaactccatcacaaatggaaaaaacaaattcttaaaattaccaataaagaacatatataaaaacggtaaactaataaatgtaggaaaacgcgaggttatcaatagaattcttcaaggtttacacgcaaatgctagtgtcacagacctatcaaatttaggtattaaaagcccttttggcttcttacaaaagggcgccggtctaagcctatcaggagaagcgcaactgattcaccaatccgctaccggcttgttcgaacaccgagtacagctaaataaaatcaaatga

SEQ ID NO: 5514 - RNA, 4137 nt, synthetic construct
  misc_feature 1..4137: note = Cas9 variant
  source 1..4137: mol_type = other RNA
atgagcaataaaccctatagcattggattagatataggtacaaactcagtaggatgggcagtaatcacagatgactataaagtaccatccaagaaaatgaaagttttaggtaatacagataaacacttcattaagaaaaacttgataggtgcactactattcgacgaaggaacgacagcagagggtagaaggctaaaacgaacagcaagacgcaggtacaccagaagaaaaaaccgactaagatacctccaggaaatattcagtgaagagatctctaaagttgacagtagttttttccacagattagacgacagtttcctcgttcctgaggataaacgaggatcaaaatatccaatttttgcaacactcgcagaagaaaaagaataccataaaaactttccaactatttaccacctcagaaaacaattagcagattcaaaggaaaaagccgatttaaggctaatctatcttgcgctggctcatatgatgaaatacagaggtcacttcttgtatgaagaaagctttgatattaaaaacaatgatatacaaaaaattttcaacgagttcatatcaatatacgacaataccttcgagggatcgtcacttagcgaacaaaatgtgcaggtagaagcaatttttacagataaaatctccaagtcggctaaacgtgaaagggttttaaaactctttcccgacgaaaaatccaccggacttttctctgaatttctaaaactaatcgtaggtaaccaagcagaattcaaaaaacactttgacttagaggaaaaagcccctttacaattttcaaaagatacatatgatgaggaccttgaaaacctattaggccagataggtgacggtttcgctgatcttttcctagtagcgaagaaactgtatgatgccattctactctctggtatcttaacagtaacggacccctcaacaaaagcgccattaagcgcctctatgattgaacgatacgaaaaccatcaaaaagacctagcatcactcaaacagttcattaaaaataatttaccagcagaaaaatgcgtagaagtattctcagaccaatcaaaggacggatacgctggatacatagatggtaaaactacacaagaagcattctataaatatataaagaacctcctgtcaaaattagaaggagcgtactacttcctagacaaaatagaaagagaagatttccttaggaaacaacgcacctttgataatggcagcatcccccaccaaatacacttacaagaaatgaatgctatactacgaagacaaggagaacactatccattcctaaaagaaaacagagagaaaatagagaaaattttaacattccgaataccataccatgtcggaccattagcacgcggaaacagagactttgcttggctcaccagaaattctgacgaagcaattagaccttggaattttgaagagattgtcgatcaggcatcatccgctgaagactttataaataaaatgaccaattacgatctgtacctaccagaagagaaagttctgccaaaacattctctactatacgaaactttcgcagtatataacgaattaaccaaagtaaaatttatcgcagaaggattaacccgctatcaattcctagataaaaaacaaaaaaaagacatattctatacattttttaaagcagaagacaagaggaaagtaacggaaaaagatataatacactatttacacaatgtagacggatacgacggtatagaacttaaaggaatagaaaaacaattcaacgccagcctaagcacataccacgacctcctaaaaataatcaaagacaaggaattcatggatgatcccaagaacgaagaaatacttgaaaacattgtacacacactaaccatatttgaagaccgagaaatgatcaaacaaagactagcccaatatgactcattatttgacgaaaaagtcataaaagccctaacccgtcggcattatacaggttggggaaaactatcagctaaacttataaacgggatatgtgacaagcaaacaggtaaaactatacttgattatttgatagacgacggaaaaataaatagaaatttcatgcaactaatcaacgacgacggactctcgtttaaagaaataatacagaaagcgcaagtagtaggaaaaacgtacgacgtaaaacaagtcgttcaggaacttccaggatcaccagcaatcaaaaaaggaatcctacagtcagtaaaattagttgatgaacttgttaaagtaatgggacacgcaccggaatcaatagtaatagaaatggcaagggaaaatcaaacaacagccaaaggtaaaaagaattcacaacaaagatacaagagaatagaagatgccattaaaaatcttgcacccggtctagacagcacaatcttgaaagaacacccaaccgataacattcaactacaaaatgaccgtctattcctatattatttacaaaacggtcgagacatgtatacaggaaaaccattagaaatcaaccaactatcaaattatgatattgaccatatcataccacaggcatttatcaaagatgactcacttgataatagagttctaacatcgtcaaaagaaaacagaggtaaaagcgacaatgtaccatcattagaagttgtagaaaaaatgaaggcattctggcaacaacttttagacagcaaactaataagcgaaagaaagttcaacaatctcacaaaagcagaaagaggaggattagacgaattagacaaagtaggatttataaaaaggcagttggttgaaacaagacaaataacaaaacatgttgcacaaatcctggacgccagatttaacaaagaagtaaccgaaaaaaacaagaaaaacagaaatgtaaaaatcattacactgaaaagtaacatggtttcaaatttccggaaagagtttggattgtacaaagtacgagaaataaacgactatcaccatgcgcacgatgcgtatctaaacgctgtagttgcaaaggcaatcctaaaaaaatatcccaaactagaacctgaatttgtatacggcgactatcaaaaatacgacctcaaacgatacatctcaaaatcaaaagatccgaaagaagttgaaaaagcaacagaaaaatatttcttctattccaaccttctaaatttttttaaagaagaagttcattatgcagatggaacaatagtaaaaagagaaaatattgagtattctaaagataccggagaaatagcttggaacaaagaaaaagactttgccaccatcaaaaaagtgctaagtttcccacaagtaaacatagtaaaaaaaacagaagaacaaacggtcggtcaaaacggtggactatttgacaacaacatcgttagcaaagaaaaagtagttgacgcctctaaacttatacctataaaaagcggtctatccccagaaaaatatggaggatacgcccgaccaaccatagcatattccgtcttagtaacgtataaacaaaacaacaaaatcaaaaacacaatggtaggtataccggtcttaaccaaactagagttcgaaagagatccaaacctatacctacgcaatcttggaataaataacgtatcacatgttataaaactcgtaaaacatacagtactcgaatttaaacataaatatggaacttacagacgctttattgtctcaaaccaagaactgaaacgagccaatcaaattttcgtcacaacaaaacaaatgaaactaataagccaatatactacccttgataaaaatgagcacgactctttactaaagaataatcagcaattaattcaatcaatctggaaccaattccttgagtttatgctcgccaccgatttagttaacaaaaaacaatacgacgaacttatcttaacaaataaccaaaccatagaagaatgcagaaacataatgaacagagtcattaccaccctttccttcaccaacataaacgcaggacaaaaaaaaattatcttcgacgatacacttagtttacccataaaacgatggcaattcactgacagcgataagatggtaaagaaaataattgaatccacgttaatacaccagtcaataacgggactctacgaaacacgcatagacctaaacaagttaggggaagactga

SEQ ID NO: 5515 - RNA, 4137 nt, synthetic construct
  misc_feature 1..4137: note = Cas9 variant
  source 1..4137: mol_type = other RNA
atgaacaaaccctattcaataggtttagacatcggaacaaattcagtgggttggtcaatcataaccgacgattataaagtaccagccaaaaaaatgagggtattaggaaacacagacaaggaatacatcaaaaaaaatctaatcggtgcactcttatttgatggaggaaacactgcagcagaccgacgactaaaaagaactgctcgaaggcgctacacacgaaggcgcaaccgaatactatatttacaagagatttttgccgaggaaatgagtaaagtggatgattcatttttccataggctagaagatagtttcttagtagaagaagataaaagaggtagcaaatatccgatctttgctacgatgcaagaggaaaaatattaccacgaaaaattccccaccatataccatctccgaaaagaactagcagacaaaaaagaaaaagctgatttaagacttatatacctagcattagcacacataatcaaattcaggggtcatttcttaatagaagacgatcgatttgacgtgcgcaacacagatatacaaaaacaatatcaagccttcctagaaatctttgatacgacattcgagaataatgacttgctttcacaaaatgtagatgtagaagcaatcctcacggacaaaatcagtaagtcagcaaaaaaagatagaatcctagccagataccctaaccaaaaatcaacaggaatcttcgctgaatttctaaaattaatagtcggaaaccaagccgatttcaaaaaacattttaacttagaagacaaaaccccattacaatttgcaaaagattcttacgatgaagacctcgaaaacttactaggacaaataggtgacgaattcgcagacttatttagcgcagctaaaaaactatatgattctgtattattgtccggaatccttaccgtaatagacctaagcacgaaggcacctctatcagctagtatgatccagcgctacgacgaacaccatgaagacctaaaacacctaaaacagtttgtgaaagcgtcattgcctgaaaactatagagaagtatttgccgattcaagcaaagacggatacgccggctacatagaaggaaaaacctctcaagaagcattttataaatatttactaaaattactcacaaaacaagaaggtagcgaatatctattagaaaaaataaaaaatgaagacttccttcgaaaacaaagaaccttcgacaatggatccatacctcatcaagtccatcttacagaactacgagcaattatccgtagacaaagtgaatactacccttttttaaaagaaaacctagaccgtattgaaaaaatcctaacattccgaataccgtactacgtcggccccctagcccgagaaaagtcagattttgcttggatgacaagaaaaacagacgattccataaggccatggaacttcgaggacctcgtggacaaagaaaaatcagccgaagcttttattcatagaatgacaaacaacgatttatatctaccagaagaaaaagtcctacccaaacattccctaatctatgaaaaatttactgtctataatgaactcacaaaggtacgcttcctagcagaaggttttaaagatttccaattcctcaatcgaaaacaaaaagaaacaattttcaattcccttttcaaggaaaaaagaaaggttacagaaaaggacattatatcatttctcaataaagttgatggctacgaaggtattgccataaaaggtatagaaaaacaattcaatgcctctctatctacataccatgatctcaaaaaaatattaggaaaagacttcttagataacacagataacgaactaatacttgaagacatcatccaaacactaacactatttgaagatcgagaaatgataaaaaaacgattggacatatacaaagacttctttaccgaatcacaacttaaaaaactctatagacgccactacactggctggggtagactttctgcaaaactaataaatggtataagaaataaagagaaccagaaaacgatccttgactatttaattgacgacggatctgccaaccgaaatttcatgcagttaataaaagacgcaggattatcattcaaaccaataatcgacaaagctagaacaggtagtcacagcgacaacttaaaggaagtcgttggtgaacttgccggcagcccggcaataaaaaaaggaatcctacaatcactaaaaatagtcgacgaacttgtcaaggtaatggggtatgaacctgaacaaatagtagtagaaatggcaagagaaaaccaaacaactgcaaagggattgtcaaggtccagacaaagactaacaacattacgcgaaagcttaggaaacctaaaatctaacatactagaagagaaaaaacccaaatacgttaaagatcaagtagagaatcaccacctttcagacgaccggctattcctctactatttacaaaatggaaaagacatgtataccgacgacgaattagacatagacaacttatctcaatatgatatagaccatataataccacaagcattcataaaagacgacagtatcgacaatcgagtattagtgtcaagtgccaaaaacagaggaaaatccgacgacgtacctagcatagaaattgtcaaagcgagaaaaatgttttggaaaaacttactagacgcaaaactgatgtcacagaggaaatatgataacctaacaaaagcagaacgaggtgggctaaccagtgatgacaaagcacgtttcatacaacgtcaactggtcgagacaagacaaataactaaacacgttgccagaatcctcgacgaaagattcaataatgaattagactccaaaggaagaagaataagaaaagtaaaaatcgtgacgcttaaatcgaacctagtaagtaattttcgaaaagaattcggattctacaaaatcagagaagtaaataactatcatcatgcacacgatgcatacctaaacgcagtcgtagcaaaggccattttaacgaaatatcctcaattagaacccgaatttgtatatggcctataccgtcgaaaaaaacttagcaaaatagtaagagaagataaagaagaaaaatactccgaagcaactcgaaaaatgttcttttactctaacttaatgaatatgtttaagcgagtcgtacgtctcgcagacggaagcattgtagttagaccagtcatagagactggtagatacatgggaaaaacagcatgggataaaaaaaaacactttgcaacggtacgcaaagtcttaagctacccccaaaacaacatagtcaagaaaacggaaattcaaacaggaggtttcagcaaagaaagcatcttagcacacggtaattcagataaattaatcccccgaaaaacaaaagatatatacttagatccgaaaaaatacggcggattcgattcaccaatcgttgcctatagtgtcctagttgtggctgacatcaaaaaaggcaaggcccaaaagttaaaaacagtgaccgaattgctaggcataacaataatggaaagaagtcgatttgaaaaaaacacatccgcatttctagagtctaaagggtacctaaatataagagatgataaactaatgatcttaccaaaatattcattatttgaattagaaaatggcagaagaagacttctcgccagcgcaggcgaattacaaaaaggcaatgagctcgcattacctacccaatttatgaaatttttatacctcgcttcaagatacaacgaatcaaagggtaaaccagaagaaatagaaaaaaagcaagaatttgtaaaccaacatgtatcatattttgacgatatattacaattaataaacgacttctcaaacagagtaatattagcagatgcaaaccttgaaaaaataaacaaactatatcaagacaacaaagagaatatacctgtagacgaactagcaaacaacatcattaatctatttacattcacatcactaggtgctcccgcagcctttaaattcttcgataaaatagtcgatcgtaaaagatacacatccactaaagaggttctaaacagtacattaatacaccaaagtataacaggactatacgaaacccgcatagatctaggaaaactaggagaaggttga

SEQ ID NO: 5516 - RNA, 4137 nt, synthetic construct
  misc_feature 1..4137: note = Cas9 variant
  source 1..4137: mol_type = other RNA
atgacaaatgaaaaatatagtattggcctcgacataggaacgagctctataggtttcgcagtagtaaacgacaataaccgggtaattagggtaaaaggtaaaaacgcaataggagttagattatttgacgaagggaaagcagcggcagatagaagaagtttcagaacgacacgtagacgactatccaggagaagatggcgcctcaaactactacgagaaattttcgacgcatatataacacccgtagacgaagcattctttatacgcttaaaagaaagtaacctgagtccaaaagatagcaagaaacaatactcaggagatatattatttaatgacaggtccgataaagatttctatgaaaaataccccacaatataccacctaaggaatgcccttatgaccgaacatcgaaaatttgatgtgagagaaatctacttagctatacatcatatcatgaaatttagaggacacttcctaaacgctacacccgccaacaacttcaaagtaggcaggttaaacttagaagaaaaattcgaagaacttaatgatatttatcaacgggtcttcccagacgaatcaattgagttccgaacagataacctcgaacaaataaaagaagtcctattagataataaacgatcacgtgccgaccgacaaagaacattggtaagtgatatatatcaaagcagcgaagataaagacatcgaaaaacgaaacaaagcggtagcaactgaaattttaaaggcatccctaggaaataaagccaaactaaatgtcataacaaacgtagaagtagacaaagaagctgctaaagaatggtccataacattcgactctgaatcaatagacgacgatttggccaaaattgaaggacaaatgaccgatgacggacatgaaataatagaggtccttagatcattatacagtggaataactttatcagccatagtcccagaaaatcatacattgagccaaagtatggtagccaaatacgaccttcataaagatcacctaaaattattcaagaaactgattaatgggatgaccgatacaaagaaagcgaaaaatcttcgagcagcatacgatggttatatcgacggtgtaaaaggtaaagtgctacctcaagaagacttctataaacaagtacaagtaaaccttgatgacagcgcagaagcaaacgagatccagacttatatagaccaagacatatttatgccaaaacaacgaacaaaagcaaacgggagcattccacatcaactacagcaacaagaattagaccaaattattgaaaatcaaaaagcatactatccctggctagccgagttaaacccaaatccagacaagaaaagacaacaacttgcaaaatacaaattagatgaattagtaacattccgcgtgccatattatgtaggacccatgattaccgctaaagatcagaaaaatcaaagcggggcagagttcgcctggatgataagaaaagaaccaggaaatattacaccttggaacttcgatcaaaaagtcgacagaatggcgaccgcaaaccaatttataaaaagaatgactactaccgatacatatctactaggggaagatgttctaccggctcaatcactcctttatcagaaattcgaagttctaaatgaattaaataaaatacgcatcgatcataaaccaatcagcatagaacaaaaacaacaaatatttaacgacctattcaaacagtttaagaacgtaactataaaacatctacaagattacctcgtttctcaaggtcaatactctaaacgcccgctaattgaaggattagcggatgaaaaacgattcaacagcagtttgtccacttactcagacctatgtggaatatttggagcaaaattagttgaagaaaacgatagacaagaagacttagaaaagataattgaatggagtactatattcgaagacaagaaaatataccgagcaaaactaaatgatcttacttggctcacagacgaccaaaaagaaaaactcgctaccaaaagatatcagggatggggaagactatctagaaaattattagtagggttaaagaactctgaacatcgaaacataatggatatactttggataacaaatgaaaattttatgcagatacaagcagaaccagacttcgctaaactggttacagacgccaacaaaggaatgctagaaaagaccgattcacaagacgtcataaacgacctatatactagcccacaaaacaagaaagcaataagacaaatactattagtcgtacatgacatacaaaatgcaatgcacggacaagcaccagcaaaaatacatgtagagttcgctcgtggtgaagaaagaaatcccagaagaagcgtgcaaagacaacggcaagtcgaggcagcatacgaaaaagtatcaaatgagctagtcagtgccaaagtaagacaagagttcaaagaagcaatcaacaacaaaagagatttcaaagatagactattcttatacttcatgcaaggaggaatagacatatatacaggaaaacaactaaacatagaccaattatctagctaccaaatagatcacatattaccccaggcattcgtcaaagacgacagcttaacaaatcgagtcttaacaaacgaaaaccaagtaaaagcggattccgtaccaattgatatctttggaaagaaaatgttatcagtatggggccggatgaaagaccaaggactgatatcaaaaggtaaatacaggaacctgacaatgaacccagaaaatataagtgcacacacagaaaacggctttataaatagacaattggtagaaacaaggcaagtaataaaactggcagtaaatatactagcagacgaatatggagattctacacaaattatctctgttaaagcagacctatcgcatcaaatgcgagaagacttcgaattacttaaaaatagagatgtcaacgattatcaccacgcttttgacgcatatctagccgcatttattggaaattacctactaaaaagatacccaaaattagaatcttattttgtgtatggagacttcaagaaatttactcaaaaagaaacaaaaatgcgcaggtttaattttatatacgatttaaaacattgtgaccaagtagtaaacaaagaaactggcgaaatcttatggacaaaagatgaagatataaaatacatacgacatagcttcgcatacaagaaaatacttgtatctcacgaagtcagagagaaaagaggagctctctacaatcaaacaatctataaagcaaaagacgacaaaggctcaggacagggcagtaagaaactaatacggattaaagacgacaaagaaacaaaaatatacggaggatacagcggaaaaagtttagcgtatatgacgatagtacaaataactaagaaaaacaaagttagctacagagtcataggcatacccacattagccctagctagattaaacaaattagaaaatgatagcacagaaaataacggtgaactatacaaaataataaaaccacaattcacccactacaaagtagataagaaaaatggggaaataatcgaaacgactgacgacttcaaaatagtcgtctctaaagtaagattccaacaattaattgacgatgccggacaattctttatgctggcatcagatacatataaaaataatgctcaacagctagtaatcagtaacaacgcattaaaagcaatcaacaatactaatataacagattgcccaagggacgatcttgaaagactcgataaccttcgtcttgattccgccttcgacgaaattgttaagaaaatggacaaatatttcagtgcctacgacgccaacaatttcagagagaaaatcagaaacagcaacttaatattctatcaactacctgtagaagatcaatgggaaaataataaaataactgaactaggaaaacgaaccgtacttacaagaattttacaaggccttcatgcgaacgcaacaaccacagatatgtcaatcttcaaaatcaaaactccttttggccaactacgccaaagaagtggtatttcgctgtccgaaaacgcacaactaatatatcaatcaccaacaggtttatttgaacgacgagttcaactaaacaaaataaaatga

SEQ ID NO: 5517 - RNA, 4137 nt, synthetic construct
  misc_feature 1..4137: note = Cas9 variant
  source 1..4137: mol_type = other RNA
atgacaaacgaaaaatactcaatcggattagatatcggaacatcgtcgattggattcgcggtcgtcaatgacaataatcgagtaatacgagtcaaaggcaaaaacgcaataggggtacgattattcgacgaaggcaaagcagccgcagaccgacgcagttttcgaacaacaagacgacgactatcaagacgaagatggaggttaaaattgttaagagaaatattcgacgcatacatcactccagtggacgaagcattctttatccgtctaaaagaatcaaatttatctccaaaagacagcaagaaacaatactcaggggacatattatttaatgatcgatcagacaaagacttctacgaaaaatatcctacaatttatcacttacgcaatgcactaatgacagaacatagaaaattcgacgtaagagaaatttatctagctatccaccacataatgaaattcagaggccactttctaaatgctacaccagcaaataattttaaagtaggaagattaaacctcgaagaaaaattcgaagaactaaacgacatataccaacgggtattcccagatgaatctatagaatttagaacagataatttagaacaaattaaagaagtactattagacaataaacggtcacgagcagatcgacaaagaaccttagtgtcagacatataccaatcttcagaagacaaagacatagaaaaacgtaataaagccgtagcaactgaaatattaaaagcatcactaggaaacaaagcaaaattaaatgtcattactaatgtagaagtcgacaaagaagcagcaaaagaatggagtatcacattcgacagcgaaagtatcgatgatgacttagcaaaaatcgaaggacagatgacggacgatggacacgaaatcatcgaagttctgagatctctatactccggaataactctttcagcgatagtaccagaaaatcatacactgtcacaatcgatggtagcaaaatacgacttgcacaaagaccacttaaaattatttaagaaattaattaacggaatgacagacaccaagaaagccaaaaacttgcgcgcagcttatgacggctacatagacggcgttaaaggaaaagtactccctcaagaagacttctataaacaagtacaagtaaacttagacgattcagcagaagcaaatgaaatacaaacatacatagaccaagatatattcatgccaaaacaaagaacaaaagcaaacggaagcatcccccaccaacttcaacaacaagaactcgaccaaataatagaaaaccaaaaagcgtactatccttggctagctgaattaaacccgaatccagacaagaaacgacaacaattagcaaaatacaaactagatgagctagtaacattcagagtaccatactacgtaggtcccatgataacagcaaaagatcagaaaaatcagagtggagcagaatttgcttggatgataagaaaagaaccaggtaatatcactccctggaacttcgatcaaaaagtcgacaggatggcgacagccaatcaattcataaaacgaatgacgacaacagatacatacctattaggagaagatgtactacctgcccaatccttattatatcaaaaatttgaagtacttaacgaacttaataaaattcgcatcgaccacaaaccaatatcaattgaacaaaaacaacagatattcaacgacctatttaaacaatttaaaaacgtgacaattaaacatttgcaagactaccttgtaagtcagggacaatatagtaaaagacccctaatcgaagggttagcagatgaaaaacgctttaatagcagtctcagtacatattctgatttatgtggaatatttggagcgaaattggtagaagaaaacgatagacaagaagaccttgagaaaattattgaatggagtacaattttcgaagataagaaaatttacagggcgaaattaaacgatttaacatggttgacagatgatcaaaaagaaaaactcgcaaccaaacgttaccaaggctggggaagactttctaggaaactcctagtaggtctcaaaaattcagagcaccgcaatataatggacattctatggataactaatgaaaatttcatgcagatccaggccgaaccagatttcgcaaagctagtaacagacgccaacaaaggcatgctagagaaaacagattcacaagatgtcattaatgatctttacacgagtccacaaaataagaaagccatacgccaaatacttctcgtagttcacgatatacaaaacgcaatgcacggacaagcgccagcaaaaatacatgttgaatttgcaagaggagaagaaagaaatccacgaagatccgtacaaagacagcgccaagtagaagcagcgtatgaaaaggtcagcaatgagctagtaagtgctaaagtaagacaagaatttaaagaagcaatcaacaataaacgagactttaaagatagattatttttatactttatgcaaggaggaattgatatctataccggtaagcaactaaatatcgatcaattgtcctcataccaaatagatcatatcttaccacaagcattcgttaaagatgatagcctaacaaacagagtactcacaaacgagaaccaggtaaaagcagattctgtaccaattgatatatttggcaagaaaatgctgagcgtttgggggcgtatgaaggatcaaggcctgatctcaaagggaaaatataggaacctaaccatgaaccccgaaaatatatctgcacacaccgaaaacgggttcattaatagacaactcgtagaaacacgacaagtcatcaagctagccgtcaacatattggcagatgaatacggagacagtacacaaattatatcagttaaagcagatttatcacatcaaatgagagaagatttcgaactactaaagaaccgcgacgtcaatgattatcaccatgcattcgacgcatatttagcagcgtttatcggcaattatcttttgaaaagatatccaaaactcgaaagctactttgtttatggagatttcaagaaattcacgcaaaaagaaactaaaatgaggcgcttcaattttatatacgatctcaaacactgcgaccaagtagtaaataaagaaacaggtgaaatcttatggacaaaagacgaagacatcaaatatataaggcacttatttgcttataagaaaatcctcgtatcgcacgaagtaagagagaaaaggggagcattatacaatcaaacgatttacaaagcaaaggacgacaaaggaagcggacaaggcagcaagaaattaattcgaataaaagacgacaaagagacaaaaatctacggaggatatagtggaaaatccttggcatatatgacgatcgtccaaataaccaagaaaaataaagtatcctacagggtaataggaatacccacgctcgcccttgcccgactaaacaaactcgaaaatgatagtacagaaaataatggagaactatataaaataataaaaccacaattcacacactacaaagtagacaagaaaaatggagaaattattgaaacaacagatgacttcaaaattgtcgtgtccaaggtaaggttccaacaattaatagacgacgccggacaatttttcatgctagcctcagatacatataaaaacaatgcacaacagttagttatctcaaataatgcgttaaaagcaataaacaataccaatatcacagattgtccacgagatgacctagaaagactagataacctacgtcttgactcagccttcgatgaaatagtcaagaaaatggataaatatttctcagcttacgacgctaacaatttcagagagaaaatacgtaatagtaacctaatattttatcaactaccagtagaggaccaatgggaaaacaacaaaataacagaactcggcaaacgcactgtcttaactcgcattcttcaggggcttcacgcaaacgcaaccacaactgacatgtctatttttaaaattaaaactccatttggacaattaagacaacgatcaggaataagcctttctgaaaatgctcaattaatataccaatctccaacaggattatttgaaagaagagtccaattaaataagattaaatga

SEQ ID NO: 5518 - RNA, 4140 nt, synthetic construct
  misc_feature 1..4140: note = Cas9 variant
  source 1..4140: mol_type = other RNA
atgaaacaaatattaggcctcgatctaggaacaacttcaataggatgggcattggttcgtgaagctgaaaacaaagatgaacaatcatcaatagtaaggattggggttcgagtaaatccgctgacatcagatgaacaaaaaaatttcgaacaaggaaaaagcataacaacaaatgctgacagaacacttaaacgtagtatgagaagaaacttacaacgatacaaactaagacgtgatcatctaaaagattgcctacaaaaaaatgggataataaccgataaagcagtattatcagagaacggaaactacacaacgttccaaacctactatttaagagcaaaagccgtaaacgaaaaaatatcattagaagaatttgcacgagttctactaatgctcaacaagaaaagaggatacaagagctcaagaaaaatgaaatctgcagacgagggtcaattaatagacggcatgtctgtagccaaaagactttacaatgacaatattacgccaggtcaatatgtactgtctctactcgaagaaggtagaaaatacataccggatttctacaggtcagatctcttagacgaacttgataaaatatggacgtttcagcaatgcttttacccagaaatattaacccctgagtgtagaaaacttatagcaggtaaaggtaaacaagcaacagcaaaaattttcttgggaaaatataaaatatatactgcagacaacaaatccaaagacaaacgattacaagcttaccaatggagggtagaagcactctcaggacaacttccaatagaagtagtagcatttgtcgtgtgcgagataaacggggctatccaagcatccagcggttacctaggagcaatttctgacagaagcaaagagctatattttgaaggactcacagtaggacaatacctagtcaaacagcttgaaaaaaatcccgacacttcactcaaaaataaagtcttctaccggcaagattatctaaatgaattcgaaaaaatatgggaaaaacaagcagaataccacacagaactgacaccgcaactaaaaaaagaagtaagagatataataattttttatcaaagaacgcttaaatcacaaaaaggtctcgtaggtttctgtgaatttgaaagccgccaaatagaggtgatgatagatggaaaacttaagaaaaagacagttggctgcagagtatgccctaaatcatcacctttattccaagaatataagatatggcataacctaaataaccttaaaatagtagaaaaagaacttgggaaatctagattcctcaatcaagacgaaaaagaatcactattccaagaactaaacataaaggaaaaattatccaaaacagacatactaaaactcctatgtttaaaagcaaaagaattcgatttaaactttgagaaagtagaagggaatcgaactcaagcagaattattcagagcctaccaggctataatagaaatgtcaggtaacggcgattacgacttctcaaaaatgacgtcaagcgagatccaagatacagtcacaggtgttttcagaggattaggatacaatacagacatactatcctttgacgcagaaaaagaagagaaaacatttgacaaacaaccgatgtatttattgtggcacctactatactcatacgagggagattcatcagatacaggcaacaaagccctaatcactaaaattaaaaaattatgtggatttgaaagtgaggaatatgcaagaatacttactgacgttacattccaatcggaatatggaaacttaagtaccaaagccatcagaagaatacttcctttcatgaaaaaaggaagtgaatatagcgaagcatgccgacatgcaggataccgtcattcagaaagaagcctaacaaaagaagagttagacaaaaaggtttacaaagaccacctagaattgttaccaagaaactcactacgaaatccagtagtagagaaaattctaaaccaaatgatacacgtagtcaatacagtagtggatacttatggcaaaccagacgaaattcggattgaattagcacgtgaactaaaaaaatcagcaaaggagagagacgaaatgacagcatccataaacaaaacagcagcagaacacaaaaaatactgtgaagtgctccaaaaagaattcggattcacgcacgtgagtagaaacgatattataaggtataaactatatctagaacttgaaaataacggatataaaacactatactcagatacctatatcccacgagaaaaattattctctaaggaattcgatatagaacatataataccacaatcaaagttattcgacgactccttctcaaacaaaacgttagaatgtcgatccgtaaatatagaaaaaagtaatgatactgcatatgattacgtacttaacaaatatggtgaacaaggaatattagattataaaaacaggatcgaaaatttatataaggactctaagattagtagaaccaaataccaaaaattaatgatgaaaaacagtgatatctccggaaatttcatagaaagagaattaagagatagccaatatatagcaaaaaaagcaagggaaattttagaagaattagtgaaattcgtagttccaaccacaggctcagtaacagcaagattacgagaagactggcaactagtcgacgtaatgcaagaacttaattggaagaaatacgacaaattagggctaacagacgtacgttatgacaaagatggcagagagatcagatacataaaagactggtcaaaaagaaatgaccatcggcaccacgcaatggacgccttaacaattgcatttaccaagagaagcatcatccaatacctaaataacttaaatgcaaaaagtgacaaatctggttcaatatatgcgatagaacaaaaagaactttttcgcgacaaaaggggcaagcttaaatttatacctcccatgccatgtaatatatttagagcagaagcgaaaagacatcttgagaatgttttggtatctgtgaaagcaaaaaacaaagtcgttacaccaaatatcaaccgaagcaaaggaaaaaacggaatcaataagaaaattcaactaacaccacgtggacagttacacaacgagacaatctacggctcgatgaagagatacgaaacgaagtgggaaaaaatcggaagtgggttcgatgagcgacaaattgctaaagtagctaacaaaaaatttagagaagcattattatcaagactagcagaattcggcaatgacccacaaaaagcttttaccggaaaaaacagtctggagaagaatccattgtatgtcgatgagttacacactcagaaagttccggaaaaagtcaaaatagtaactctagaaaacttatacacaatacgcaaggaaattacaccagacctgaagatcgataaagtagtggatgcaggggtcagacgagtactacaagaaagactagacgaattcgacgacgattcaaaaaaagcattttctaatctagacgaaaacccaatatggttaaacggaaaaaagatgaaacgggtaacaataatgggcgtatccaacgcagtacctttgcacgacaaaaaagattacaaaggcaatttagtattcgatagcaaagggaggaagcaaccagtagattttgtaaataccggaagtaaccaccatgttgccatataccgagatgaatcaggagaactacaagacattgtagtaagcttctatgaagccacaacacgatcgactttagggatccccgtaatagataaagaatacaaaaaagcagaaggatggaactttcttttctcaatgaaacaaaatgaatacttcgtatttccgaatgaggaaacaggttttaatcctaaagaaatagatttaatgaatccagataactatactacaatatctccgaacctttatcgagtccaaaaattttccaaatgtatgtatggaaatagcagtgtgcgagaatacgtctttagacatcacctagaaacaagcgtgaatgacagtaaaggattaaaaaacattgcatacaaaaatgtaaaaagtttagtatacctcgaaggaatagtcaaagtaaggattaaccatataggacaaatagtgagcgtaggagagtactga

SEQ ID NO: 5519 - RNA, 4140 nt, synthetic construct
  misc_feature 1..4140: note = Cas9 variant
  source 1..4140: mol_type = other RNA
atgcgaatagataacggactcgaagaattaaaagtaaacaacagaatctataatatcggcttagatatcggtacatcttcagtcggattcgctgtaacagacgcccaggataaattagttagagtcaaaggaaagactgctataggcgtacggctctttgaagaaggccataccgccgcagaacggagaggcttcagaacaacacgaagaagattatcacgcagaaaatggagaataaacttactcaatcaaatattcgaaccatacataagcgaaattgaccctactttctttgccagattgaaaaatagcagcttagccggtaaagataagaaatttgaaggatctctcttattcccggatcgaacagattatcaattctataaagacaacccgaccatgtaccatttacgcaaacacttaatggaaaaagacagacaatttgatctgcgagaaatatacctcgccatgcaccatattataaaatacaggggaaatttcctaaatacaacaccaatgaaccactttaaaaatgaagaaatcgactttagcgccttattttctagactaaatgaactttaccaagaaatcgacgacgaaaatatctttgaactcaatatagagaatgttgatgaaattaagaaaatattattaaaccacgacctgttcaaaatggaaaaacagaaacaagttgcgaaacttttaaatgttgacaccgatgacaaacaactaaagaaagaaaatactgcgttagcaagcaatttcagcaaagcaattctaggatacaaattcaacttagctctagtaacaaaaatacctgatcaagacaagaaagaatggacaatttcactaggagacgaagacttcgatgacagattagacaacgtaccagtagcactcaccgaatcacaactagaagtcgtagaggtattacattcgatattcaactcaatatcactcaatgaaatagtcgaaaacggagaaacactctccagtgcaatggtaagaaaatacaacgatcataaacatgacttaaaacttctgaaaaatgtaatgacgactctcgaagatagaaagaaagctaagaaaatacaaggtatatacaacgtttttgttggtaaagatactgacctaatctcggataaagacaaaaacaaatacaaagacaaagatgagttctataaagaaatacagaaaaacttagacaattccagcgacgccgaagaaattataaaaagaataaaacaagaccaattcttacccaaacaacgaaccagcaaaaatggagtaataccccaccaactccatcaaagagaactagatttaattatcgaaaaccaagcaaaatactacccttttctcaaagaagcaaaccctaacaagaaacgacttaaacaagccaaatacaaactggatgaacttatcgcatttaaaatcccatattatattggcccaaccagtggagctgaaaattcggatttttcatggctcaaacggaagaaagacgggcaaattacaccatggaattttgatgaaaaagtagaccgaatcgaatcagccaaccgattcatcagacgaatgacgactaaagacacctaccttctcgcagaagacgtacttccattagaatccttgatctacgagaaatactcagtcctcaatgagttaaataacgtccgaatcaatagacaaaaactatcagtaaacgataaacaagatatttacaatgaactattcaaaaactctaaaacagtaacactaaaacaattacaaaaatacttcgaagtcacaaagaaattaaaaacggtcgtcgtcgaaggcttagcagacccgaagaaatttctgagtaacttaggtacatatcatgactttaaattaatatttggagacatcgtcgacgaccccgaatatcaaacagacctagaaaacatcatagaatggagcactatttttgaagatagaggaatatttaatagtaaattaaacgaaataacttggttaacagacgaacaaaggaagaaagttctatcaaaaagatatcaaggttggggcagattcagcaagaaactattagttggacttaaaaactctcaaggcaactcaatactggacgaattatggaacacaaatctcaactttatgcaattacaaagccaagacgactttgctgaattaatccacgcagaaaatgctaaacaatttaaagcaaacgatcccgacaacccatggaacggaatagacgctatactaaatgatgcatacaccagtccacaaaacaagaaagcgataaggcaagtagtcaaagtagtacaagatatagaaaaagctatgggaaataaaccacagaaaatagcaatagagttcacccgaagcgccgacaaaaatcctagacgtaccgatagcagaataaaaagattatcagatatttacaaagaagcagcagaaaaagtagtaggagaatcgctaaaattagaattaaacgaatatctaacctctaaaaagaaaatgacagacaaaatgtacctatatttcacccaactcggaaccgatatctataccggtaagaaaatagatatcgatcaactaaacaattatgatatagatcacgtattaccccagagctttctaaaagatgattccttagacaatcgagtccttaccaacagatccgataatagcgaaaaatcagacacagtccctttacacaaatttggcgcaaaaatgggcaacttctggagacaactcgctgacgaaggattaatcacaaaaaggaaatacaaaaatcttactaccgaccccgctacaattgacaaatatactatacaaggatttattcgacgacaacttgttgaaaccagccaagtcatcaaattaacagcgaatatattaggcggcctttacccagaagaaacagaaattctcgaaattcccgcaaaactaaaccaccaatttagagatatgttcgacctcgtaaaagtgcgtgaagtgaatgattaccaccatgcatttgacgcttacatcacagtttttgtaggaaattttctataccgaaggtaccccaaattaagaagttactttgtatacggagactttaagaaacttaataaaaccgacgacgatattagaaaattcaatttcctcaacttatttaacaaagataaagttgaagataatgaaacagatgaaatcttatggagcaaagccgaatcaattcgagacattaaaaacatatataattataaatttatgctcgtatcacgcgaagtatatacacgacacggtgctatgttcaatcaaactatttacccagcctctaaaaatgattcaaagaaactaatcccaattaagaaaggaaaagacactgcaatatacggaggatatagcggtaacaccgacgcatacatggccatagtagcagtagaagacaagaaaggagaaaaatttaaagtcgtcggtgtaccaactagagcagtaagcagacttgaacaactagctgcagacgatcatgaccaatacctaacagcactgcacgacgttctaaaaccaaatttcaccaaaatcaaaacaaataggaaaacaaaagccaaagaagaagtcactacacctttccgaatacttgtaggaaaagtgggataccgacaactaatacaagacggccaagtaaaaatgatgttagggagttctgcctataaatacaacgccaaacaattagtactaagtgagaaatcattaaaagttatcaaaaacaataagaaatataaccctgatgatgaaaatcaagacctaatagacgtatatgatgaaatattaggtgtagtcaacagggccttcaatctctacgacacaaacggatttagaaagaaactcaatgataaccgagtcaaatttgttgaactcccaattaataacatatttgacggaacaaaattagtacaaatgggaaaaagagcagtattaacacaaattcttaacggacttcacgccaatgcagcattaggtgacttaaaagcgttaggaatcagcacaccattcggcaaaatgcaaagtaaatccggaatcccactatccatggatgcaagcctagtataccaaagcccaactggcctattcgaaagaaaactaaaccttagtgacctatga

SEQ ID NO: 5520 - RNA, 4140 nt, synthetic construct
  misc_feature 1..4140: note = Cas9 variant
  source 1..4140: mol_type = other RNA
atgactaagaaaaattactccataggattagatattggaacaaacagtgttggatgggctgtaataacagacgactacaaagtgccagccaagaaaatgaaagtactagggaatacagataagaaatatatcaagaaaaatttactaggagcacttctgtttgactcaggagaaacagctgaagcaacaagacttaaaagaactgctcgtcgtagatatacgcgaaggaaaaaccgacttagatatttacaagaaatctttgcagatgaaatggcaaaagtcgatgagagcttctttcaaagattagacgaatccttccttcgatgggacgacgataataagaaattgggacgatatcccatctttggtaataaagccgatgttgttaaataccaccaagaatttcccaccatctatcatctaaggaaacatttagctgacagcagcgaaaaagccgacctacgtctagtatatttagcattagcgcacatgataaaattccgaggacatttcctaatagaaggagaactaaacgctgaaaacacagacgtacagaaaattttcagtgacttcgtcagagtatacgatagaacgttcgatgactctcatttgtcagaaattacagtcgacgcagcatcaatactaacagagaaaatatcaaaaagtagaaggctagagaacttaattaaatactatccaactgaaaagaaaaacacactattcggaaacttaatagcactagctctaggcctccaacccaacttcaaaatgaacttcaaactcagcgaagatgctaaactacaattctctaaagactcctataacgaagacttagaagaactattgggaaaaataggtgatgattatgcagatctattcacgagcgcgaaaaatctatacgacgctatattactatcaggcatactaactgtcgacgataacagcacaaaagcgcccctcagtgcaagcatgattaaaagatacgctgaacatcacgaagatctggaaaaattaaaagaatttattaaagcaaacaaaagcgaactataccatgatattttcaaagatgaaaccaaaaacggctacgcaggatatatagaaaacggcgtcaaacaagacgaattttataaatatctcaaaaacacgttatctaaaatagcaggaagtgattacttcttagataaaatagaacgtgaagattttctaagaaaacaaagaacattcgataacggctctataccacatcaaatacacctccaagaaatgcacgcaatccttagaagacaaggcgactactacccgtttttaaaagaaaaccaagatagaattgagaaaatactcactttccgaataccttactatgtcggaccattagcaagaaaagatagcagattttcgtgggccgaatatcattcagacgagaaaattaccccatggaatttcgataaagttatcgacaaagaaaaatcggcagaaaaatttataacaagaatgacactaaacgatttataccttccggaagaaaaagtacttccaaaacactcacacgtttacgaaacctacgcagtatataacgaactcacaaaaataaaatatgtaaacgaacaaggcaaagatagcttctttgacagcaatatgaaacaagaaattttcgaccacgtcttcaaagaaaacagaaaagtaacaaaagaaaaactcttaaattacttgaacaaagagttcccagaatacagaattaaagacctcataggactagacaaagaaaataaatcatttaacgcaagcctaggaacctatcacgatcttaagaaaatactagataaagcgtttctagacgacaaagtcaacgaagaagtaatagaagatataataaaaactttaaccttattcgaagataaagatatgatacacgaacgactgcaaaaatattcagacatattcaccgctgaccaactaaagaaactagaaagaagacattacacaggatggggacgtttatcgtataaactgataaacggaataaggaacaaagaaaacaacaaaactatcttagattatctaattgacgacggctcagctaatagaaattttatgcagctaataaacgacgacacattacccttcaaacagataatccaaaaatcacaagtagtaggagacgttgatgacatcgaagcggtagtgcatgaccttcccggttcaccggcaatcaagaaaggcattcttcaatctgtaaaaatcgttgatgaattagtaaaagttatgggtgataatcctgataacatagtaatagaaatggcgcgtgaaaaccaaaccacaaatagaggtagaagtcaaagccaacaaagactaaagaaattacagaactcactcaaagaacttggatctaatatactcaacgaagaaaaaccctcttatattgaagataaagttgaaaactcacatttacagaatgatcaactcttcctatattacatacaaaacggtaaagatatgtacacgggagatgaactagatatcgatcatctgtcagattatgacatagatcacataataccacaagcatttatcaaagacgactccatagataatagagtactcacaagtagcgctaaaaacagagggaaaagtgacgacgtcccaagtttagatatagtacgagcccgaaaagccgaatgggtaagactttacaaatcaggcttaataagtaaaagaaaatttgataatttaacgaaagccgaaaggggaggtttaacagaagcggataaagcgggctttatcaaacgacagctagtcgaaactagacaaataacaaaacatgttgcacaaattctagatgcaaggttcaatacggaatccgatgaaaacgataaagtaattagagatgtaaaagtaatcacattaaaaagcaacctagtatcacaatttcgtaaagacttcgaattttacaaagtaagagaaataaacgattaccatcacgcacacgacgcatatttaaacgcggtagtaggcaccgcattactcaagaaatatccaaaactcgcgagtgaatttgtatacggtgaatataagaaatacgatgtacacaaattaatagcaaaaagttcagacgatcattccgaaatgggaaaagcaacagcaaaatactttttctacagcaacctcatgaactttttcaaaagagtaatccgatactcaaacggtaaagtcatcgtacgaccagttgtggaatactcaaaagacacagaagatattgcatgggataagaaatcaaacttcaggacaatatgtaaagtattatcttacccacaagtaaatattgtcaaaaaggtagaaacacaaactggcggattctcaaaagaaagcatacttcctaaaggggattcagacaaactcatcccacgtaagaccaagaaagcatactgggacactaaaaagtatggaggttttgacagtccaacagtagcatacagtgtatttgtagtagcagatgtagaaaaaggaaaagccaagaaactaaaaacagtaaaagaactcgtaggaatttccataatggagagatctttctttgaagaaaatccagtagagttcctggaaaataaaggttaccataatataagagaagataagctaattaaactaccaaaatactctctattcgagttcgagggaggcaaacgtagactattagcaagtgcatcagaattacagaaaggaaacgaaatggttatacccggacacctcgtcaaactactatatcacgcacaaagaattaattcattcaatagtacaaaatatttagactacgtttctgcccacaagaaagaatttgaaaaagtattatcatgtgtggaagacttcgcgaatctgtatgtcgatgtggagaaaaacctcagcaaaatccgagctgtagctgattcaatggacaatttttccattgaagaaatatcaaacagtttcattaatctattaaccttaacagcgctgggagcccccgccgactttaacttcctaggagagaaaatccccagaaaaagatatacgagtacgaaagagtgccttaatgctacattaatacaccaatcaataacgggattatatgaaactagaatcgacctctctaaaataggagaagaatga

SEQ ID NO: 5521 - RNA, 4143 nt, synthetic construct
  misc_feature 1..4143: note = Cas9 variant
  source 1..4143: mol_type = other RNA
atgggaaaatacaaccttggactcgacataggcactaattcagtaggctgggccgtagtcgacgaaaacaaccaaatagtgaaaaaaggaggaaaagccctctggggggtcagaatgtttgacgaagcgcaatcagctaaagaaacacgaatatacaggaacagtcgacgaagaatcgtccgacgaaatcaaagactactcttattacaaaaagaattctacgacgaaataataaaagtagaccaaaccttctttcaacgcctaaaagacagcttctttaaaaaagaagacaaattaaacaaaaataattataccttctttgatgatgacattacagatagagaatacttcaaaaaattccccacaatatatcacctaagatcacatttactatacaatgacgaaaagatcgacattagaatgttatatctagccctccatcacatcgtcaaataccgtggacacttcctcgactccggcgaggtcaatgaatcaaacttcagcaagataaaagacgtcctagatacatttaataataaaatgagcgaaatgtcactcgaatttgaagacaacgaagactacttctgtaaaatagaattcgacgaaaattttgagaacaaattaaaagatatcatgctctcgcaactcagcaaaaaagaaaaacgacaagaactaatcgatttatttaaagtagacaaaaagtcattagtcaacgaactactaatcgaactcctagtcaacaaaaaagtaaaactaaactccttaagtatcaccaacggtaaaaaatacgaagtatgtgaaatagacttcgaaaaagaagaactcttcgaaaaattagaagatgcgaagaaaataataaccgaattattcgacatcctcgacgaaattgttaatataaaaaaaatagttgactattattatgtactcaaaataataggagacaacgaatacttatccgaagcaatggtaaaaaaatatgacaaacacgacaaagacttaagagaactcaaaagcttcatcaaaacctactgccccaataaatactatgaatgtttcagaaaaacgtctaaccccaatctttgcaattaccccaagtatgtcggaataaactctgtcaacaaaaaaatagaacgtttcgcacactgtaaaaaagaagaattttataaatatcttaaatctttgttcaatacaataaaagatgagaacgcaaaattaaaaatcgacttattccaaaaagatatggaaaatgacgatttcctaaataggcaaaacagcaaccacaacagcagcatcccaatgcaactaaacttttgtgaacttaaaaaaatactagaaaaccaatctaaatattacccatttttaatgctaaaaaactccgacggctactccacatccgacagaataatcgcaatcttcaaatacaagataccatactatgtcggaccccttaacaagaactccaaatacagctggcttgtaaaaaaaagtaacgaaaacataaccccttggaactacgaaaaggtaatagatttagatgcgtccgcaaaagagttcatacaaagaatgcaaaacaaatgcacataccttaaaggggaaaatgactactgtcttcccaaaaaatcaatactattttcagaatacaactgcctgcaatacttaaatagactaataataaacggggcactcatcgaaaacaaactaaaaaacgagatatatgaaaacatcttcctctgttataaaaagccaacaaaaaagagcatagttgaatacctgaaaaccaattacaactatgacgaaaccaccttgaaaagcaatatactcgaagtgaattgtgacatgtcgagttatatccaatttaaagaaatctacggtgaggacttcgaacaaaacctaaacatagtcgaagacatcatcaaagacataactatatttgaagacaaaaaaatattagaaaagagactacgagaaatatatcatctatccgaagacaaggtacaaaagataaaagggctcaactacaaaggctacgctaccctatcaaaacactttttgaataatttctactccgtaaacgaagagaccggagagatttacggaccaatcatacaaataatgcgagacacaaactataatctgcaacaagtaatttacaacgaccgatataatttcatgaaagcaatagacaaatacaataaaaaaaacttagacacagaaaaaaaactcaacgtgtctgattttatagacgagtatatatatgtatctccgataatgaaaagaagtctcatacaatcctacaacatcatacaagaactggaaaaaatcctaggcgagtctattagcaaatactacatagaatgtgcaagagtgcgcagcaactctaaggacgttatcaatagcagatatcgacaactatccgaactatacaaagactgtgaacaccaagtatctgacataagcaagaattacattaacataaataaattaaaaaaacaactagaagacaataagaacgaactaagggcagacaaactttacctctacttcacacaattcgggaaatgcatgtacacactaaaagacatcgacctcgacgacgtcttcttgggcaaatatgacatagaccacatatacccccaaagcttaataaaagatgactcacttaacaacagagttcttgcaagcaaagaaaaaaacggaaaaaaagacaatcaatttatatttaacatcccagaattccttcccaaaaatgcagagctcttctataagaaactccttgaatgcaagttaataactaaagaaaagtatcgcagactaaccatgaaaaaaatagacgacgatgaactagacatattcgtaaatagacaactagtagcaacgaaccaatcagtcaaaggattagtggacgtactaaaaatatacaaaggagtaaagccaactaatatagtctattcgaaagctgtcaacatatccgacttcagaaataattataacctatataaatcaagaacagcaaacaattatcatcatgctcatgatgcgtatttaaacgtagtcattggaaaagcccttgacgtatactatcaatgcaactacttccaaaattataaggacgtcatcaaactaaaagacaggaacattaccataaacccagaaataatactatcaaaaaatagatacgtaaatagaaatggcgagaaaaaagtaatttgggacctcgataacacactaaaactaataaaaaataatttatacaatcgttttgacataaccgaaacaattatgacaagaaaatctaataaaatgttttcaaaaagctccatctcacctgctaaaaattcaaaaaatctaattccgataaaaacctccgatccccgatgtaacgtcttaaaatatggcggaataaaatcaaattcctacaacttttattgcatagttgagctctacgacaagaaaggaaagaaatcatacatcctagaagcaatcccaaagactcactcagataagttggaagaatatataaagaattctatagacgaaaaaaacgtatcaaatttcaaaataataaacaaaaatattaaaagtaatataataatagaatataaaaaactgcgctacgtaataaccggcaaatccggaaaatactatctaattaaaaacttcaaagaccggaatttttcatataacgccatcaaaaccataaaatatattgagaaatacaactaccaaaaaaaatacgaaattccatttgaagagactaaagaaaaaataatattagcccccaaaaaaaaagacacgaaagaaatttcactaaccctagacaactgtcaggcactactcgatgaaataatttcactgttcaaaaaagacatatataactatgacatcatatacaaaatcaccagcaaactagaagaaaataaacagaacctaacgcttacaaacctaatcaaagtgttaactgaaattttaatactcttaaaaacaaatgaacgcggaacagcagacctaacacttatagacatgagcaaagatacaggaacactatgcatctccaaaacattaaaaccaggtatgaagttcatttcagaatcaccaacaggatattaccgtaaaataatattcgaagttccaaatgggatctga

SEQ ID NO: 5522 - RNA, 4143 nt, synthetic construct
  misc_feature 1..4143: note = Cas9 variant
  source 1..4143: mol_type = other RNA
atgaaaagaatactaggcttagacctaggtactaccagtatcggttgggcacttgtcaatgaagctgaaaacaataatgaggcgagtagtattgtcaggctaggtgtacgcgtaaaccccttaaccgtcgatgagaaaagcaacttcgaaaaaggtaaagctattacaacaaatgcagatcgtcaattaagacacggagctagaatcaacctacaaagatataaattgaggagacagaaccttcatgattgtctacaaaaacaaggatggttaggtacggaagcaatgtacgaagaaggaaaagcaagtacgtttgaaacatataaactacgtgccaaagcggccgaagaagagattagcttacatgagttcgcacgagtattatttatgttaaataagaaaagaggctacaaaagtaatagaaaagctaataataaagaagacggacaactattcgatgggatgactatagcaaagaaactttacgaggaacacctaacccccgcagaatactctttacaattactaaacaaaggaaagaaattcactcagggttattaccgtagcgatttaaatgccgaactcgaacgcatttgggatgaacagaagaaatattaccccgaaatactaacagacgagttcaaacaacaattagaaggaaaaacaaaaacgaacaccagtaaaatcttcttagcaaaatatggaatatatagcgctgatttaaaaggactggatagaaaattccaaccattaaaatggagagtagaagcactacagcaacaagtagacaaggaagtgctcgcttttgtgatcagtgacctaaaaggacaaatagctaatacgtcaggcttacttggagctatatcagacagaagtaaagaactatacttcaacaagcaaactgtgggacaatatctttgggcatcactagaagaaaacccgcatatttcaatcaaaaacaaaccgttctacagacaagactacttagacgaatttgagaaaatatgggaaacacaagcagcatttcataaacaactaacgccggaacttaaacaagaaataagagacataataatattttaccaacgaccgttgaaaagcaaaaagagtctaatttcagtatgcgaactagaacaaagaaaagtaaaggctaccatagacggcaaagaaaaagagataactataggacctaaagtagcgcctaaatcatccccagttttccaagagtttcgaatatggcaaaatttaaacaacgtcctattaatcgataatgatacaaatgagaaaagaccactagacgaagtcgaaagaaatctactatacaaagaactttcaataaaagccaaactcagtaaaactgaagcactaaaaatactaaacaaaaagggcaagcaatgggatttaaactacagagaactcgaaggcaatagaacacaagcaattcttttcgactgctacaacagaatcattacactaacaggtcacgaagaatgcgactttaagaaaatcaaagcgagcgaaatcagacactatgtaagtacaattttcaaaaaccttggcttcagtacagaaatattagatttcgatccgagcttaaagaaacatgaactagaaaaacaaccaatgtatcaactttggcacctactatattcttacgaatctgataactctagaacgggaaatgaatctttattaagaaaattagaaacaacttttggatttccagaagaatacgctacagtactgtgtgatgtagtatttgaagaagattatggaaatctgtctgtgaaagcaatgcgagaaatacttccatatttacaagcagggaacgattacagtcaagcatgtgcatacgcaggatacaatcattcgagacattcacttacaaaagaagaactcgatcaaaaagtatacaaagaacgcctagaactattacctaaaaactcattaagaaacccagtagtagagaaaatattaaatcaaatgataaacgtaattaacgccataatagatgaatacggaaaaccagacgaaattagaattgaaatggctcgagaattaaaaagctcagccgcagacagaaagaaaaccacacatgcgatttcgcaaggaaacgctgaaaatcaacgcatcagagaaatactagaaaaagagttctctttgagctacataagtaggaatgatatcatcaaatataaactttatgaggaactagaaccaaactactacaaaacactttatagcgacacctacattactaaagataaactcttctcaaaagactttgacatcgaacatataataccgaaagcaagattatttgacgactccttctcaaataaaaccttagaagcacgcaacataaatttagaaaaatctaataaaaccgcatttgatttcataaaagaaaaatacggtgaagacggcgcagaagcatataaaaagaaactagacatgctgttagaaaatgatgctatcagcagacccaaatacaacaatttattaagggcagaagctgacataccttctgattttatcaatcgagacctaagaaacacacaatatatcgccaagaaagcgtgcgaaattctaggtgagctagttaaaaccgtcactccaactacaggcaaaataaccaatcgacttagagaagactggcaattagtcgatgtaatgaaagaacttaactttgaaaaatatgaaaaactcggcctgacagaaatagtcgaagaccgagatggaaggaaaataaaaagaataaaagattggacaaaaagaaatgaccacaggcaccatgcgatggacgcactcgcaatcgcattcacaaaaccatcattcattcaatacttaaataatttaaatgccagaagcaataaaggagatagtatatatgccatcgaaaacaaagaactgcattatgaagaaggaaaactacgatttaatgcaccaatcccagtcaacgagttccgagcagaggccaaaaggcatctgagcgctattctagtaagcataaaagccaaaaataaagttatgacacaaaatgtcaacaaaataaaaacaaaacacggcattataaagaaaatccagcttaccccgcgcggaccactgcacaacgaaacaatatatggcaccaaaatgcgacccataatcaaaatggtcaaagtcggagcagcacttgatgaagcaacaataaataaagtaagttcacccgcgatccgagaagctctgttaaaaagattaaacgaatactcaggcaacgctaaaaaggcctttacagggaaaaacacactagagaaaaatcctatatacctaaacgcaggaagaactaaaacagtacccagtctagttaaaactgtggaatgggagagcttccacccaacaagaaaactgatagacaaagacttaaatgttgataaagttgtagataaaggaataagagaaatactaaaagccagattagaagaatttaacggtgatgcaaagaaagcatttagtaaccttgaagaaaaccccatttacctagacgaagctaagaaaatagccttaaaaagagtctcaatagaaggggtcctctcagcaataccacttcacaccttgaaaaatcaggccggaaaaccaataacaggtaaagatggaaagcctgtattaggtaattacgtgcaaacatcgaataaccaccacatagcgttttattacgacgaagatggaaacttacaagacaacgccgtatcattctttgaagctgctgaacgaaaaagccagggtatcccggtaatcgataaagactataacagagataaaggatggagatttctatttacaatgaaacaaaacgaatatttcgttttcccgaacgaagccacgggatttatccccagtgaagtggacttaacagacgaagcaaactacgggatcataagtccaaatctgtacagagttcaaaaggtgtcacgaatagacaaaggaacctcagcctcaagagactactggtttagacatcacctagaaacaatcttaaacgacgacgcaaaattaaagaacctagcctttaaaaggataagaggcttactagaactcaaagacataatcaaagtacggattaacagcacaggaaaaatcgtggccgttggagaatacgactga

SEQ ID NO: 5523 - RNA, 4143 nt, synthetic construct
  misc_feature 1..4143: note = Cas9 variant
  source 1..4143: mol_type = other RNA
atgaaaaagatactcgggctagacctaggaaccacatcaataggatgggccctggtcaatgaagcagaaacagaatcggaaaaatcaagcataatcagactgggagtaagagtaaatccacttactatagatgaaaaaggaaatttcgaaaaaggcaaagctataacaaccaatagcgaccgtcaacaaagacactcagccaggataaatctacaacgttacaaactgagaagacagaacttatgtgactgcctccagataggcggcttattaggatccgaatcaatgtatgaagaaggtaaagaaagcacttttgaaacctacaaattaagagcaaaagcagcgacggagaaagtagcactccatgaatttgcaagaatactatttatgctaaataagaaacgtggatacaaaagtaacagaaaagcaaattcgaaagaggacggacaagcgtttgatggaatgacaattgccaagaaactatatgaagagaatttaacacccgcagaatatagtctccaattactaaacaaagggaagaaattttcaccctcctattatcgaagcgatttagaatccgaattaaaccgtatttgggaagaacaaaagaaatattacccagaaatactgacagatgatttttaccaacaacttgaaggaaaaacaaaagttaatactacgaaaatttttctcgctaaatacggtatatacacggcagacctaaaaggactagataagaaaatgcagccattaaaatggagaattgaagcacttaacaaacaggttgataaagaagtcctaacattcgtagtatctgacttaaaagggcaaatagaaaagaccagcgggcttttaggggaaatctcagacagatcgaaagaactatatttcaacaaacaaactgtaggacaatatgtatgggcatccttaaaagagaacccccacgtgagcattaaaaataaacccttctacagacaagactacctagacgaatttgagaaaatatgggaaacacaagcagcatttcacaaagaactaacaccagaactgaagaaagaaatacgcgacataataatattctatcaaagaccactaaaaagtaagaaaggattaataagtatatgcgaattagaacagaagaaagaaaaagtaataatagagggtaaagaaaaagaaatattaattggttcaaaagtcgccccaaaatcgtcaccaatgtaccaagagttcagaatctggcaaaacttaaataatgtactattaatagatacagaaataaacgaaagcagaccgctagatgaagaagaaaaagcactactatacaatgaactatcagttagagccaaattatcagaaacagaagcgttaaaaacaatcaataagaaaggaaaacattgggatctcaactttaaagaactagaaggtaatagaactcaggcagttctatttgaatgctacaatagaataataactcaaactggacatgaagaatgtaattttaagaaaatatcagcagaagacatcagacattacgtagctacaattttcaaaaatttaggatttaatactgacatattagactttaatcctagcttggaaaaacacgaattagaaaaacaaccaatgtatcaactctggcacctattatattcatatgaatcagataaaagtaggacggggaacgaaagtttactgaacaaattagaagcaaactttggcttcccacaagaatatgcatccgtactcgcagatgcgactttcgaagacgattacggcaatataagtgtaaaagccataagaaaaattcttccacacttacacgacggttacgattattcagaagcgtgtgaacgagccggatacaaccatagcgtacgtagtctaacgaaagaagaattagcccaaaaagtatataaagacagattagatcttttgcctaaaaactcactcagaaacccagtcgttgagaaaatcctaaaccagatgataaacgtaatcaacgctataattgtagaatatggaaagccagacgaaatcagaatcgaaatggcaagagaactaaaaagctcagcagcaaaaagagaagaaagaactaaatcaatcaaccaaaacgcagcggaaaacaaacgaatcacagaaatattacaaaccgagttcggcttgtcctatattagccgaaatgatattgtgaaatataaattatatcaagaattagaagctaatggattcaaaactctctactccaacacctatatccccaaagaaaaattattttcaaaggattttgacatcgaacacattgtaccaaaagcaagactattcgacgattcatttggtaataaaaccattgaggcaagagacgtaaatcttgcaaaatctaacaaaacagctttcgacttcgtgaaagaaaaatatggtgaacaagggattgaagaatataagaagaaactagacaccctactaaaagaaaatgctatcagttcaggaaaatataagaaattaatgatgtccgaagcagatataccatcagatttcattaatagagacctgcgaaacacccagtacatcgcgagaaaagcgtacgaaatattaggagagctagtaaaaaccatcacaccaactacaggaaaaataactgatcgtttaagagaagattggcaactgattgatgtaatgaaagaactgaacttcgaaaaatatgatagattaggactgacggaagtgatagaagacagggacggcagaaaaatcaaaagaataaaagactggacaaaaagaaatgatcacagacaccatgctatggacgcacttaccatagcctttacaaaaccatcctacattcaatacctaaataacctcaatgccagatcagacaaaagtggtagcatctacgcgatagaaactaaagaattacacagagaaaataacaccttacgattcaatgcaccaatgccattaaatgagttcagaaaggaagctaaacgacacctatcagcaatactcgtatccatcaaagccaaaaataaagtaatgacccaaaatgtaaataaaataaaaacaaagaacggcataataaagaaagtacaactaacacctagaggagcattacacaatgaaacaatatatggaacaaaaatgcgacctataataaaaatggttaaaatcggagcagcgttagatgaagcgacaattaataaagtcagtagcccaacaataagagaagcattactaaaacgtctaaacgaatacagtggagacgcaaagaaagcctttgctggtaaaaatgcgatcaccaaaaatcctatatacttaaatgcagaacatacaaaaacagcccccgccatggtcaaaatagtcgaatgggagatgtattatccaataaggaaactaatcactccagatctaaaaatcgaaaaagtaatagacaacggaataaaagaaattctaaagaaacgactaaaagagttcggaggagacgcaaagaaagcatttagcaatctcgacgaatgtcccatatatctagatgaagagaaaaatataacactaaaaagggtctcaatcgaaggagtgctatctgcaataccagtacacacactcaaaaaccacgcaggaaaagaaatcaaagacgaagacggtaaagccgtactaggcgactacgtccagacctcaaataaccaccatgtcgccatctatcaagacgcaaagggcaatctacaagacaatgtaataagtttctttgaagcagcagaaaggaaatctcagaacgtacccatagtagataaaaacctaaaccgcgacaaagggtggcacttcttatacacaatgaaacaaaacgaatacttcgtcttccctaatgaagaaacaggtttcgttcctagtgaaatcgacctaatggacgaaaacaactacgaaatgataagccctaaccttttcagagtccaaacaatgtcaagagtcgattatggaaagacaatcataagagaatatgtgttcaggaatcacctagaaactatattaaatgacaatctaaaactaaaagggctagtattcaagaaaattaaaagtctgaaggcattggaaggaatagtaaaagtcagagttaatgccataggaaaaatagttgcagttggagaatatgattga

SEQ ID NO: 5524 - RNA, 4143 nt, synthetic construct
  misc_feature 1..4143: note = Cas9 variant
  source 1..4143: mol_type = other RNA
atgaaaaagaaatatgcgataggaatcgatataggtacaaacagcgtaggctggagcgttgtaacagacgactataaagtcccatctaagaaaatgaaagtgttcggaaatacagagaaaagatacatcaagaaaaatctactaggcaccttactattcgacgaaggaaacacagcagaaaaccgacgattaaaacgaacagcaagaagaagatatacacgaaggagaaacagaatattatacttacaggaaatcttcgccgaagaaatcaataaaatagacgacagcttctttcaaagattggacgattcatttctcatagtggaagacaaacagggtagcaaacatccaatatttggcacactacaagaagaaaaagaataccataaacaatttcctactatatatcatcttcgaaaacaacttgcagactcatcacaaaaagcagacatacgactaatatatttagcattagctcatataattaaatatagaggacactttctatttgaaggagacttaaaatcggaaaataaagatgttcaacatttatttaacgacttcgtagaaatgtttgataaaaccgtcgaaggctcatacctatctgaaaacctccccaacgtagcagacgtactcgtagaaaaagtcagtaaaagtcgacacctcgaaaatatactgcattattttccaaacgaaaagaaaaatgggttatttggaaactttttagcgttagccttgggactacaaccaaacttcaaaaccaatttcgaattagcagaagacgcaaaaattcagttctcaaaagaaacatacgaagaagatttggaagaattactaggcaaaataggagatgactacgcagatttatttatagctacaaagtccctctatgatggcatactactggcgggaatactttcaacaacaaattcaacaactaaagcaccattaagctcaagcatggttaacagatacgaagaacaccaaaaagacctagctctactgaaaaacttcatacaccaaaacctaagcgatagctataaagaagtatttaacgataaattaaaagacggatatgcaggatatatagagggtaaaacaactcaagagaatttttacagattcattaagaaagcgatagagaaaatagacggttctaattatttcatcgagaaaatagaaagagaagattttctaagaaaacagagaacctttgataacggatcaatacctcaccaaattcatttaagagaaatgcaagcaatcataagaaggcaagcaaaattctatccctttttagaagaaaatcaggacaaaatcgagaaaattcttacattcagaatcccatactacgttggacctctagctagaggaaaatcagaatttgcatggctcaacaggaaatcggacgagaaaataagaccatggaacttcgatgaaatggttgataaagaaacatcagcggaaaacttcataacacgtatgacaaattacgaccaatacttgccagaccaaaaagtgctcccgaagcacagcctattatatgaaaaattcgcagtatacaatgaactaacaaaagtaagatatgtaacagaacaaggaaaatctttcttcttcgacgctaatatgaagcaggaaatctttgatagaacattcaaagtatataggaaggtaacaaaagaaaaattaatggatttcctttctaaagagttcgatgaatttagaatagtagatttactaggactcgacaaggacaataaatcatttaacgcatctttaggtacataccacgaccttaagaaaatagtttctgaagactttctggataattcagaaaatgaagatattttagaaaacgtagtgttaacactcacattattcgaagacagagaaatgatacggaaacgactcgagaaatataaagacgtattaaccgaggagcaaaggaagaaactggaacgtagacattatactggttggggacgactatcagcgaaactaatcaacggaatcagagataaagtgactcgaaaaacaatcctagactatcttatagatgacggaacatcaaatcgaaatttcatgcaactaattaacgatgatacccttagctttgttgacgaaatacgacttgctcagggatcgggaaaagctgaagactatcgggcagaagtccaaaatttggcaggctcaccggccattaagaaaggaatattacaatcactcaaaattgtagatgaattaattgaagtaatgggatatgacccagaacatatagtagtagaaatggcacgagaaaatcaattcacaaatcaaggaaggagaaatagccaacagcgttataagaaaatagaaaacgcaattaagaatctcgattcaaaccttaattcaaaaattctcaaggaatatcctactaataaccaagcactccaaaatgatagattattcttatactacctacaaaacggcaaggatatgtatactgatgaagaattagatattgaccaactgtcacagtatgatattgaccatataataccgcaagcatttataaaagatgatagcttagataacaaagtactaacaaaatcagctaaaaacagaggaaaatcagatgacgtaccatctcttgaaatagtatataagaagaaaaatttctggaaacaactattagactcacaattaatatcccagagaaaatttgacaatctaacaaaagcagaaagaggaggactaaccaatgaagacaaagcacgcttcatacaaagacaattagtagagactcgacaaattacaaaacacgtagctagaatattagataccagattcaataccaaactagacgaagcaggcaacagaataagagacccaaaagtaaacattatgacacttaaatcatccttggtatcacaatttcggaaagactaccaattgtacaaagttcgagaaataaacaactatcaccatgcacacgacgcttatctaaacgccgtagtagctacagccctattaaagaaatatccccaacttgcgccggaatttgtatacggtgactacccaaaatataactcatataaatccagaaaatcagcaaccgaaaaagtactcttctatagcaacattatgaacttctttaaaagagtccttgtatacagcaaaaccggcgaagttaggataagaccggtcatagaagtaaacaaagaaaccggcgagatagtatgggataaaaagagcgattttagaactgtaagaaaagtgttaagctacccacaagtaaatgttgtgaagaaaacagaagtacaaaaccacggattggatcgaggaaaacccaaaggattctataacgccaatctctcaccgaggccaaaagaaggtagtgtggaaaacctagtacccgcaaaacaatccttcgatacaaaaagatatgggggttatgccggcatatcaaattcatacgccgtcttagtaaacggtataatagaaaaaggaaagaagaaaagtaaagccgaagttaccgagttccagggaattagtatattagccagaaaagacttcgacaaaaatccaaaacaatatttactcaacctgggatacaaagatatcaaaagcatcattaaactgccgaaatacagcttattcgaattagaaaatggttcaagaaggatgttggctagtattttatcaacaaataacaaacgaggcgaaatacataaaggtaatgaaatgtacctaccagataaatttgtaactctcttataccatgccatgcgcgtaaacaggactttagaacctggacataagaaatatgtagaagcccacagacatgtattcgacgaattattaacatatatactagaatacaatgaaaagatcgtcggggccaaagcaaacggcaaacgaattgtagaagcatattcagcacgaaaagacacagacaacctcgaagaactctgtaattcatttataaacctattaaacttaactgccttaggctcagccgtcgatttcgagttcctaggtacaaaaatacctaggtatcgagactacactccctctagcctcctaaaagcaactttaatacatcaaagcgtaacagggttatatgaaactaggatagacctcagcaaactaggaggagattga

SEQ ID NO: 5525 - RNA, 4143 nt, synthetic construct
  misc_feature 1..4143: note = Cas9 variant
  source 1..4143: mol_type = other RNA
atgaaaaagatactgggtttggacttaggaacgacctctataggatgggctttagtatatgaaagcgagaatgcggacgagaaaagcagtatagtaaggctaggtgtaagagtaaacccacttagcgtagacgaaaaaggaaattttgaaaaaggaaaatcaatcacaactaatgcggacaggcaacaaacgcatggcgcaagaataaacctacaacgatataagttgagaagagaaaaccttaaagactgtctacaaaaacaaggttggataggaacagaagcactatacgaagaaggaaagacctcaacctttgaaacatatatgttacgagcaaaagccgctgaagaagaaataagtttacacgaactttgtagagtacttttcatgctcaataaaaagcgaggatacaaaagcaatcgaaaagcaaacaacaaagaagacggtaaactttttgacggaatgacagttgcaaagaaactttacgaagaacatctaaccccagcagaatactccttaaaactcctttcaagtggaaagaaattcaaacaggaatattatagatctgacctaaaagaggagttcgatcgcatatggaatgaacaacaaaaatattacccagaaatattgaccgacgatttcaaacaacaactacaaggtaaaagtaaaggaaacacctccaaaatattcctggggaaatatgggatctactcagccgacttaaaaggcttggatagaaaattacaaccgctaaaatggagagtagaggcactaaaacagaaagtagataaagaagtattagcattcgtaattagtgacttaaatggtcaaattgctagcacctcaggtttgcttggggctataagcgaccgctcaaaagaactctattttaataaacaaacagtaggccaatacctatggacatctctaaaagaatcaccgcacgtaagcattaaaaacaaaccattttatcgacaagattacctagatgagttcgagaaaatttgggaaacacaagcaacctaccataaggaattaacacctgaactaaaacaagaaatacgagacataataatattctaccagcgccctttaaaatctaagaaaggactaatatcagtatgtgaattggaacaaagaaaagtaaaagtaacaatagatggaaaagaaaaagaaatatcgataggacccaaagtagccccaaaatcaagccccatgtttcaagagttcaggatatggcaaaatctaaataatatcctgctcatagataaaggaaacaattcaaatagaccattatacgaagaagaaagaaatctattatatgaagaactaagcgtaaaagaaaaactgtcaaaggcagaagcactaaaagtactaaataaaaatggcaaacaatgggatctaaactataaagaaatcgaaggaaacagaacccaagcggtactatatgactgctataatcgtattatcggaatgactggccatgaagaatgcaacttcaaaaagttaaaagcctcagatattagatacaacgttaaaacaatcttcaaaaacttaggattttcaacagatatacttgactttgacagtagtctacaaggtcatgaactcgaaagacaaccatcctatcaattatggcacttattatacagctacgaatctgacaatagcagaaccggaaatgatgcactactgcgtaaactggaaacagctttttcgatcccaaaagaatatgcggcagtattatccgacgtagtatttgaagactcatacggaaatttaagcgttaaagcaatgagaaacatattacctcatcttcaagcgggtttggattacagtcaagcgtgcgaaaaggcaggatataaacactcaagaagatcacttacaaagaatgaattagacaagaaagagtacaaagaaaaactagaacttttgccaaaatcatctctacacaatccagtagtcgagaaaatattaaaccaaatgataaatgtcataaacgcagtaatagacgaatatggaaaacctgacgaaattagaatagaattagctagagaacttaaaatcggagccgcagagcgcgaaaatatgacaagaagtatcaaccagggtaacgccgaaaacaaacgcatcagagaaatcttggaaaaagaatttgcactatcatatataagtagaaacgacataataaaatacaagctatatgaggaactaaaatcaaatggatttaaaacattatatagtgatacttacatcagcaaagataaacttttcagtaaagactttgacatagaacatataataccaaaagcaaggttattcgatgacagtctaagcaacaaaaccatcgaggctcgcgacgtaaacatagcaaaatcgaacaaaacagcatttgactttatctcagaaaaatacgaccaacaaggaatagaagcgtataaaaagaaactggacattttattacaggatggcagtatctccaaagcaaaatataatagacttttaatgaaagaagctgatataccaagtgggttcatagacagagatttgcgtgatactcaatacatcgcgaagaaagcatatgaaatactatccgatcttgtccgcaatgttacaccaacaacaggggcggtaacatcacgactaagggaagactggcaattagtcgacgttatgaaagaattaaactttgaaaaataccaaaaactaggactggtagaagtaatagaagacagagacggtcgcaaaattaaaaggataaaagactggacaaaaagaaacgatcacagacatcacgccatggatgccttaaccatagcatttacaaaaccgtcatacatccagtacctcaacaaccttaatgcaaggtcagataaaaacagtagcatctatggaatagagaataaagaactccatagagaagacaataaattaagatttaacgccccattacccattaacgaatttcgcgcagaagcccgccgtcacctcaaatcaatcttagtaagcgtgaaggcgaaaaacaaagtaatgacacaaaacgtaaacgttatcaaaaccaaacacggtgtaataaagaaagttcagctaacaccaagaggggaactacataatgccacattctatggtacaaagaaaagaccgatcataaaaatggttaaagtcggtgccgccttagacgaagttacaatcaagaaagtatcaagctcctttataagagaagcactcctcgaccggctccatgaatacaatggagatgccaaaaaggctttcactggaagaaattcaatagacaaaaatccaatatacatcgatgaggaacataagaaaaccgtacctgctctcgtaaaaacgatagaatgggagatgtaccaccctacccgaaaaatgattagcccagacctaaaaatagacaaagttatagataaaggtatacgggagatacttcgaacgcgtctggccaaattcaacggggacgcacaaaaagcattttctaatctagacgaaaacccaatatataaagacgaagctaagaaaataacattaaaaagggtaagcctagaaggagtaagttcagttatcccgttgcacaagttaaaagacatgggagggaaacctgttgtaggcaaagacggtaagccagtatggggtgattacgtacaaacatcaaataaccaccacatcgctttctacatggatgaaaacggcaatctacaagacgatgtagttacattctttaaggcagctcgacgtaaaagccaaggtgtacccgtgatcgataaaaactataatcacgacaaaggttggcattttcttttcacaatgaaacaaaatgaatatttcgtttttccaaacgaagccactggttttatcccgactgaagtagacttaatggatgaagcaaattatgacatgatcagcccaaatctatacagagttcagaaaatgtctaaaacaaaacaaggaataaccgataaacgagactactggtttcgacaccacctagaaacagtacttaacaacgacttaaaagtaagaaattcaatattcaaacaaataaactcactaaaaccattagaaggcatagttaaagtaagaataaatgccataggaaaaatcgttgccataggagaatatgattga

SEQ ID NO: 5526 - RNA, 4143 nt, synthetic construct
  misc_feature 1..4143: note = Cas9 variant
  source 1..4143: mol_type = other RNA
atgaaaagaatactagggctagatcttggaacaacaagcatcggatgggcgcttgtaaatgaagctgaatccaacaatgaagcatcaagcatcgtacgattaggcgtacgcgtaaacccattaacagtagatgagaaatcaaatttcgaaaaaggtaaagccattaccacaaacgccgatagacaattgaggcatggagcaagaataaatcttcaaagatataaattaagacgccaaaacttacacgattgtttacagaaacaaggatggttgggtacagaagcaatgtacgaggaaggtaaagcatcaacatttgagacatacaaattgcgagctaaagctgcggaagaagaaatctcactacatgaatttgctagggtactatttatgttaaacaagaaaagaggttataaaagcaacagaaaagcgaacaacaaagaagatggtcaactgttcgacggaatgaccatagctaagaaattatacgaggaacacctaactccagcggaatattccttacaacttttaaataaaggcaagaaattcacacaaggctactatcgttcagatcttaacgcagagctcgaaagaatatgggacgaacaaaagaaatactacccagagatactcactgatgaatttaaacaacaattagagggaaagaccaaaactaacacctcaaaaatattcctagctaaatatggaatatactcagcagacttgaaaggactagaccggaagctacagccgcttaaatggagagtagaggcccttaaacaacaagtggacaaagaagtcctcgctttcgtaataagtgatttaaaaggtcaaattgcaaacacatcaggcttattaggagcgatatcagatagaagtaaagaactatatttcaacaaacaaacagtaggtcagtatctttgggcatcattagaagaaaaccctcacatctcaattaaaaataaaccattttataggcaagactatcttgatgaatttgagaaaatatgggaaacccaagcaacatttcacaaacaactcacacctgaactaaaacaagaaatacgggatataataatcttttatcaaagaccacttaaatcaaagaaatcattaatatccgtatgtgaattagaacagagaaaagttaaagcaaccattgatggcaaagaaaaagaaataactatcggtccaaaagtagcaccaaaaagctccccggtttttcaagaatttcgtatatggcaaaacctaaataatgtactattaatagataacgatacaaacgaaaaacgcccactagatgaagatgagcgctatctactctacaaagaactaagtatcaaagcaaaattatctaaaacagaagcactaaaaatattaaacaagaaaggcaaacaatgggatctcaattacaaggaattggaaggaaaccgaacccaagcaatattatttgattgctacaacagaattataacattaactggtcacgaagaatgcgactttaagaaaataaaagcaagcgaaatacgtcattacgtaagtacaatatttaaaaatctagggttcagtactgaaatactcgatttcgatccatcactcgagaaacacgaactagaaaaacaaccaatgtaccaactttggcatttattatacagttacgaaagcgataactccagaacaggaaatgaaagtctcctacgaaaattagaaaccacatttggcttccctgaagaatacgcgacagtattgtgcgacgtagtattcgaagaggactatggtaatctatcagttaaagctatgcgcaagatattaccctatctccaagcaggtaacgattattcacaagcatgtgcgtatgccggatataatcattcaagacattcactgacaaaggaagagttagatcaaaaagtatataaagaacggttggaactcttgcctaagaactctctaagaaatcctgtagtagagaaaattctcaatcagatgatcaatgtaataaacgccataatagatgaatacggaaagccagacgaaataagaatagaaatggcaagggaacttaaaagctcagcagcagatagaaagaaaacaacacacgcaattaatcaaggcaatgatgaaaaccaatgcataagagaaatattagaaaaagagttcgccttaagctatatatcccgaaatgatatcattaaatacaaactatacgaagaactaaaaccaaacggatttaaaacactgtactcagacacatatatcccaaaagataaattattttccaaggattttgatatagaacacataattccaaaagcaagactattcgatgattcatacagcaataaaactctagaagcacgagacatcaatcttgcaaagtcgaataaaactgcattcgacttcgtcaaggaaaaatacggagaacaaggtgctgaagcatacaaaaagaaattagatatgctccttggcaataatgtaataagcaaaccaaaatacaacaaactactcatgacagaagcggatattccaagtgattttatcaatagagatctgcgaaacacgcaatatatagcccgaaaagcatgtgaaatattaggagagctagttagaacagtcactcccacgactggaaagatcacaaatcgattaagggaagactggcaattagtagacgtgatgaaagaactaaattttgaaaaatacgaaaagctaggcttgaccgaaatagttgaagaccgcgacgggagaaaaataaaaagaataaaagattggactaaaagaaacgatcatcggcatcatgctatggacgccctcgccatcgccttcactaaaccaagctatatacagtacttaaacaatctcaatgcaagatcaaataaaggagacagtatatacgcaatagaaaataaagaattacattatgaggaaggcaaattaagatttaatgctcctatccccgtaaacgtgtttcgagcagaagccaaaaggcatctaagcgccattctagtctcaatcaaagccaaaaacaaagtaatgacacaaaacgtaaacaaaataaaaacaaaacatgggataataaagaaaattcaactaacaccccgtggaccacttcacaacgaaacaatatatggcacaaaaatgcgccccataataaagaaagtaaaagtaggagcagcacttgacgaagcaacaataaataaagtatcaagtccagcaattagggaagtactactaaaaagattaaatgaatactccggaaacgcaaagaaagcattcacaggtaaaaacacactagataaaaaccccatatatcttaacgcagaaagaacaaaaacagtgcccgccagcgtaaaaaccgtagaatgggaaaattaccaccctatccgcaaaccgataacacctgatttaaaagtagataaagttatcgataaaggtataggagaaattctaaaagcccgattagaagaatttaacggtgacgccaaaaaggcatttagcaatttagaagaaaatccaatatacttagatcaaacaaagaaaatcgcattgaaacgggtgtcaattgagggagttttatcaacaattcccctacacacattaaagaatcaagcaggtaaacctatcatggggaaagatggaaaaccagtactaggaaattacgtacaaacatctaacaatcaccacattgcattttactatgacgaagatggaaaccttcaagataacgcggtatcattctttgaagcagccgagcgaaaatcccaaggaatttccgttatagataaagactataaccgcgacaaaggctggagatttttattcactatgaaacagaacgaatacttcgtattcccaaatgaggcaactggttttataccttccgaagtcgatttaactgatgaagcaaattatggaataattagtccaaatttatatcgtgtacagaaaatgtcgagaattgaaaaagggacgtccgtatcaagagactactggtttagacaccacttagaaacaatattgaatgacgactctagactgaaaaatagtgctttcaaaagaataaactcgctaaaaccactagaagggatcataaaagtcaggataaactcaattggtaaaatagtcgcagtaggcgaatacgactga

SEQ ID NO: 5527 - RNA, 4143 nt, synthetic construct
  misc_feature 1..4143: note = Cas9 variant
  source 1..4143: mol_type = other RNA
atgaagaaaggatactcaataggattagatataggtacaaactcagttggattcgcagtgattacagatgactataaagtcccatcaaagaaaatgaaagttctaggaaacacagataaaagattcataaagaaaaacctaattggagcactgttatttgacgaaggtacaacagcagaagcaagaagacttaaaagaacggctcggagaaggtacacaagaaggaaaaacagactgagatacttacaggagatattcagtgaagaaatgagcaaagtggactcctcattctttcatagactagacgattctttcctcattccagaagataaacgagagtcaaaatacccaatatttgcaacactagaagaagaaaaagaatatcacaagaaatttccgacaatctatcatctcagaaaacatcttgcagattctaaagaaaaagcggacctccgtcttatatacctcgcattagctcacatgatcaaataccgtggacattttctatatgaggatacattcgacattaaaaacaacgatatacagaaaatattcaatgaatttatatcaatttatgataacgcatttgaaggatcctccttatctggacaaaacgcacaagtagaagcaatattcactgataaaatatcaaaaagtgccaaaagagaaagagtacttaaactttttcccgatgaaaaatcaacagggctattctctgagttcttaaaactcattgtcggcaaccaagctgacttcaagaaacattttgacctagaagacaaagcacctctacaattttcaaaagatacttatgatgaagacttagaaaacctacttggacaaatcggtgatgactttgctgacctattcgtagcagcaaagaaactatatgacgccatcttactttcaggaatattaacggtaacagacccatcaacaaaagctccactatcggcatcaatgatagaaagatacgagaatcaccaaaatgatcttgtagtgctcaaacaattcatcaaaaacaacctcccagaaaattatgtcgaggtattttcagacgatagcaaaaatggctacgcaggctatgtcggtgttgattctaaaataagaaaacgcaacgcgaaactagcaaccgaagaggagttctataaatacctcaaaaacatactaaacaatgtaaaaggcgcagattattttctagataaaatcgaacgcgaagactttctacggaaacaaagaacttttgacaatggctcgattccacaccaaatacaccttcaagaaatgaacgcaattttaagaagacaaggcgaacactaccccttcctgaaagaaaatagagagaaaatcgagaaaatactaacctttagaataccatactatgtcggtcctctagcacgtggaaatagagattttgcttggctaaccagaaactccgaccaagcaatacgaccttggaactttgaagaaatcgtcgataaagcaagcagcgctgaagacttcatcaataaaatgacaaattatgacctatatttacctgaagaaaaagtactccctaaacatagtctactttatgaaaagttcgcagtatataatgagctgaccaaggttaaattcatcgcagaaggtctgcgagactatcaattcctcgacagcggccagaagaaacaaatagtaaaccagttattcaaagagaaaagaaaagtgactgaaaaagatataatacattatctacatacagtagatggatacgatggaatcgaacttaaaggcattgaaaaacaatttaatgccagtctatcaacataccatgacctgctcaaaataataaaggacaaagagttcatggacgatcctaaaaacgaagaaattcttgaaaatatcgtacatacattaaccatatttgaagatcgtgaaatgatcaaacaaagactagctcaatatgacagcttatttgacgaaaaagttataaaatctttaacaagaagacactatacaggatggggtaaactctcagcaatgcttatcaacggaatacgagataaacaaaccggtaaaaccatactcgactatctaattgatgatgcttattacaatcgaaatttcatgcaactaatcaacgacgatggactatcattcaaagaaataatacagaaagcccaagtcgtaggcaaaaccgatgatgtcaaacaagtggtccaagaacttcctggatccccagcgatcaagaaaggtattctccaatcaattaaaatcgttgacgaacttgtaaaaataatgcgacataaccccgaaagcatagttattgaaatggcaagagaaaaccaaactacagcaagaggaaagaaaaactcacaacaacgatacaaaagaatagaagacgcactgaaaaacctagcaccaggattggactcaaatatacttaaagaacatccaactgataacgtacaactccaaaacgacagacttttcctatattatctccaaaatggcaaagatatgtacaccggcgaagccctagacataaatcaattatcatcatatgatattgatcacataatacctcaagcctttataaaagatgattcgtttgataacagagtactaacttcatcaaaagataacagaggaaaaagcgacaacgtaccctctatcgaagttgtacaaaaacgaaaagccttctggcaacagttactagactcaaaattaatatcagaacggaagttcaataacctcacaaaagctgaaagagggggtttagatgaaagggacaaggttggcttcataaaaagacagctagtagagacacggcaaataaccaaacacgtagctcaaatactagatgcacgatataacactgaagttaatgaaaaagacaagaaaaatcgcacagttaaaatcataacattaaaatcaaacttggtatcaaatttcagaaaagaatttagactatacaaagtcagagaaattaatgactatcatcacgcacatgacgcctacttaaatgccgtggtcgcaaaagcaattctaaagaaataccccaaactagaacctgagttcgtctacggagaataccaaaaatatgacttaaaaagatatatatcacgctcaaaagaccccaaagaagtagaaaaagctactgaaaaatacttcttttatagtaacttactaaactttttcaaagaagaagtgcactatgctgacggcacaatagtaaaacgcgaaaatatagaatactcaaaagacacaggagaaattgcctggaacaaagaaaaagactttgctataattaaaaaggttcttagtctgccccaagtaaacatagttaagaaacgagaagtacagacaggtggtttttcaaaagaatcgatactccccaaaggaaactccgataaattaatcccacgaaaaacaaaagacatactctgggatacaacaaagtatggcggattcgactccccagttatagcttatagcatactcctaatcgccgatatagaaaaaggaaaagcaaagaaactaaaaaccgtaaaaacccttgtcggaataacaataatggaaaaagccgcatttgaagataacccaattactttccttgaaaacaaaggatatcacaatgtccggaaagaaaatatattatgcctaccaaaatactctttatttgaactcgagaacggaagaagaagactactagcaagtgccaaagaactacaaaaaggcaacgaaattgttttacccgtatacttaaccacacttctataccattcgaaaaacgtacataaattagatgagcccggacacttagaatacatacaaaaacacagaaatgagttcaaagatctattaaaccttgtatcagagttctcacaaaaatatgtactagccgatgcaaacctagaaaagataaaaagtctctacgcagacaacgaacaagccgatatagaaatattagccaactcttttattaacttactaaccttcactgctttaggagctccagctgcattcaaattctttgggaaagacatagacagaaaaagatatactactgtatccgagatcctcaacgcaactttaatacaccaatctataactggcttatatgaaactagaattgatctaagcaaactcggagaggattga

SEQ ID NO: 5528 - RNA, 4143 nt, synthetic construct
  misc_feature 1..4143: note = Cas9 variant
  source 1..4143: mol_type = other RNA
atgaatctaaggcatgtagggaattataatattggcttagatatgggaacagcaagtgtaggctgggcagcaatagacgaacaaggtgagttattgcactttaagggaaaaccaacttggggctcgcgactattcgactcagccaacacagcagcaacagctagaatgccaagaggccaacgaagacgatacattagacgaaggtggcgcctagatctactacaaaaattctttagtgaagaaatggcagaaaaagaccctgagttctttattagactcaggcaatcatccctctggccagaagatcgcgaaggaggacatactgcataccactggcctttattcaacgacagtgattttaatgaaaaagaatattatgaaaagttcccgacgattttccatttaagacaatggctcatggaaacagacgaaaaagccgatattcgacttatttacctcgccttccacaatattgttaaacaccgtggcaacttcctacaagaaaacaatgatagtctaagcgcacaaaacgctaacatgcgggagagcttagaatcattttgcatagctctagaagaatggtgcgatgaaaaagaactcacatgcagctgtgaccctcaaaaattggaacacttatttaaagaagtaaaatatagaagtgacataagagacggatttgctgctttattaggcctagcatgtagtggtgaaaatgaagtagacgtaaaagcaatggctaaagaaatgggaaaggcaatagtaggatacaaagctgacttctcaaaaatatttacagaatgtgataaagaaggaagctcgttccggttatctgatgatgaaggaccggaagcctttttagacatatgcccagacgatggaatcgcactattcgaagcaatacaaatggtctattcctcttttatattaaccggaatgttaacagaaaaaggcctgagcctatcgaaaatatctgcgtataatcagtatggtcaagacttagaaagtttaaaagcgttagtaaaagaatatgtaccaaacgaatattctagtttcttccgaggaccgacatatagcggaagtacagaatatgatcctagtaaagctcaaggttatactagatataatttaggacccagtaaaaaggggagtggcgctaaaccaatggcatatgaagattttaagaaatcagttgaacaactatttgcaaatacaaacgccataaatgacgaaagatacaaagagatgatgggaagatttgctgaggaaaaatttctacggagactccgcacgtccgataacggacgaataccatttcaattgaatttagaagaaatgacagcaatcataattaaccagggtaaatattacccattcctccttgagcaacaagagaaactcgagtcacttgttcgttttaggataccctactacgttggaccactaacccgcataaatgcacgactagattcaaaaggaaacgcttgctttgcatggagtaaaagaaaagacggcatggatagtgcaagcataaaaccatggaattgggatgaagtaattgacaaacacgcatcggcacaagcattcattgaaagaatgacaggaacatgtacgtatttaagaggggagccagtcttaccaagatgttcgctattatatgaagaatattgtgttctaaatgagctcaatggagcaagatggactcaggatggtgataaattcatacgatttgattacaaagatcggtcggacataatcgaagaactttttaagaaaagaagaggaaggattcaatacgcagcagttgccgattggatgaaacaagaacgttcacatgctaacgtgcacgtctcgggaggccaaggagaaaatgcttttgaatctaggttatcttcttaccatttcttttgtaacgatgtctttggagtggatgaactaccaggatcctacgtagatatggttgaagaaataatattatggtctacattgtttgaagatagaagtatactaagggaagaaatacaaaggaaatatggagacgtattaaacgaagaacaaattaaaacaatttgtaagaaaagattttcaggatggggccgcctaagtagaaaattgttatgtagtctaaaagcacaaaccgacaatggtccaaaatctataatggatatactacaagaaggagatcaaaataacggcagagtaggcagagcaatggtatttcaggaaatactccacgatgaacaattaggttttgaacagaaaatagaagaagaaaatacacaaagtatgttagaaggagaaaacctgctaatagaagatttaccaggttcaccggcaataagaagatctataaatcaggccgtcaggatagtagacgaaatagtggggattgctgggcacgcaccagataatatattcatcgaagttacacgagaagacgatactaaaaagaaaggaaaaagaacaacgaccagatatagtaatatacaaaaagcactagaagcattaaaagaagaaggcgctgaggctttacgggaactaaagacgtataaacacaacgaactggacaaaagattatccctatactttatgcaaaatgggaaatccctttatagcggcattccgctagacatcagaaggctaagtgaatatcaaatagatcatatcataccccaatcatacattaaagacgattcatacgaaaatatggctttagtactccctggtgaaaaccaatcaaaagcagataacttactaatctcccaagatatccgtattaaaatgaaggcaacctggacagcgctccacaaggcgggactgatgggagacaagaaatacaataatctaatgaacagttcaatctcagatgcaaagatgaaaggattcattaaccgtcaactcgtcgaaacttcacaatcagtaaagctaacgcagatgatgttatcacaaaaatatccaggagcaaaagtacggcccataaaagctagcataagttcgcagctaagagacgcttgtgacttagtaaagtgcagagaagctaatgactatcatcatgcacacgatgcatatctcgcttgccaggtgggacgttttgtattaaaacgacactctagcatgttcgataatcccataggtatgaccaaagtaattagagatttcgtgaaacgacaagggcaagagttcaaacggaacgggaaattaccagcatacgcatctaggtcagggttcatagtacaatcttttatgcggtccggattcgatgcagaaacaggggaactgttaagagacgactggaatgcaccttttgaaatagcaagaatcaaaagatgtctaaactatagagactgctatatttcacgaatgccaatggaagattcaggagcattctgggacgcaacaatatactctcctaaggcaggcaagaaaggggccttaccagttaaacaaggattaccagttgaaaagtatggaagctacagcagagaacaatttgcatacttctttgtatacaaggcatacaatccgaaaaagaaagcatacagacttgaatttgaagcagtgccagtaagagtagcaagtgccgtggaaacaagagaaaatgcactagaagaatatgctaaatcagtggcaaagcaagcaggtctggagttcgtagaagtagcacgaccaaaagtttataaatatcaattaattgaattaggcgaagatagattgtacattactggaaaacgagaagtccgaaacgcaagtcaacttgcattcagtctagacgaaatagatttactaaaaaggctcgctgaaggagaagaaactagctccgaagaaagagaacgattgtttgatgtattaattgaaaaatacgcaagatacgccccaagactagcacgacaactatcagtagatagcatgtccgctacattcgaaacccttaacgcagaagaacaattgggaatcttattatcattagtggagattgctaatggaaaaagaaatatgatagatttaagcagcgcaggaggatccaaaaacgcaggctgcatgaacccaactttcagttcagaactaagttcaccaggaagtaattttactttcatcgaccaatcagtaacaggaatgttcgaacgccgtcaaagactagaactgtga

SEQ ID NO: 5529 - RNA, 4146 nt, synthetic construct
  misc_feature 1..4146: note = Cas9 variant
  source 1..4146: mol_type = other RNA
atggtcaaaaagaaatacgcaataggaatagacataggcacaaactcagtaggatggtcaatagtaacagatgattacaaagtacctagtaagaaaatgaaagttttcggaaatacagagaaaagatacattaagaaaaacctactaggaacacttctctttgatgaaggcaacaccgctgaaaacagaagactaaaacgaactgccagacgtagatatacaagaagacgcaataggatattatatctgcaagaaatatttgcggaagaaatcaataaaattgacgatagcttctttcaacgacttgacgacagctttttaatagtagaagataaacaaggctcaaaacacccaatatttggcacacttcaagaagaaaaagagtaccacaaacaattcccaacaatttatcacctaaggaaacaactagctgactcttcacaaaaagctgatataagacttatatacctggcattagcacacatcataaaatatagagggcactttttattcgaaggagatctcaaatccgaaaataaagacgttcaacacttatttaacgatttcgttgaaatgttcgataaaacagttgaaggatcttatttaagcgaaaacttaccaaacgtagccgatgttctagtagaaaaagttagcaaaagcaggagactagaaaacatcctacactatttcccaaacgagaagaaaaatggtttattcggtaactttctagctcttgcgctaggattacaaccaaattttaaaacaaactttgaactagctgaagacgccaaaattcaatttagtaaagaaacatacgaagaagaccttgaagaattattaggcaaaataggtgatgattatgcagatttattcatagcaacaaaatcattatatgacggcattttactggcagggatactaagcacaaccgatagtacaaccaaagcaccactcagctcatcaatggtgaatagatacgaagaacaccagaaagatctagcccttcttaaaaatttcatacatcaaaatctatcagacagttacaaagaagtttttaacgataaattaaaagacggatatgctggttatatagaaggcaaaactacccaagaaaatttctatagatttatcaagaaagcaatagagaaaatagaaggaagtaattacttcattgacaaaatcgacagagaagactttttacgaaagcaaagaactttcgataatggctccatacctcatcaaatacatctacaagaaatgcacgccataatacgacgacaggcggaattttatccgtttttggtagaaaatcaagacaagatagagaaaatattaacatttcgaatcccttactatgtcggaccactagctagaggaaaaagcgaatttgcttggctaaacagaaaatcagatgagaaaattcgaccatggaattttgacgaaatggtagacaaagaaacaagcgcagaaaacttcatcaccagaatgacaaactatgataggtatttacctgaccaaaaagtgcttccaaaacacagtcttttatatgaaaaattcgcagtatataacgaattaacaaaagtaaaatttatagcggaaggaatgcgcgactaccaattcttggattcaggacaaaagaaagacattgtaaaaaccttattcaaaacaaaaagaaaagtcacagctaaagatatcaaagcatacctagaaaatagtaacgggtacgccggtgtggaattaaaaggattagaagaacaatttaacgcgagtctaccaacctatcacgatttattaaaaatcttgagagacaaagcattcatagacgcagaagaaaaccaagaaatactcgaagacatagtactaacactaacactatttgaagaccgagaaatgataagaaaaaggttagaaaaatacaaagatatcttaacagaagaacaacgcaagaaactagaaaggagacactataccggatggggcagactaagcgccaaattaataaacggcattctagacaaagtgactcgaaaaactatattaggatacttgatagatgatggaacctccaatagaaatttcatgcaacttattaacgatgatacattatcattcgttgatgaaataagattagcacaaggatcaggagaagcagaagactaccgtgctgaggttcaaaacttagcaggctccccagcaataaagaaaggcatactacaatcactaaaaatagttgatgagttaatcgaagtcatgggatatgaacccgaacacatagtggtagaaatggcaagagaaaatcaatttacaaatcaaggacgacgaaatagtcaacaaagaattaatagattagagaacgcactcaaagactttgggtccaaaatactagaagaacaaaaaccttacggagtaagcaaagtaaataatatacatcttcaatcagatagactctttctatactacttacaaaacggaaaagatatgtatactgacgaagaactagacatagatcacctctctgaatatgacatcgaccacattatcccacaggctttcattaaagacgattcactcgataataaagtattaactaagtccgcgaagaacaggggtaaatcggacgatgtacccagtatggaaatcgtacataaccggaaaaatttctggagacaactcctaaaatctaaattgataagccaaagaaaatttgataacttaaccaaagctgaaaggggaggcctaactaacgaggacaaagctagattcatccaacgtcaattagttgaaactcgacaaattacgaagcatgtagcaagaatgttggacacaagattcaatacaaaattagacgaagcaggtaacagaatccgcgacccaaaagtaaatatcataaccctaaagtctaaccttgtaagccaatttcgaaaagattatcaactatacaaaatccgagaaatcaacaactatcaccatgcccacgacgcatatataaacgcagtagtagctacagccttactaaagaaatatccccaactagctccggagttcgtatacggggaatacccaacatacaactcatacaattcaagaaaaagtgcaactgaaaaagttctcttctactcaaatattatgaactttttcaaaagaatagtggtacattcaaaaaccggagaagttcgtattcgaccagtaatcgaagtgaacaaagaaaccggcgaaatagtatgggacaaaaagtcagatttccgcactgtaagaaaagttcttagctatccacaagtaaatgtcgtcaagaaaactgaagtccagaatcacggattagaccgtggaaaaccaaaaggtttctacaacgcgaacctaagcccaagaccgaaagaaggatcagtagaaaatctagtcccagccaaacagagtttcgatacaaaacgatatggtgggtatgcaggcatatcaaacagctacgcagtcttagtgaacggtattatcgaaaaaggcaagaagaaatcaaaagcggaagtaaccgagttccagggaatttctatcctggcccgcaaagacttcgataaaaacccaaaacaatacctactcaacttaggttataaagatataaaaagtataataaaactcccaaaatactcgttattcgaattagaaaatggaagccgaagaatgttggcaagtatacttagtacaaacaataaaagaggagaaattcataagggtaacgaaatgtatctgcctgataaattcgtaaccttgctatatcacgccatgagagttaacaggacgttagaaccgggccataagaaatatgtggaaacacacagacatgttttcgacgaactactgatctatatcttggaatataacgagaaaatcgtaggagcaaaagcaaacgggaaaagaatcgtggaagcatattcggcacgcaaagacacagacaatctcgaagaactctgcaatagttttataaatctattaaatctaaccgcattaggaagcgccgtcgattttgaatttttaggcacaaaaataccccgatacagagattatacaccgagtagcctattaaaagcaacacttatccatcaatcagtaacaggactatatgaaacaagaatagatctgagcaaattgggtggcgactga

SEQ ID NO: 5530 - RNA, 4146 nt, synthetic construct
  misc_feature 1..4146: note = Cas9 variant
  source 1..4146: mol_type = other RNA
atgaattatgtaaaggaatatcatataggactagatataggaacctcatcaataggatgggcagttaccgattcacaattcaaattgatgagaattaaaggaaaaaccgcaattggcgtacgactatttgaagaaggaaagacagcagcagaaagaaggacatttagaacaacaagacgcaggctcaaaagaagaaaatggagactccattatttagatgaaatcttcgcaccccatctgcaagaggtagatgaaaatttcttacgtagattaaaacaatctaatatacatccagaagatccagcaaagaatcaagcctttatcggaaaacttttatttccagaccttttaaagaaaaatgaacgtggctatccgactctgattaaaatgcgagatgaactaccagtcgaacaacgagcacattacccagtgacaaacatatataaacttagggaagcgatgataaatgaagatagacaatttgatctaagggaagtatacttagctgttcaccatatagttaaatatagaggtcatttcttaaacaatgctagcgtagataagtttaaagtagggaggatagattttgataagtcttttaatgtcctcaatgaagcgtatgaagaactacaaaacggcgagggatcattcacaatcgaaccgagtaaagtagaaaagataggccaattattactagacactaaaatgagaaaactcgaccgacaaaaggcagtagcaaaattcctggaggtgaaagtagctgataaagaggaaacaaaaagaaacaaacaaattgccacagcaatatccaaacttgtcttaggttataaggctgatttcgcaacagtagctatggctaatggtaatgaatggaaaatagacttgagctcagaaacatcagaggatgaaatcgaaaagttcagagaagaattgagtgatgcccaaaacgatatcctaactgaaataacatcattattcagccaaatcatgctaaacgaaatcgtccccaacggtatgtcaatatcagagtcaatgatggatagatattggacacatgaacggcaattagcggaggtaaaagaatacctcgcaacccaaccagcctccgcccgaaaagagttcgatcaagtctataataagtatataggccaagcgcccaaagaaaaaggctttgatctagaaaagggacttaagaaaatcctcagcaagaaagaaaactggaaagaaattgatgaattattaaaagcgggggatttcttgccaaaacaaagaacctccgccaatgtagtaataccccaccaaatgcaccaacaagaacttgatcgcataatagaaaaacaagcaaaatactatccgtggttagctacggaaaacccagcaacaggagaaagagatcgtcatcaggccaaatatgaattagatcagctagtcagtttcagaataccgtattatgttggacccctagtaacaccagaagtccaaaaagctacttcaggagcaaaatttgcatgggctaaacgaaaagaagatggagaaattacaccatggaatctatgggataaaatcgatcgagccgaatctgcagaggcttttattaaaagaatgacagtaaaagatacatatctccttaatgaagatgtgcttcctgctaactcgcttctatatcaaaagtacaatgtattgaacgaacttaacaatgtaagagtgaatggaagaagactatcagttggaataaagcaagatatttactcagaactcttcaaaaagaagaaaacagtaaaagcaagtgatgtagccagcttagtcatggcaaaaacgcgaggcgtaaacaaaccatctgttgaaggtctctctgacccaaagaaatttaacagtaatctcgcaacatatcttgatcttaaatcaatagtaggagataaagtcgatgataattgttaccaaacagacctcgaaaatataattgaatggcgttcagtgttcgaagatggagaaatatttgccgacaaactaacagaagtagaatggctcacagatgaacagagatcagctctagttaagaaaagatacaaaggttggggaagactaagtaagaaattattaaccggcatcgtcgatgaaaacggtcagagaataatagacctaatgtggaacacagatcaaaacttcatgcaaattgtaaatcaaccagtattcaaagaacagattgatcaactcaaccaaaacgctattaccaatgacggaatgacactcagagaacgagtcgaatctgtattagatgatgcatacacaagtccacaaaacaagaaagcaatctggcaagtagtcagagttgttgaagacatagtaaaagccgtcggaaatgcaccgaaatcaatatcgatagagtttgccagaaatgaaggaaataaaggagaaatcacacgctctaggcggactcaactacaaaaattatttgaagatcaagcacatgaattagtaaaagatacaagtctcacagaagaactagaaaaagcgttggacttgtctgatcgatattatttatatttcactcaaggcggaaaagatatgtatacaggtgacccgataaattttgacgaaataagtacaaaatatgacatagatcatatattaccacaatcttttgtaaaagacgatagcctagataatagagtattagtttcgagagcagaaaataataagaaaagcgatagagtacccgcgaaactctatgccgcaaaaatgaaaccatattggaatcaactactaaaacaaggattaatcacacaacgaaaatttgaaaatttaactatggatgtagatcaaaatatcaaatatagatcattagggtttgtcaaaagacagttagttgaaactcgacaagtcatcaaactcactgcgaatattttaggttctatgtatcaagaggcaggcacagatattatagaaaccagagcaggacttacgaaacaactgcgagaagagttcgaccttccaaaagtccgtgaagtaaacgactaccaccatgctgttgacgcatatttaacaaccttcgcaggacaatatcttaatagaagataccctaaactaagaagtttcttcgtgtatggtgaatacatgaaatttaaaaggggttcagatttaaaattaagaaattttaatttctttcatgaacttatggaaggagataaatcacaaggaaaagtagtagatcaacaaacaggagaacttataacgacgagagatgaagtagccaaatctttcgatagacttttaaatatgaaatatatgttagtcagcaaagaagtacacgataggtccgatcaattatatggagcaacaatcgtcacagcaaaagaatcaggaaagttaacaagtccgatagaaatcaagaaaaaccgaccagtcgacctttacggtgcatatactaacggaacttcggcattcatgacaataattaaattcactggtaacaaacccaaatataaagttataggtgtaccaacaacatcagcagtcggattaaaaagagtaggaaaaccgggctcagaatcatacaaccaagaattacacagaattataaaatcaaatcctaaggtcaagaaagatttcgaaatagtggtaccgcatgtgtcttactcacaactaatagtagacggtgattgtaaatttacattagcctccgatacataccaacacccagcgacacaacttgtgctcagtaaagaaagtatggaaatcatcgctgacgatttcaaatttgtaaaagaaaatccggcaacagccgacgaacagctagtcagagtttttgatgaaatcgtcaaccaaatgaatcactattttacaatatttgaccaaagaagcaaccgacaaaaagttacaaaagcccgtgacaagttcgtatccttaccaacagagagcgaatacgaaggagcaaagaaaacgcaagtcggaaaaactgaggtaattaccaacctactaatgggcctccatgcaaatgccgcacaaggagatctaaaagtacttggcctatctacctttggtttctttcagtcaagcggaggtctcaacttaagtgaggatgcaatgatagtctaccagagccccacaggattatttgaaagaagaatctgtttaaaagatatatga

SEQ ID NO: 5531 - RNA, 4146 nt, synthetic construct
  misc_feature 1..4146: note = Cas9 variant
  source 1..4146: mol_type = other RNA
atgaaacagatcctcaagaaagttcaaggatataacataggcctagatatcggtacaaactcagtaggatgggtagtaactgacgaaaatgccaatctactgcaattccgtaaaaaaaacatgtggggtgcaaggctgtttgaaaaaggcgacacagcacaaggtagaagactttcaagatcaaccagaagaagatatgatagaagaaggcagcgaatacactatctacaagagatgttggcaaccatggtactaccaatagacgaaagtttctttataagattaaatgaagcatttctatggaaagaagataaaagtgtacaaagagactacattctgtttgcagacaagcaattcaccgacagagatttctacaaacaatttaaaacaatctaccacctacgaaaatttcttctagacactaaagaaaaagctgacccacgatttatatacttggcgctacatcacatgataaagtacagaggtaactttttataccagggacaatcatttgacgtcgtagagaacgtacaagaatcattcagagtattgctagaagaaatgtacgagcaattaggcaaagaatgggaatatggagagcacttcgacgacatccaacggatactagaaaatacaacaataggcaaaaaatctaaacaagaacaaatcgccgccatactcaccgaacagtatggcaacaaaaaattggcaaatgaagtaacaagagcatgtctaggttactcattcgacctaacagttgtgatggaaaatgaaaacttactagatgaatcaggtaaaaagatcaagatttcattcagcgacagtaagtatgaagaacaagaattagaactccaaaatagactggaagaaaaatttgccgtcatagaggccctcaaacgaatatataactggcttgttctcaaagacaccttacgaggaaaaaagtatataagcgaagcaatggtaaacaaatacgaagcacaccacgaagatctagtgaaacttaaacgcctatttagaacttacctatcaacagaagaatactcgtgtttctttcgaaaagaaaagcaaaaagataaatatatatcaaattacgtcaactatagaaaaggcgcagagagatgttccaaagaaaaattatataaagcgatacatgaactattcgacacggttgcaaaagatgacgttgtctatcaagagatagttgaaaaaatggatcaaggcgaattccttaccaaacaaaatgaagtcagtaacgcatacatcccctaccaatgtaatgaagtagaaatgaaacgaatattaaaacaacaaggagaattctacccggaactaaaagagaacgcagataaaatattacaactgttgttattcaggataccctattatgtagggcccctagttgacgaaaagcaatcgaaattcgcatggatgaaaagaagaactggcatggaacaagttaagatatacccatggaatttcgaacaagtagtagacatagaccagactgcagaagccttcattacacgaatgacaaactactgcacttatctcccagaagagaaggttctacccaaacaatcattactttacagtgaatacgaattattacaagagctaaacaaaataaagataaacggtaagttctcgttagaaacccgaaacaaaataatagaacaattgtttaaaaaacaaaagaaagtaaccgaaaaacaattaaagaaatggctagtacgagagcaatactgtacaacgaaagtaacggaaaaaatggtaaaactagatgaaaatgcttattatatcactggatttcagaaggaaaatgaattcgcaagtagcctaacctcctacatagatttcactaaaatattaggggaaataacggaaagaaacagaaaaatgatagaagaaataatatattggttgacagtcttcgaggaaaaatcaatagtgaaaagaaaaatacaaaaaaaatacggaaacgaaataaatgacaaacaattagcacaaatcctaaaactaaattactctggatggggccgatttagtgaaaaatttttaaatggaatcaaaggattcgaccgacaaggacaaaaaaaaacaatcatggagctcttaagggaagactcacgactactaaacattatgcaaataataaacaatgaagaaatgggattttgcaaaataatcgaagcaaaccaaaaaaaactatacggaaacgaaaatctattagatgtagtacaagaattacacggaagccccgcaattaaaagaggtatatggcaaagccttaaaatagttgaagagataataagtataatgggaggcgtcccgcaaaatatattcatagaattcgctagagaagatgacgatcgagtaagaaccaattctcgtgtaaaacaaatagaaagactatataaaaaatttaaagaggaggttaacgacttcaatgagcacgctgccaacgaactaaaggagaaacgataccaaaaccgtattgatgaagaaaaagtattcctttacttcatgcaaaacgggaaaagcctatactcaggagtaaccctggacattgatcgattaaacgaatatgaagtagatcacataataccaagaacgctagttaaggacgatagcttagaaaacaaagcactagtattgaaaggagaaaatcagagaaaaggagagggactgataccgcatgaatggcaaaatcgacagaaagaagtatggaaaaaattattaagctgcgggctgatggggaaaaagaaatacgcaaatctatgtaaagaatcttttggaaatgagaaagaacaaaaacatttcatagcgcgacaaattgttgaaacaaggcaaataataaaacaagtagcaaacatacttgcgcaatattatcaaggcgtaaacgttgcagcagtaaaggcttcactcggaagtgaattgcgtgagaactacacaattgaaaaaaaagacgacaacggttttttcatggaaaataagagttacaccatgttaaaatcaagaaaaataaatgacttccaccacgctcaggacgcatacctggcatgtgcagtaggactatatataaaagccgcttttcctaaatatgaaaaagaaattgattacgaaggttatcgaaagtactaccagaaaaaaaaccagcaaaaagatggagttagaaacgaaaaaagacaattttttagttatgtaatgtctagattctctgaacaaatagtagacaaagaaacaggagaaatattatgggacggaacccaaaaattagcttacattaagaagatattcggatacagagactgcctgatcactaaaaaattagaagaaaatacaggcgaattctataagcaaacaataaatgcgaagccagaaaaaggaaaagaaaacaacacaaaactcctcccaataaaaaaaggactgagcgtagaaaagtatggaggatatcaaggtggtgaagccgcatacagctgcctagttcgatatcaacaaggtcgaaaaacaaaactatcactcgaaaaaatatcagtaataatagcaaaaaaaattgcagaaaaagaagtctcactagaccgatacttaaaggaaaaactaggggtagaagaaatagttatactccggaaaaaggttatgaaaaatcaactgatagaagatagtgatggaaacaggttctacttaaccgcagctacagaagtggtgaacgccaaacaatttattttggacggaaagcaccagcacctactaagaacaatagcaataatggagaaaggagaatattatgggtacagactagatgaactagaaaatagtatggatgagttatatgcatattatcggatgaaaatacaacagcaatatccagcatacgaatcgatagtgaaaaaaatagtagaaagccacgtgtacgaaagccttcatgtagaagaaaaaataaaggccgtacaggaaaaaggtaaattcctaattcaactattgagacttacggaagctaatgccgaatgtatagatctcaaaacaatctccgacgggcggctcgcagaccgtatagggagaaaaaatcactacacaattaaagaaggcataaaatttatagatcaatcaataacgggtctatatgaaagatatatgacggtgtga

SEQ ID NO: 5532 - RNA, 4146 nt, synthetic construct
  misc_feature 1..4146: note = Cas9 variant
  source 1..4146: mol_type = other RNA
atggactacgtaaaagaatatcacatcggactcgatatcggaacctcaagtattggctgggctgtaacagatagtcaatttaaactaatgaggataaaaggtaagacagccataggggtcagacttttcgaagaaggcaaaacagcagcagaaaggagaactttccgaacaacaagaagacgactaaaacgccgtaaatggcgactacattacctagataagatattcgcaccacatctacaggaagtcgacgaaaactttctccggcgcttaaaacagagcaacattcacccagaagacccagccaaaaaccaagcattcattggaaaactactattccccgacttgttaaagaaaaacgaaagaggatatcctacattaataaaaatgagagatgaacttccagtagagcaacgagctcattatccagtgacaaacatatacaaactaagagaagcaatgattaacgaggatcgacaattcgatttaagagaagtctatcttgcagtacatcacatcgttaaatacagaggacactttttaaacaacgccagcgtagataaatttaaggtcgggagaatagactttgataagagctttaacgtactaaatgaagcctacgaagaattgcaaaacggagagggatcattcactatagaaccatcaaaagtagagaaaatagggcagctattattagacaccaaaatgagaaaattagacaggcaaaaggcagtcgcaaaattattagaagtaaaagtagccgacaaagaagaaactaaaagaaataaacagatagctacagcaatgtccaaattagtactaggttataaagcggatttcgcaacagtagccatggctaacggaaacgaatggaaaattgatctatccagtgaaacaagtgaagatgaaatagaaaaatttagagaagaactaagtgacgcacaaaatgatattctaaccgaaataactagcttattcagccagataatgttaaacgcaatagtaccaaacggaatgtcaatctccgaatcaatgatggacagatattggacccatgaaagacaattagcagaagtaaaagagtatttagcgacacaacccgcttctgcaagaaaggagttcgatcaagtatacaataaatatataggacaagtaccaaaagaaaaaggttttgacttagaaaaaggactgaagaaaatactatcaaagaaagaaaattggaaagaaatagacgaactactaaaagctggtgactttctaccaaaacagcgaacatctgcaaatggagtaataccacatcaaatgcatcaacaagaactagatagaataatcgaaaaacaagcaaaatactatccatggttagcaacagaaaacccagcaaccggagaacgagatcgacatcaagccaaatacgaattagatcagctagttagttttaggatcccttactacgtaggtccactggtaaccccagaagtacaaaaagcaaccagtggtgcgaagttcgcctgggctaaaagaaaagaagacggggaaattacaccatggaatttatgggataaaattgacagagcagaatctgcagaggccttcataaagagaatgacagtaaaagacacttacttgctaaatgaagatgtcctccccgcaaactcactactataccaaaaatataatgtattaaatgaactaaataacgtaagagtcaatggtcgcagactgtccgtcggaataaaacaagatatatacacggagctgtttaaaaagaagaaaacagtcaaagcgggagatgttgcaagtctagtaatggcaaaaacaagaggagtaaataaaccatcagtagaaggtctttcagacccaaagaaattcaattcaaatctagccacatacttagatttaaaatccattatgggagataaagtagacgacaatagatatcaaatggacttagaaaatattatagaatggcgaagtgtatttgaagacggagaaatctttgcagacaaacttaccgaagtagaatggttaacagatgagcaaagatcggctctagtaaagaaaagatataaagggtggggaagattgtcgaagaaactacttaccggtatcgtagatgaaaatggacaaagaatcatagatttaatgtggaacactgatcaaaactttatgcaaatagtaaatcaaccagtatttaaagaacaaatcgatcaactaaaccagaaagcgatcactaatgacggaatgacccttcgtgaacgtgtagaatccgttctagatgacgcatatacatcaccgcaaaataagaaagcaatttggcaagtggtccgtgtagtagaagacattgtaaaagctgttgggaatgcaccaaaatcgatatccattgagttcgccagaaatgaaggaaataaaggagaaatcacaagaagcaggaggactcagcttcaaaaactctttgaagaccaagctcacgaattagtgaaagacacttctttgaccgaagaattagaaaaagctccagacttatctgatagatactacttttactttacacaagggggaaaagatatgtatacaggggacccaattaatttcgacgaaatatctactaaatatgatattgaccacatactaccgcagtcatttgtgaaagatgattcattagataatagagtactggtttctagagccgaaaacaataagaaatctgacagagtaccagcaaaactatacgctgcaaaaatgaaaccatactggaatcaactacttaaacagggactaattactcaaaggaaattcgaaaacttaactatggacgtagatcagaacattaaatacagatctttaggattcgtaaaaaggcagctagtcgaaacacgacaagtaataaaattaaccgccaatatattaggcagtatgtaccaagaagccggaacagatataattgaaactagagccggattgactaaacaactacgtgaagaatttgacttaccaaaagtccgtgaagtaaacgattatcaccatgcagttgacgcctatctcactacgttcgcagggcaataccttaacaggaggtaccctaaacttagaagtttctttgtctatggagaatatatgaaatttaaacacggctcagacttaaaactaagaaacttcaactttttccacgaactaatggagggcgataagagtcaaggcaaagtcgtcgatcaacaaacaggtgagttaataacaacaagagatgaagtagctaagagctttgacagactactaaacatgaaatatatgttagtaagtaaagaagttcatgacaggtcagatcaattatacggagccacaatagtaaccgcaaaagaatccggcaaacttacatcacctatagaaataaagaaaaacagacccgtcgatctatacggcgcctacaccaatggaacaagtgcgtttatgacaataataaaattcactggaaataaaccgaaatacaaagttataggagttcccacaacaagcgcagtcggattaaagagagttggaaaacctggatctgaatcctacaaccaagaacttcatagaattatcaaatcaaatcccaaagttaagaaagacttcgagatagtggtcccacatgttagttattcccaactaatagtagatggtgactgcaaatttacgttagcaagtgacacatatcaacatccagcaactcagctagttttaagcaaagagtcaatggaaattatagcagacgattttaaattcgtaaaagaaaaccccgcaaccgcagacgaacaattagtaagagtctttgatgaaatagttaaccaaatgaatcattattttacaatattcgaccaaagatcaaatcggcaaaaagtaacaaaagcacgagacaaatttgtgtctttacccacggaaagtgaatacgaaggagccaaaaagacacaagtaggtaaaacagaagtaatcactaacctcttaatgggcctacacgcaaatgccgcacaaggtgacctaaaagttctaggtcttagcacattcggattcttccaatcaagtggaggattgaatttgtctgaagatgcaatgatagtttatcaatccccaaccgggctattcgaacgaagaatatgcctaaaagatatatga

SEQ ID NO: 5533 - RNA, 4146 nt, synthetic construct
  misc_feature 1..4146: note = Cas9 variant
  source 1..4146: mol_type = other RNA
atgaagaaatcatacgcaataggcatagacataggaaccaactcagttgggcactgcgttatgtacacagaaaattataaagtaccaagcaagaaaatgaaagtgttcggtaacactgaaaaacgatatattaagaaaaatctactaggcaccctcctctttgatgaaggaaacacagctgaaaacagaagactaaaaagaacagccaggagacgttacactagaagaagaaatcgtattctatatcttcaagaaattttcgcagaagaaataaataaaattgacgacagctttttccagcgactcgacgatagtttcttaatagtcgaagataaacaaggatcaaaacatcccatattcggaacattacaagaagaaaaagaatatcataaacaattccccaccatctaccatttacgcaaacaactagctgattcttcacagaaagcagacatacgactaatctacttagcgctagcacacataataaaatacaggggacactttctattcgaaggagatctaaaatcagaaaacaaagacgttcagcatttattcaacgattttgtagaaatgttcgataaaacggttgaagggtcatacttatctgaaaacctaccgaatgtagcagatgtgctagtagaaaaagtaagtaaaagtagacggttggaaaacattctacattacttcccgaacgagaaaaagaacggactttttggtaacttccttgcgctagcattgggcctacaaccaaattttaaaacaaactttgaattagcagaagacgccaaaatacaatttagtaaagaaacctacgaagaagatttagaggaacttctcggaaaaattggcgacgattacgcagacttgtttatcgcaacgaaatcactctacgacgggattcttctagctggaatcttatctacaactgactcaaccacaaaagcacctttgtcatcttccatggtaaacagatacgaagaacatcagaaagatctagcccttttaaaagactttatccgacaaaacttatcagatagttataaagaatttttcaacgatacattaaaggatgggtacgcaggatacatagaaggaaaaaccacacaagaaaacttttatagatttataaagaaggcaatagagaaaattgaaggatcgaactattttattgacaaaatagatagggaagattttcttagaaagcaacgaaccttcgacaatggatcaataccacaccaaatacacttacaagaaatgcacgcaatcatacgcagacaagcagagttctatccattcctagtagaaaaccaagacaaaatcgaaaagattcttacattccgtattccgtattacgttggtccattagcaagaggaaagtcagagttcgcgtggctgaaaagaaaatcagacgagaaaataagaccctggaactttgatgaaatggtcgacaaagaaacctctgcagaaaacttcataactcgaatgacaaattatgaccaatatttaccagatcaaaaagtgctacctaaacattccctactatatgaaaaatttgcagtatacaacgaactcactaaagtgcgatatgttacggaacaaggaaagagcttctttttcgacgcaaacatgaaacaagaaatattcgatggcgtctttaaagtatatcgaaaagtcacaaaagaaaaacttatggatttcttaggaaaagaatttgacgagttcaggatagtcgatctaatgggattggataaagataacaaatctttcaatgcatcactgggaacataccatgatctcaaaaagatagtctccaaagacctactagacaaccctgaaaatgaagacatcctcgaaaatgtagtactcacgctcacgctattcgaagatagagaaatgataagaaaacgcctcgaaaaatacaaagatgtactaacagaagaacaacgaaagaaactagaaagacgacactacacgggatggggaagactatcagcaaaactcataaatggaatacgaaacaaaaccacacgtaaaaccatactagattatttaatagacgacggcacatcaaacaggaacttcatgcaactaattcacgacgatacactctcattcgtagatgaaattagacttgcacaaggatctggagaagcagaagattatcgaacagaagtccaaaacttagccggctctcccgccataaagaaaggtatacttcaatccctaaaaattgtagacgaacttattggagtaatgggatataatccagaacatgttgttgtcgaaatggcaagagaaaaccaatttacaaatcaaggcagacgatcaagccaacaacgatacaagaaaatcgaaaatgcaatcaaaaacttagacagtaacttgaactcaaaaatactaaaagaatacccaacaaacaaccaagcactacaaaatgatagactatttttatactacttacaaaacggcaaagatatgtataccgatgaagaattagatatcgatcaactatcacaatatgatatagatcatataataccccaagcatttataaaagatgactcacttgataataaagtactaacaaaaagcgcgaaaaaccgaggcaaatcagatgatgtcccatcattagaaatagtacacaaaaagaaaaatttttggaaacaattgcttgacagccaactaatatcacaacgaaaattcgataatctaactaaagctgaacgaggcggcttaacaaacgaagacaaagcaagattcatacaaagacagttagttgaaacccgccaaataacaaaacacgttgctagaatccttgacaccagattcaatacaaaattggacgacgccggtaacaggataagagacccaaaagtcaatataataaccctgaaatccagtctagtaagccaattcagaaaagactatcaattatacaaagttagagaaatcaacaactatcaccatgcccacgacgcctacttgaatgcagtagtcgccacagcactacttaagaagtatccccaattagcccctgagttcgtatacggcgactacccaaaatataactcgtacaaatcaagaaagtcagctactgaacgcgtcctattttacagtaatattatgaacttctttaaacgagttgtgaaaagcagtaagacaggaactgttaaaatacggcctataatagaagtaaacaaagaaaccggagaaatagtctgggataaaaagagcgattttcgaaccgtccggaaggtgttatcttaccctcaagtaaatgtagtcaaaaagacagaagtacaaaaccacggtttagaccgaggaaaaccaaaaggattttataatgccaacctatcaccaagacctaaagaaggatcagttgaaaatctcgtaccagccaagcaatcgtttgatactaaaaggtacggaggttatgccggaataagcaatagctacgcagtacttgtaaatggtataatagaaaagggcaagaagaaatccaaagcagaagtaaccgagttccaaggaataagcatattagctagaaaagatttcgagaaaaaccccaaacagtacctactgaacctcggatacaaagatatcaaaagcataataaaactcccaaaatattcattgtttgaacttgaaaacggatctcgcagaatgctggcaagcatcctatcaacaaacaataaacgaggcgaaatccacaagggaaacgaaatgtacctccccgacaaatttgtcaccttactataccatgcaatgcgagttaatagaacactcgaaccaggccacaagaaatatgtcgaaacccacagacatgtctttgacgaactcctaacttacatacttgaatacaatgagaaaatagtgggagcaaaagctaacgggaaaagaatagttgaagcgtacagcgcacgaaaagacaccgacaacctcgaagaactctgcaactcattcatcaacctattaaatctaacagcgttaggtagtgctgtagattttgagttcttgggaacaaaaataccacggtacagagattatacaccaagctcactcctaaaagcaacattaatacatcaatcagtcacaggactctatgaaacacgtatcgacttatctaaattaggcggtgactga

SEQ ID NO: 5534 - RNA, 4146 nt, synthetic construct
  misc_feature 1..4146: note = Cas9 variant
  source 1..4146: mol_type = other RNA
atgaagaaaattataggcttagatctagggaccacatcaataggatgggcatacgtgcatgaagcagaaagtgcgcaagaacgatctgaaatagttagattaggagcaagagtagtccctctaacaacagatgaacaagatgagtttaagaaaggtaaaagtatcacaaccaatgccgcacgattaagtaaacgaagtttaagaagaaatgctgatagattccaactacgaagagatgaattggccggtgtcatgaaagaagcaggatggatcgacgaaacaactgtactagcagaacaaggccctagaagtacctttgagactttaagattaagagcaaaggcagcgtccgaggaagtcactttagccgagtttgcacgcatactactccaaattaatagaaaaagaggttacaaaagtaaccgaaaaacggacggagatgaagaaggagctctaattgatgggatggatgtaagtaaacaactaaatgcatccggacaaacccctggagaatgggttttagcaaggatgcaagaaggaaatgctgttattcctgcattctactgtagtgacttaagtgaggaactagacagaatttggaggaagcaacaagcatcacatcaagcgtggatgaccgaagaactgcatacagtcttgagacatgcagatggtaggtcagctatcaggctaatggacaaagctggagtggtaccagactcagttaatgtaaaagaaaggcgcagagttatgtatgaatggcgggcagccgcagtacgggactgtctaccagcgggtagagtcgcagcagcattaatgcaagtaagtaaagagatcgggagagccgactcttacttgggaaggataggcgacagaagcaaagaactatacttccataggcaaactgtaggacaatatttatggaggctaatatgtgacaatcctaaccaatcattaaagaacttagtgttctataggcaagactaccaacacgaatttgaaactctatggtcaattcaaacaaaatatcacgtagaactaacagaagatctccgaaaacgtgtaggaagaataatatttttccaaagaccgctcaaaagcaagaaaggtctagttaatcgatgtgaattagttcactatagcgtctgtgaaaacagcggggatgatctaaccgaaaaagtcgatgtaggaccaaaagtatgtcctaaatcctctccactttttcaggaatttaaagtttggcaagtcctaaataacgtagaggttattcatccttcaacacaagaggcaagaagactcgaaatggaagaaaaagaactactcgccagcgagctgcttttcagagaccgaatgaagaaaatagacgtgctgaaattactattttcgaattggagagatctagatctaaattacaaagagctagaaggcaacagaactatggcagctttctatagggtatatgaacaggtaatagctcaaacaggacatggagactatgatttcgcaaaaatgcgagccgcaaaagtcaaagagctcgcagaaggtgtttttgctggcctaggctttgaagtaggcctacttacattcgatgcagaactagacagtcctgcttatgaacaacagccttgctatagactttggcacttactatattcatatgaaggagataaatcggccacaggcaacaaatgcctattaaagaaactatgtcggttaacaggaatgaacgctgaattggtaggactattcatgcaaataagattttcaggagattatggcagcctaagtacaaaagcaatgagaaggattctaccctaccttaaagcaggaaatacgtatgatgtggcctgcgaatacgctggttttagacattccgcccgttcattaacccgagaagaattagcacaaaaagaatacaaagactatctagatttacttccacgtaacagcttaaggaatccagtggtagagaaaatactaaaccaaatgatacatgtagtaaacggactatcctctacatatggaaaaccggatgaaattcgagtcgaaatggcaagggaattaaagaaatcagcgagagaaagagaggaaatgacaagcgcaatttccaaaacaacaaaagaaaatgcagaaataacagccatattacaaagagatttcggtttgcgctatgtcagccgtaatgatatattaaggtacaaactatattgtgaattacggataaaaggtaacggttgtagaacattatactccaacacatatataaaccccaacgaactattctcaagagaatttgacattgaacatattattccacaatcaagactatttgatgactcatttagtaataaaactctagagtcaaggacagccaatttggaaaaaggggacagaacagcctgggactacgtcaatgaaaaatatggagctgagagagcagatgaatatagggctcaagtagaagcactatacagggacggaactatatcaaaagctaaacgcgataaactgcttatgccaggtgacaaaatcccggaagatttcattgacagagatataagaaacacacagtatatagcaaagaaagcacttgaaatattcgaagactttgttccctcagtagtagcaacttctggcaatgtaacagcgcgactaagagaggattggggtctagtcgatgtaatgaaagaactgaattggtccaaatacgagtcgcaaggaatggtacatatagaatacgatcgagacggtcgaccaattcgtagaattgttgattggacaaaacggaatgatcatagacaccatgcaatggacgccctagcagtagcgttcacaaaaagaagttatattcaatacctgaatcatttaaatgccagaaaagaggcaacatccgttgcgtacgctatacaacacaaagagatggaacttgatggtagtaatagatggagatttaaatgtccctttggtgataggtcagcattccgcagagaagctaaagcacaactagaacgaatactggtttcaatcaaaagtaaaaataaagtactaactcctagtgtcaatagaacaaagaaaagagggggattcaacaagaaagtagagtggacgccaagaggggcgttacacaatgaaacagtgtacggaagaattagaagatacgacgtaaaagaattaagagtagggtcaagttttacggcagaagttatcggtaaagtagctgatagccgatatagagccgcactaatgcatagactagcagaatttggtggagatcctaaaaaggcttttactggtaaaaacagcttggagaaaaatccactatatacagatgaagctcatacggcctgtgtcccgagtagtgttaaagtagtaagttttgttgaaataggtactataagaaaaggagtggacccgaacctgaatgtggataaagttgtagatacacatattaaaaatatattactagcacgcctttcagcttatggaggagacgcaaagaaagcattttccaatctggacgcagatccaatatggttaaataaagaaaaaggaatagcgataaaaagagtaacaattagcgacgattctgaagttagacctatacacgtaaaacgagatatgcgaggcagacttgtatgtgacgaacatggacgacctgtaccatctgactacgtacaactgagaaataatcatcatgtggccatattcagagatgcaaatggcgagttaaaagagcgcgtagttacattctttgaagcagtagaacgggtacgacaattacgttctgaaggtcgagcagtggaagttatagataaaaattacaaatgcgaagaaggatggacctttttattttcaatgaaaataaatgaatactttgtttttcctgacgccgcttcaggatttgatccaagggaaatcgaccttacggaccctgcaaattacgcactaatctcacctcatttatttagagttcaaaaattaagctcaaaagactactattttagacaccatttagagactaccgtcaatgatgttaagcagttaagggacataacatggaagcgaatatcatctctccaagatttagcagggacagttaaagtacgggtaaatcacatcggacaaatcgtcgcagtaggagaatactga

SEQ ID NO: 5535 - RNA, 4146 nt, synthetic construct
  misc_feature 1..4146: note = Cas9 variant
  source 1..4146: mol_type = other RNA
atggtaaaaaaaaaatacgccattggcattgatataggaacaaacagtgtaggttggtcaatagtaacagacgattataaagtaccatcgaaaaaaatgaaggtcttcggaaacactgaaaaaagatacataaaaaaaaacttactgggaacactgcttttcgacgaaggcaatactgccgaaaacaggagacttaaaagaacggcgcgccgtagatacacccgtcgtagaaaccgaatcctatacttacaagagatattcgctgaagaaataaataaaatagacgatagcttctttcaaaggttagatgacagtttcttaattgtcgaagataaacagggatctaaacaccctatattcggaactcttcaagaagaaaaagaataccataaacaattcccaaccatttaccatctaagaaaacaactagcagactcatcgcaaaaagccgatatccgcctcatctatctagcactagcccacataataaaatacagaggacacttcctattcgaaggagacctcaaatcagaaaataaagatgtacaacatttatttaatgatttcgtcgaaatgtttgacaaaacagttgaaggatcctacctatctgagaatctgccaaacgtcgcagacgttctcgtcgaaaaagttagcaaaagcagacgactggaaaacatactacattatttcccaaatgaaaaaaaaaacggcttattcggaaatttcttagctttagcactagggttacaaccgaacttcaagacaaactttgaactagctgaagacgctaaaatccagttctccaaagaaacctacgaggaggatctagaagaattactcggcaaaattggagacgactacgcagacttatttattgcaaccaaaagtttatatgacggcatactacttgccggaatactctcaactacagactctacaactaaagcacccttatctagcagtatggtaaacagatatgaagagcatcaaaaagatctagccctactaaaaaactttatacatcagaatctttcagattcctataaagaagtattcaacgataaattaaaagatggctatgcaggatacatagaaggtaaaacgacacaagaaaatttctatagattcataaaaaaagccatagagaaaatagaaggcagtaactacttcatagacaaaatagacagagaagacttcttacgaaaacaacgaacattcgataacggttctatcccacatcaaatccacctacaggaaatgcacgcaatcatacgacgacaagcagaattttatccgttcttagtagaaaatcaagacaagatagagaaaatactaacattccgtataccgtactacgtaggacccctagctagaggaaaatccgaattcgcatggctaaacagaaaatctgacgaaaaaattcgaccctggaacttcgatgaaatggtagataaagaaacatccgccgaaaacttcataacacgtatgacaaactatgaccagtatctacctgatcaaaaagtactaccaaaacattcactattatacgaaaaattcgcagtatataatgaactaaccaaagtcagatacgtaaccgagcaaggaaagtcttttttttttgatgctaatatgaaacaagaaatatttgatagaacgtttaaagtataccgtaaagttaccaaagaaaaactaatggacttcctgagcaaagaattcgacgaattcagaatagtagacctactaggcttagacaaagacaacaaaagcttcaatgcgtctttaggcacatatcatgatctgaaaaaaatagtcagcgaagacttcctagataactcagaaaacgaagacatcttggaaaatgtagtattaacacttacattattcgaagacagagaaatgatcaggaaacgactagaaaagtacaaagatgttttaacagaagaacaaagaaaaaaactagaaagaagacattacacaggatggggccgacttagtgctaaattaattaatggcatcagggacaaagtaacacgtaaaaccatactcgattatttaattgacgatggaacatcgaatagaaacttcatgcaactgataaatgacgacacattaagcttcgtggacgaaataagacttgctcaaggatcaggaaaagctgaagactacagagcagaggtacaaaatcttgccggtagcccagctataaaaaaagggatactccaaagcctaaaaatcgtagacgaactaatagaagtaatgggttacgatcccgaacacattgttgtggaaatggctcgggaaaaccaatttacaaaccaaggtcgaagaaactcacaacaaagatataaaaaaatagaaaatgcaataaaaaatctcgactcaaatttaaactcaaaaattctcaaagagtatcccacaaacaaccaggcactacaaaacgacagactgttcttatactatctgcaaaacggaaaagacatgtacacagatgaagaattagacatcgatcaactatcacaatacgatatagaccacataataccacaggccttcataaaagacgatagcttagataataaagtattaacaaaatctgctaagaaccgcggaaaatctgatgacgtaccgagcctagagatcgtatacaaaaaaaaaaacttttggcaacaactgttggattctcaattaatctcgcaacgcaaattcgacaacctcacaaaagcggaacgtggcggattaacaaatgaagataaagctagattcatacaaaggcaattagtcgaaacacgacaaataacaaaacacgttgcacgcatattagacaccagatttaacacaaaactagacgaagcaggaaatcgtatcagagaccctaaagtaaatatcataatactcaaatcaaatttagtgtcccaattccgcaaagattatcaactatataaggttagggaaataaataactatcatcatgcgcacgacgcatatctgaacgcagtagtcgccacagcattactcaaaaaatacccacaattagccccagaatttgtctacggtgagtatccaacatacaattcctacaatagcaggaaaagcgcaacggagaaagtcttattttattcaaatatcatgaacttcttcaaaagaatagttgtccactcaaaaacaggagaagttcgaataagaccagtaatagaagtcaataaagaaactggagaaatagtttgggataaaaaatcaaatttcagaacagtaaggaaggttttatcgtacccacaggtaaacgtcgtcaaaaagacagaggtacagaatcacggattagaccgcgggaaacctaagggattttacaatgcaaatttatcccctcgaccaaaggaaggtagtgttgaaaacttagtacctgccaaacaaagttttgatactaaaagatacgggggatatgcaggcattagcaattcatacgcggttttagtcaacggcataatagaaaaaggaaaaaaaaaaagcaaagccgaagtaaccgaattccaaggaatcagcatattagccagaaaagatttcgataaaaatccaaaacagtacttattaaatttgggatataaagacatcaaaagtattataaaattaccaaaatattctctcttcgaactagaaaatggttcgcgtcgaatgttagcatcaatactctcaaccaataacaaacgtggagaaatacacaaaggaaacgagatgtatttaccagataaattcgtcactcttctctaccatgcaatgagggtaaacagaacgttagaaccaggacacaagaaatatgtcgaagcgcaccgacatgtatttgatgaactactaacctacatcttagaatataatgaaaaaatagtcggggctaaagcaaatggaaaacgcatcgtagaagcatacagtgcaagaaaggacaccgacaacctagaagaactctgcaactccttcatcaacctattaaatctaacagctctcggatcagcggtagatttcgaattcttaggcaccaaaataccaagataccgagactacacaccaagctcactacttaaagcgacactaatccatcaatcagtaactggactatacgagacaagaatagacctgtcaaaactaggaggagattga

SEQ ID NO: 5536 - RNA, 4146 nt, synthetic construct
  misc_feature 1..4146: note = Cas9 variant
  source 1..4146: mol_type = other RNA
atggttaaaaaaaaatatgccataggcattgatataggaacaaactccgtcggatggagtgtcgtcacagatgactataaggttccctcaaaaaaaatgaaagtctttggaaacaccgaaaaacgatatatcaaaaaaaacctactaggaacattactatttgatgaaggtaatacggccgaaaatagacgcttaaaaagaacagccagacgtagatacacacgacgacgaaatcgaatactatacttacaagaaatctttgcagaagaaataaacaaaatcgacgactcatttttccaaaggctagacgattcatttctaattgttgaagataaacaaggatccaaacacccaatcttcggtacattacaagaagaaaaagagtaccacaaacagtttccaacaatctaccacctccgaaaacaattagcggactcatcacagaaagccgacataagactaatctatctagcattggcacacataataaaatatagaggccattttctcttcgaaggcgacctaaaaagtgacaacaaggacgtgcaacatttatttaatgaatttgtagaaatgttcgacaaaacagtagaaggctcctatctcagtgaaaacataccagatgtagcggacatcttagtagaaaaagtatcaaaatcaagaagactagaaaatgtattacaatatttcccaaacgaaaaaaaaaatggattactagggaattttttatccctagcgttaggactacaaccaaactttaaaaccaactttgaattagccgaagatgccaaaatacaattttccaaagagacttatgaagaagatctcgaagagctcctaggtaaaataggggacgactatgcagatctgtttattgcaacgaaatcattatacgacggaattctcctagctggaatcctctcaacaacagactccactacaaaagcaccacttagttcctctatggtcaatcgttatgaagaacaccaaaaagacctagcactactaaaagattttataagacaaaacctatcagattcatataaagaagtgttcaatgatgcgcttaaagacgggtacgctggatacatagaaggcaaaacaacacaagaagatttttataaattcgtgaaaaaaacaattgaaaaaatagaaggtagtgattactttatcgacaaaatagatagagaagatttcttaagaaaacaaagaacatttgacaacggatcgatccctcaccagattcacctaaaagaaatgcaagcaataataataagacaagcaaaattttacccattcctagaagaaaatcaggataaaatagagaaaatactaacatttagaattccttattacgtaggccctttagcccgaggaaattcagagttcgcctggttaaatagaaagtccgacgaaaaaattagaccatggaactttgatgagatagttgacaaagaaacaagtgcagaaaattttataacacgaatgactaattacgatcaatatctaccggaccaaaaagtgctacccaaacattcactgctatatgaaaaattcgcagtatataatgaattaactaaagtcaggtatgttacagaacagggaaaaagcttcttttttgatgctaatatgaaacaagaaatttttgacggagtctttaaagtatacagaaaagtaacaaaagaaaaattgatggattttttaggtaaagaatttgatgaattcaggatagttgatctccttggcttagataaagataacaaatcttttaacgccagtctaggaacataccacgatttaaaaaaaatagtatctaaagacctacttgacaaccctgaaaatgaagatatcctagaaaatgtagtgctaacgctaacactatttgaagacagagaaatgatacggaaacgtctggaaaagtataaagaagttcttacagaagaacaacgcaagaaattagaaagaagacattacacaggttggggcagattgtcagccaagttgataaatggtatacgggataaagttacccgaaaaactatcttagactacctaatagacgacggaacatcaaatagaaattttatgcaactgataaacgacgatacgctaagttttgttgacgaaattagactagctcaaggttctggagaagcggaagattaccgagcagaagtacaaaacctcgcaggtagtccagctataaaaaagggaattttacaatcattaaaaattgttgacgaactaatcgaagtaatgggatacgaaccagaacacatcgtagtagaaatggccagagagaaccaatttactaaccaaggacgaagaaattctcaacaacgatacaaaaagatagagaacgctattaaaaatctcgactcaaatctaaattcaaaaattcttaaagagtacccaactaacaaccaagccctccaaaatgacaggcttttcctatattatctacaaaatggaaaagatatgtatacagatgaagaacttgacatagaccaactcagtcaatacgacattgatcacatcatcccacaagcatttattaaagatgattcgcttgacaacaaagtcttaacaaaatcagctaaaaatagagggaaatccgacgatgtaccatcacttgaaatcgtatataaaaaaaaatcgttctggaaacaactccttgactcacaattgatctcgcaacgtaaattcgacaatttaacaaaagctgaaagaggcggattaacaaacgaagataaggccagattcatacaaagacaattggtagaaacacgccaaataactaagcacgtggccagaatgctggatacacgttttaacacgaaattagacgaagctggaaaccgtatacgagatccgaaagttaatataataacattaaaaagtaacctagtctcacaatttcgtaaagattaccaactatacaaagttagagaaattaacaactatcaccatgcacatgacgcatacctgaacgctgttgtagcaacagcattattaaaaaaatacccacaactcgcaccagaatttgtttacggagaatatcccacatacaattcatataattcacgaaaaagtgccaccgaaaaagtattattttattccaacataatgaacttttttaaacggatagtagtacactccaaaaccggagaagtacgaataaggccggtaatagaggtaaacaaagaaaccggagaaatagtctgggacaaaaaaagtgattttcgaactgttcgaaaagtactatcttatccacaagtaaatgtagtaaaaaaaactgaagtacaaaatcatggactcgataggggaaaacacaaaggcttttacaacgctaacttaagtcctcgcccaaaagaaggaagcgtcgaaaatctcgtacccgccaaacaaagcttcgacaccaagcgatacggaggatacgccggcatcagtaactcttatgcagtcctagtaaatggaattattgaaaaaggaaaaaaaaaatcaaaagcggaagtaacagaattccaaggaatatcaatactcgcgcgcaaggactttgataaaaaccccaaacaatatctgctaaatcttggatacaaagatatcaagtccattatcaaattaccaaaatactctttgttcgaactagaaaacggaagcagaagaatgctcgcgtcaattttatcaactaacaacaaacgtggcgaaatccacaaagggaacgaaatgtacctaccggacaaatttgtaaccctattatatcacgcaatgagggtaaatagaactttagaacctggacataaaaaatatgttgaaactcatcgccacgtgttcgacgaactcctaatatacatattagaatacaatgaaaaaatagtaggagcaaaagcgaatggcaaacgaatcgtagaggcctactcagcaagaaaagacactgacaaccttgaagaactatgtaattcattcatcaatctcttaaatttgaccgcacttggctcagcagtagatttcgaatttctaggaacaaaaataccccgatatcgggattacacgccctcatcactcctgaaagcaactttaatccatcaaagtgtcactggattgtacgaaacccgcattgacttatcaaaactaggaggagactga

SEQ ID NO: 5537 - RNA, 4146 nt, synthetic construct
  misc_feature 1..4146: note = Cas9 variant
  source 1..4146: mol_type = other RNA
atggtcaaaaagaaatacgctataggaatagacattgggactaattcggtcggctggtctgtagtaactgacgactataaggttccaagcaaaaaaatgaaagtcttcggaaataccgagaaaagatatatcaaaaaaaatttactaggcactctattattcgacgaaggcaacacagctgaaaatcgtagattaaaaagaacagctagacgtagatacactcgaagaagaaacagaattttatatttgcaggaaattttcgcagaagaaattaacaaaatagacgactcttttttccaacgtcttgatgatagctttcttattgtcgaagacaaacagggcagtaagcacccaatatttggaactttacaagaagaaaaagaataccataaacagtttcccacaatttatcacctacgaaaacagctagcagactcaagtcaaaaagcagatatccgattaatatacctagcattagcgcacatcataaaatatcgaggacattttctattcgaaggagacttaaaaagtgaaaacaaagacgtacagcacttattcaacgacttcgtcgaaatgtttgacaagactgttgaaggctcatatctttcagaaaacctaccaaatgtagcagatgtactagtcgaaaaagtatcaaaatctcgacatttagaaaatattttacactatttcccaaacgaaaaaaaaaatggactgtttggaaatttcctagcattagcattaggactacaaccaaacttcaagacaaattttgaactagcagaggatgctaaaatacaattttcaaaggaaacatatgaagaagacctagaagaactcttaggaaaaattggcgatgactacgcagatcttttcatcgcgacaaagagtctctacgacggcattcttctggctggtatattaagcactactaattcaactacgaaagccccactatcgtcaagcatggtcaatagatatgaagaacaccagaaagacctagcgttattaaaaaacttcatccatcaaaatctatctgatagttataaagaagtctttaacgacaaattaaaagacgggtacgccggttacatagaaggtaaaactacccaagaaaatttttaccgctttataaaaaaagcaatagaaaaaatagacggatcaaattacttcatcgaaaaaattgaaagggaagacttcttaagaaaacaaagaacattcgacaatggatctataccacaccagattcatctacaagaaatgcaggcaatcatacgaagacaagcgaaattttacccattcttagaagaaaatcaagacaagattgagaagatcttaaccttcagaataccatactatgttggacccctcgccagaggaaaaagcgagtttgcatggttaaataggaaatcagacgaaaaaataagaccttggaattttgacgaaatggtcgataaagaaacctccgcaaaaaacttcataacacgaatgacaaactatgatcaatacctacctgatcaaaaggtattaccaaaacattcattactctacgaaaaatttgccgtatacaacgaactaaccaaagtccgttatgtaacagaacaaggaaaatcatttttctttgacgccaatatgaaacaggaaattttcgatggagtatttaaagtttatagaaaagtaacaaaagaaaaactaatggatttccttggaaaagaatttgacgaatttagaatagtcgacttactaggcctcgataaagaaaacaaatctttcaatgcaagcctaggaacatatcatgatcttaaaaaaatagtatcaaaagacttcctcgacaacagtgaaaacgaagatatcctcgaaaatgtagtactgacactcacattatttgaagatcgagaaatgatccgaaaacgcctagaaaaatacaaagacattctaacagaagaacaaagaaaaaaacttgaaagaaggcactatacaggatggggtcgactcagcgccaaactaatcaatggaatcagagacaaagtcacacgaaaaacgatcttagattatctaatagacgatggtacttcaaactgcaacttcatgcaattgataaatgacgatacattatcattcgttgatgaaattagactagctcaaggaagtggtgaagccgaagattaccgagctgaagttcaaaatctagcaggcagccccgccataaaaaaaggaatcctacaatcactaaagattgtagatgaacttatcgaggtaatgggttacgacccagaacacatcgtcgtggaaatggctagagaaaaccaattcaccaaccagggccgacgaaacagccagcaaagatataaaaaaatagaaaacgcaataaaaaacctagattcaaatttgaattcaaaaatactaaaagaatatccaaccaataaccaagctctgcaaaacgatcgactctttttatattatctacaaaacggtaaagacatgtacactgacgaagaactagatatagaccaactatcacaatatgatatcgaccacattataccacaagcctttatcaaagatgactcgctggacaataaagtacttacaaaatcggcaaaaaaccgagggaaatcagacgacgtaccctcattagagatcgtatacaaaaaaaaatcattctggaaacaattgcttgactcccaactaatttcgcagagaaaattcgacaaccttacaaaagcagaaagaggcggtcttacgaatgaagacaaagcacgtttcatacaaaggcaattagttgaaacaagacagataactaaacacgtagctcggatgttagacacccgattcaatacaaaactggatgaagccggcaatagaataagagaccctaaagtgaatattataacacttaaaagcaacctagtttcacaatttagaaaagactaccaattatataaagtccgagaaataaataattatcatcacgcgcatgacgcatacctaaacgctgttgtggccacagcactacttaaaaagtatccgcagctcgcgcctgaatttgtttatggcgaatacccaacatataacagctacaacagcagaaaatcagcaactgaaaaagttttattttattcaaacataatgaatttcttcaagagaatagtagtacattcaaaaacaggagaggtaagaattagaccagtcatagaagtaaacaaggaaacaggcgaaatagtgtgggataaaaaatcagactttcgtacagtaagaaaggtattatcctatccccaagtgaacgtagttaaaaaaacagaagtacaaaatcacggtttagatagaggaaaaccaaaaggattctataacgcaaacctctctccacgacctaaggaaggcagcgtagaaaacctagtaccagcaaaacaatcattcgatactaaacgatacggtggctatgccggaatctccaactcttatgctgttttagtgaatggaataatagaaaagggaaaaaaaaaatcaaaagccgaagtaacggagttccaaggaatcagcatattagcaagaaaagactttgacaaaaatcccaaacaatatttattaaatttaggatacaaagatataaaatctataataaaactacctaaatactcattatttgagctagaaaacggcagccgaagaatgctagcttctatattatcaacaaacaataaacgaggagaaattcataaaggaaacgaaatgtatcttcctgacaaatttgtaacattactataccacgcaatgagagtcaacagaactctcgaaccagggcataaaaaatacgtagaaacgcaccgtcacgtatttgatgaactgttaatctatatactagaatacaatgagaagattgtaggagcaaaggctaatgggaagagaatcgtggaagcgtattccgcaagaaaagacaccgataatctagaagaactttgtaacagcttcataaaccttctaaacctaacagctcttggaagcgcagttgatttcgaattccttggaacaaaaataccacggtatagagattacacaccatcctcattattaaaagctacactcatacaccaatcagtaaccggtctttacgaaacgagaatagatttaagcaaactcggaggagactga

SEQ ID NO: 5538 - RNA, 4149 nt, synthetic construct
  misc_feature 1..4149: note = Cas9 variant
  source 1..4149: mol_type = other RNA
atgaagaaaatagtgaattacaatctaggcctcgatatcggcacttcgtcaataggatatgccgcaatcgacgaccaaggtcgacctgtaagacaccaaaacaaaaccgtaatgggagtccgactatttaaagaaggtaaaacagcagaaagtacaaggatattcagaggtacccgtaggcgactcagtcacagacattggaggcttggatacttagacagaatatttgataatgagatagccaaggtggatgaaaattttctaccgcgactaaaagccagcaaaagggcacgatctgatgaaaaacgaagttttagaggatcacttctcttcccagagactggcgatgatgcatattaccaaaaatatccaacaatataccatctcagatatgcattaataacccagaaaaagcaatttgacatccgtctgatttatcttgcccttcaccatatgataaaatatagaggcaattttctagacacaaccccggtatccgctttcaacatacacgatatagatcttacagatcaatttgcatcgctaaacgattgttaccaactattagatatggacttcgagttccaatttgacttgaataatatcgaacaagtccaaaaactccttcttgatgaaaccttatcgaaaactaaaagacaagcggcagttagcaaagtcctcgtaatgagcacaggcaataaggcatttgatgaccaacaaaacggcatagcttcagagttcatcaaagccctcttgggaggaccatttgacctgtcgaaaattttaaatctatcagtggccgatgtaaaatcctggaaactacacatgactgataaagacgtagacgatacactaaacagcctagttgaagaattagacgaaaatcacaagcaaattgtaaatctacttcaaatgatatacagtcaagtcatgatgttaggtctacttaatggacaacaatctatctctgcatcaatgattgaaagatacgacgaccatgctaaacactgggccgccttaaagaaactcctacccgccctaggtgaacaagaacaatccacgatcattcatgcgtatacggcttacacaggacactctcgtactaaacaactatccagggccgagttctataccaaagtaaactctattcttaagaaacatgaaaacattgcagaagcaaccggtttgattgaactaattgataggaacgagttcatgccaaaacaaagagacgcagtaaacggagttatccctcaccaattacaccaacgagaattacaactaataatacaaaaccaacaaaaatactatccatttctagcagcaaaagcatacccggatgccgatgaaacaatgatagaacagttgcttagctttcgtgttccttattacgcaggaccacttgtcgaccgtgactttattaacgaaagcagtgaccaagaacaagctatgcaaaatacaaaatttagttggctaaaacgaagagaagcaggagaaattacaccatggaatttcgaacaaaaagtcgatgttcaagagacagctaatagattcattaaacgcttaacaaccaaagacacatatctgatgacagaagacgtactaccgaaagaatccttaatctatcaaagatttgaagtcctaaacgaactaaatgcaataaggataaacgataggagactaactgcagaaaataaacaactagcatttcaacaattatttatggcaggcaacactaaaaatgtaagcattaagaaattcaggaactttgtatttgattcattaaaatttccagagaaagtgaaaataacaggattcgcaggccaacacaacttcctagccaaactaagcacatatcatgattttaaaaagatattcggagaaagagtagatcacactgacttacaaccagacttcgaaagaatagttgaatggtgcacaatattcgaggatcgacacatatatagagaaaaactcaaagaaatacaatggctgagccaaagcgaaatagaccaattagtactcatacgaaatcatggttggggtaggctatccaaacgccttctaaccggaattagagacagtgatggacgcactgtaatggaccaattgtggtttggtactgataattttatgagaataatatctcaatcagactttgccgcagcaatagcaaacgaaaatagaacgcaacttaaccaacacggcttagaagacgtcttagactccgcatttatgtctccacaaaacaagaaagcaataagacaagtcttaaaagtcgtagatgacatcgaacaaaccctgggatgtcccccaaagaaagtcatgatagaatttacccgctcaccagataaaaagaaacaacgaaccgtcacgaggcttgagaaagtacaacaagcatacaaagccgtagcggaccaattagcgggccaatcgatcgtctcagagcttgaccaatacgctaacactcattcaaaactgtcagacacctattacctttatttcatgcaattaggtagagatctgtatagtgggaaacccatagacatcgactcccccatgctagacgacgatcacatcctccctagggcatttatgaaagacaattcactagacaacagagctctaacagaaaaaccgataaataatacaaaagccgccaaattcccctctaaagtatttgggcaacaaaaagaagtaacagacttttggaaacttctacgtagatgcgggctaatgtctaatataaaagaaaaacacttatatctagacccggacaatgtggacaaatggacccgaagaggatttattcaccgacagctagttgagacatcacaggtaataaaaatcgttgctaacattttaaacgaccgatatcaacaatcacaaacagaagtcctagaagtacctgccaggctaggcacagaactacgcgaatgcttcggatggtacaaagtcagagaagtaaacgattaccatcacgtatttgacgcatacttagccgcatttataggaaactatctatataggagataccccaaattacaaccttactttgtatacggcaattttgccgaacttaacaaagctcaattaaagaatataaaaagttttaattttctatacaacattacagacaacaaacgagtggtaaaagacattgaaacgggacaaacattatgggatgatcaaataagacaacaaatacaacatatatacgaatacaaatatatgttaacatcccacgaagcctttacacaacacaaagaactttatggacaaacaatatatcctagacgagaatttaaaccaggcacactaaaagccataaaacaagatcaacctcaagagctgtacggtggatacaaaaatctaacagctgcttacatgtgcatagtaaaaattcaagcacgtaaacgacgcgcagctgaatacagagtcgtacgagttgcaacagagtctctcagcgcactacaacaagcaaaacgtttaggcgttcaagcgtatgaacgatgtctcaggcaagaattagtacgaaataacgaaatcctcagaacaaacgccgatcccaattcagcaccacgtgagttcgaagtacttctagatcgtgtactatgtcatcaaatgatcatatccgatggacaaaaatacctactcgggtctcacgcatataaaataaattgtatgcaattagtactaagtaacaattcaatgaagatcctctccacctccatagttaaattaaaacaaatgacaaacgaaccgttagtacaagtataccgcgaaattctagacgtcgtcaataaatatttcacgctatacgacgtcaattcattcagggaaaacttaaatcaattcttcgataaatttagaacattaccaattaccaacgaatacgaaagctctaagtcaggaaagaaactaatacacagaggtcaattagaaacactcaccctaatcctacggggcttacatgctaacagtgacaaagttcaatacggtgatcaaagtacactactaggcggttttcaaacaaaagacggtataaaattaagcaaagattcagtaattcaatacacttcaccagccggcctaaatgtccgtactgtcaaattaagagatctagagcaaaaagaagctcagaaatga

SEQ ID NO: 5539 - RNA, 4149 nt, synthetic construct
  misc_feature 1..4149: note = Cas9 variant
  source 1..4149: mol_type = other RNA
atggtagacgagaaaatattttggggactcgatatcgggaccgactccgttggttgggcggtaacaaactcagaatacaaactgaagaaatacaaaaataatcttatgtggggtgtacacctgtttgacgaagcaaaacagtcagctgaacgcagatcgtttcgaaccgctagacgccgattagacagaagaaaacaaagaattatactattacaggaatttttcgtgagagcagtttgcgaaaaagacgaaaacttctttcgtcgattaaaagaaagcgcattattaccagaagatgcagaacacaggacgaacaatatattctttgacgaccctgattatactgacaaagattattttgaggaatacccaactatacatcacttaatttgtgaactaatggaatctaaagaaccacacgatgtaaggctagtatacttagcatgcgtatacttactagcacatcggggacactttctactaccggtatcggaggatgacatatcaaaagtaacagaatttgaacctctgtatgaatcattctacaaagcactggaagaaaaattagacgacgaaccgccatttgaccgatcggctgacgactttgcagaaatactaaaatcacataaaactgtaagcgccaaaaacaaagatttcgataaactactatttggaggtaaagtaaaaacgtacgacaatgaaaacatatcgtattcagcattaatcaaacttttatctggaggaacagaaaaactatcaaaatttttcgccaacgaagaatacacagacctagaaaaagactcagtgtgcgtgagaaatgctgactttggagatacactagaaatgttagagggacaaatcgatgaattagattttgcattactcaaatcagttaaatcactgtacgactggagcctcctagtggatatactagaaggaaaatccctaatctcggaagcaaagaaagacaaatatgacgaacacggatatgatcttgatgcactcaaatacctatttagagaatacttgacaaaagacgactataatgaaatgttcaaagaagtatcaggaaaacagaattatgcgtcatacgtttacaatgcaagtagcgacaaaacaagagactcaaaatacaagaaatgctcacaaaaagatttttgcaaattcactaagaaattcttatcaaaaataaaaccaaatgaaaaagataaaccgtgcttagataaattactcgaaaaatgtgaacagaactcgttatgcccaaaacaagtaacaaccgacaacagagtaataccataccaattgtactacgtagaacttaagaaaattttagaaaatgcatgtggctacttaccattcctaaatgaaagagatgaatatggcacagtggcagacaaaattctttcaataatgaaatttagagtaccgtattatgtaggacccctagtagacagcaagaaatccccaaatgcatggctagtaagaaaactcgatggtaaaataacaccatggaattttacagatatggtcaatgaagatgaatcagaaaatgccttcataagacgtatgacatgcaaatgtacgtacgttgcaggacaggacgtactacctaaatattcattactatattcaaaattctccgtactaaatgaaattaataatataaaactaaacggagaaccaataagtgtacaaaccaaacaagaaatatatacagagctattcgagaggaacaaaagtcgtgtatcgaagaagaaaattagagattgcctaataagtcacggttatgcagctgactcagacgaagtcacaggtatagatgatatagccaaatcagcgttaagatcctaccatgacttcaagaaaatgctctcgaacggaatactaacagaacaacaagtagaggaaataatagaacacattactgtcactactgataatataagactcaagaaatggttaaaaacgcaatttcctatgctagcagacgaagatgtaaaatacatcacaaaactgaaatataaagattacgggagattatcgcgatgtttcttagaagacgtactcccagtagacacaaaaacaggagaagccgaaagcgacaaaaatatcatcacaatgctctgggaaacaaacgaaaacatcatgcagttactaagcagtaaatacagatactccgagaatattgagcacatgaacagacaatactacgcactacctgaaaaccacaaatcaatgagtgaacgacttaaagacatgtatgtaccaacagcagtaagacgggcagtgacgagaacatttgacattgtcaaagaattaaagaaaatccaagggagagacccagacaaaattttcattgaaatggcaagaggcactggtgaaactccaaaaggaaaaagaaccaattcaagaaaagaccaaattttagaacattggcacggcttagacaataaagatataaacgatctcaagaaatcgggaatatgggaacacttggacacaattgatgatgccaaactaaggtcagacaaatacttcctctatttcatgcaactaggccgatgtatgtacacagagaaaccgataccgttcgaagaggtagaaaatgaacataaatggaatatagaccatatatggccacaggccaaaataaaagatgactcacttgacaacaaagtacttgtcagtagtaacgaaaatggcaagaaatcagatagctacccaatatccgacgacatacgacacagcatggcaggactatggcactctctttacaagaaaggtttaataagtgagaagaaataccaaaggctgacaaggtcaacaccttttaccgatgatgagttaagcggcttcatagctcgtcaattagttgagaccagacagtctacaaaagcagtcgctacgttattaaaagaacagttcccaaacactgaaatagtatacgtaaaagccggtttagtctctgatttcagacaagaaatgggtatgttaaaatgtcgagaagtaaatgacttacatcacgcaaaagatgcttatttaaatattgttttaggtaacgtatacaatacaaggttcacaaaagacccattaaatttcgtaaagaataacgagaaatactcaataaaaatattccagaaaaactcagatggcaagaaaaccggagtaattacaagaaaagtagagagaggtggagaagttgcatgggatcccgagacatcatttgctatcgtccgaaaaatgatgagcaaaaattcaatacggtacgttagatatgcatacatgagaaaaagtggccaaaatggtggctttttcgatcaaaacccgctacgtaaaggaaaaggcatggtcagcattaaacacaatctatctatagaaaagtacggcggatatgacaatgccactattagcttcttttcgctagtctcaataaaagattttggggtcatattactagccgtagaactattatcagcaaacaaatttctaaagaatatatcagaggctaaagaatacgcagcagacaaactatcaaaagaactgaacgtcaaaatagtgccaaacgatgtggccttcccactaaataataggtacaacgtcgtgaaaatcaacgcagtgttggaactagacggttaccgggtcatgatcgccgcaaaacaaaacagtagtatcaagtttgtatcaaatgaatcactaatactaagttcgcaacatatggcatatgtaaagaaaataacgaaatttatcgagaaaagaaaacaagataaggtatgtatgataaatgccttttcagggataagcatagaagacaatatagaattatatgatgtgctagtaagcaaatgcaacatcaaaccattcaatataatgtatgagaacttaggaatcaaattatcagataatagggacaatttcatcaagaaaagtgtagaaaatcaagtattaatattgagcgaaatggttaggttgtttaaaacaggaagaaaagccggtgttaatctagaagaagtaggaggcagaaagaactctggtgtaaaaacattaaacacatgcctatataaagtaaaagattactctaatatattcttagtagatcaaagcccaacaggattaatagaacacaagtccccaaacttattggacttgtga

SEQ ID NO: 5540 - RNA, 4155 nt, synthetic construct
  misc_feature 1..4155: note = Cas9 variant
  source 1..4155: mol_type = other RNA
atgaataaaccctattcaataggtttggatataggcacaaacagtgtaggatggtcaataattactgatgattacaaagtaccagccaagaaaatgagagtattaggaaacacagataaagaatatatcaagaaaaacttaataggtgctctactcttcgatgggggaaacacagcagcagacagacggttaaaacgaacagcacgtcgacgctacactcgtagacgaaaccgaatcttataccttcaagaaatattcgcagaggaaatgtcaaaagttgacgactcattcttccatagactagaagattcattcctggtagaagaagacaaacgcggctcaaaatacccaatatttgccactctacaagaagaaaaagactatcacgaaaaattctcaactatatatcatttaaggaaagaactggccgacaagaaagaaaaagctgatttaagactcatatacatagcattagctcacataataaaatttcgtggtcacttcctcatagaagacgactcattcgatgttcgaaacacagatataagcaaacaataccaagatttccttgaaatatttaatacaacttttgaaaacaacgacttgctgtcacaaaatgtagacgtagaagcaatcctcacagataaaatcagtaaatcagccaagaaagatcgaatacttgcacaatatcccaaccagaaaagtacaggcatcttcgcagagttcctaaaattaatagtaggcaaccaagcagactttaagaaatatttcaatctagaagacaaaacaccgttacaattcgcgaaagattcatacgatgaagacctagaaaatcttttaggccaaataggagacgagttcgctgacctattctccgccgccaagaaactatatgactcagttttactaagcggaatacttactgttattgatctaagtaccaaagccccactaagcgcgagcatgatacaaagatatgacgaacatagggaagacctaaaacaactgaaacaattcgtaaaagcaagtctacccgaaaaataccaggaaatattcgccgactcatcaaaagatggttatgcaggatatatagaaggaaaaacgaatcaagaagccttctataaatatctcagtaaactattaacgaaacaagaagactcagaaaatttcttagagaaaattaaaaacgaagactttttacgtaaacaaagaacatttgataatggatccataccacatcaagtacacctcactgaactcaaagcaataattagaagacaatctgaatactaccctttcctcaaagaaaaccaagacagaatagagaaaatactcaccttcaggattccgtactacatcggaccacttgctagagaaaaatcagactttgcctggatgacaaggaaaacagacgattcgatccggccctggaatttcgaagatttagtggacaaagaaaaatcagcagaagcatttattcatagaatgaccaataatgacttctatctcccagaagaaaaagttctgccaaaacacagtctgatatacgaaaaatttacagtatataacgaattaacaaaagtacgatataaaaacgaacaaggagaaacatacttcttcgactcaaacattaaacaagaaatattcgacggagttttcaaagaacatcgaaaagtaagcaaaaagaaacttctcgactttttagccaaagaatatgaagaatttagaatagtagacgtgataggacttgacaaagaaaataaagcctttaatgctagtctgggaacataccatgacttagagaaaattcttgataaagattttctagataatccagacaacgaatccatattagaagatattgtacaaacactcacactcttcgaagatcgagaaatgattaagaaacgattagaaaattacaaagatctctttactgaaagccaacttaagaaactataccgtagacactacaccggctggggacgcctatccgcaaaactcataaacggaatacgagacaaagaatcccagaaaacgatcttagactatctaatagacgatggccgctccaacagaaacttcatgcaattgataaatgacgacggtcggtcaaacagaaacttcatgcaactcataaacgatgacggcttgagcttcaaatcaataatttctaaagcacaagcaggaagccatagtgacaacttaaaagaagttgtaggagaactcgcaggcagtccagcaatcaagaaaggcatcctacaatcgcttaaaatcgtcgacgaattagtcaaagtcatgggatatgaaccagaacaaatagtagtagaaatggcaagagaaaaccaaacaacgaaccaaggaagaagaaacagtagacaacgatacaaactactagacgatggagtcaaaaatctagcgtcagaccttaatggtaatatactgaaagaataccccacggataaccaagcacttcaaaatgaaaggttattcttatattacctccaaaatggaagagatatgtatacaggagaagcactcgatatcgacaatctatctcaatacgacattgaccatataataccccaagccttcataaaagatgattcaattgacaatagagtactcgtatcatctgctaaaaaccgaggaaagtcagatgacgttccgtctttggaaatagtcaaagactgcaaggtcttctggaagaaattactagacgcaaaacttatgtcacaaagaaaatatgacaacttaacaaaagcggaaagaggcggactcacgtcagacgataaggcaagatttatacaacgtcagctagttgaaaccagacagataaccaagcacgtagctaggattctggacgaaaggttcaacaacgaactagatagcaaaggaagacgaatccgtaaagttaagatagtaacactcaaaagcaacctagtatcaaactttagaaaggaatttggattctataaaataagagaagtcaataattaccatcatgcacatgacgcctatttaaacgccgtagtagcaaaagcaatccttacaaaatatcctcaactagaacctgagttcgtatatggcgactaccctaagtataatagttataagaccagaaaatcagcaacagaaaaactattcttttactcgaacatcatgaacttcttcaaaaccaaagtaacccttgccgacggtacagttgtagtaaaagacgacatagaagtaaataatgacacaggtgaaatagtctgggacaagaagaaacactttgcaacagtaagaaaagtactaagttacccgcaaaataatatagtcaagaaaacagaaatacaaacaggaggattctcgaaagaaagtattctagcacacggaaattccgacaaacttatcccaagaaaaaccaaggacatctatctagaccctaagaaatatggtggattcgattcaccaattgttgcctacagcgtcctagtagtagcagacataaagaaaggaaaagcacaaaaactaaaaacagttacagaactcttaggaattactattatggagcgatccaggttcgagaaaaaccccagcgccttccttgaatcaaaaggatacctcaacatacgcgcagataaattaataatacttcccaaatacagtctattcgaactcgaaaacggaagaagacgtttattagccagtgcgggagaactacaaaagggtaatgaactagccttacccacgcaatttatgaaatttttatacctagcatctcgatacaatgaatcaaaaggtaaacctgaggaaatagagaagaaacaagagtttgtaaaccaacatgtttcctactttgacgacattttacaactaataaacgactttagcaaaagagtaatcctagcagatgctaatctggagaaaataaataaattatatcaagataacaaggaaaacatcagtgttgatgaactcgcaaacaacattataaatctctttacattcacaagcctcggagcaccagcggccttcaaattctttgacaaaatagtagaccgtaaaagatacacctcgacaaaagaagtattaaactcaaccctaatacaccagtcaataactggattatatgaaacaaggattgacttaggaaaactgggtgaagattga

SEQ ID NO: 5541 - RNA, 4155 nt, synthetic construct
  misc_feature 1..4155: note = Cas9 variant
  source 1..4155: mol_type = other RNA
atgaaattgcgtggtattgaggatgactactctataggattagatatggggacgagttcggtcggatgggccgtcaccgacgaaaggggaacgttggcacattttaaacgtaaacctacatggggatcaaggttatttcgagaagcccagactgcagccgttgcacgaatgccaagggggcaaagaagaagatatgttcggagaaggtggagactagatttattacaaaaactctttgaacaacaaatggaacaagctgatccggacttctttatacggctaaggcaatcaaggttgctacgagacgacagagctgaagaacacgcggactatagatggccactctttaatgactgtaaatttactgaaagagactattaccaacgatttccgactatatatcatgtaagatcatggttaatggaaaccgacgaacaagccgatatacgactgatatatttagcactacataacatagtaaaacacaggggaaactttcttagagagggacaaagtctatccgcaaagagtgcaagacccgatgaagcattaaatcacttaagagaaacactcagagtatggtcctcagaacgcgggtttgaatgtagcatagcagataacggttccatattagcaatgttaactcatccggacttaagtccttctgatagaaggaagaaaattgcacctttattcgatgttaaatccgacgatgccgcggccgacaaaaagctaggaattgcgctagctggagctgtaataggcttaaaaacagaatttaaaaacatttttggtgattttccttgtgaagatagttcgatatacctgagcaatgatgaagcagttgatgcagtacggtctgcttgtccagatgactgtgctgaacttttcgacaggttatgcgaagtatatagcgcatatgtcctacaagggcttctcagttatgcaccaggacaaaccataagcgccaatatggtggaaaaatacagacggtatggagaagatttagccttactgaagaaacttgtcaaaatttacgccccagaccaatacagaatgttcttctcaggagcaacttaccccggtacaggcatttatgatgccgcacaggcaagaggatatacaaaatataatctgggtcccaagaaaagtgaatacaaaccttcggaatctatgcaatatgacgacttccgaaaagcagtcgagaaactattcgctaaaacagatgcgagagccgacgagagatatcgaatgatgatggacagattcgataaacaacaatttcttagacgactaaaaacatcagacaacggttcgatttaccaccaattgcatttagaagaactaaaagcaatcgtagaaaatcaaggaagattttatccttttctaaaaagagacgcagacaagctagtgtccctagtatcatttaggataccgtattacgtaggaccattatccacaagaaacgctagaacagatcaacatggagaaaacagatttgcttggagcgagagaaaacctggtatgcaagatgaaccgatatttccatggaattgggaatctattatcgatagatcaaaaagcgctgaaaaatttatactacgaatgactggtatgtgcacatatcttcaacaagaacctgttttacctaaaagttcattattatatgaggagttctgcgtacttaatgaactaaacggtgctcactggtcaatcgacggtgatgatgaacataggtttgacgctgcggatcgtgaaggaataatagaagagttatttcgacgaaaaagaactgtttcttatggcgatgtcgcaggatggatggaacgcgaaagaaaccaaataggagcacacgtctgcggtggacaaggcgaaaaaggatttgaatccaaattaggaagctacattttcttttgtaaagacgtttttaaagtggaaagattagaacaatctgattatcccatgatagaaaggataatattatggaacacacttttcgaagacagaaaaatattaagccaaagattaaaagaagaatacggaagtcgattatcagctgaacaaataaaaactatatgcaaaaagaggtttacaggctggggaagactcagtgaaaaattcttaacaggcattaccgtacaagtcgatgaagacagtgtctcgataatggacgttctacgagaagggtgtcctgtatcagggaaaagaggtagagcaatggtcatgatggagatcctacgcgatgaagaactgggatttcaaaagaaagtagatgactttaatcgagcatttttcgctgaaaacgcacaagcactaggagtaaacgaattacctgggtcaccagcggtacgacggtcgttaaaccaatcaattagaatagttgacgaaatagcctcaatagctggcaaagcaccagctaatatatttatagaagtaactcgggatgaagatcctaaaaagaaaggtcgaagaacaaaaaggagatataacgacttgaaagacgcactagaggcatttaaaaaggaagaccctgaactttggagagagttatgtgaaacagcaccaaacgacatggatgaaagattaagcctatatttcatgcaaaggggaaaatgtttatacagtggtagggcgatagacattcaccagctatcaaacgctggtatatatgaagtggatcacataattcctagaacatacgtaaaagatgacagccttgaaaacaaagccttagtatacagggaagaaaaccaaagaaagaccgacatgctattgatagatcccgaaataagacgacgaatgagcggatattggcgaatgttgcacgaagcaaaacttattggtgataagaaatttcgaaacctcttgaggagcagaatagatgacaaagcattaaaaggattcatagcacgacaattagtggaaacaggtcaaatggtaaaactcgtgagatcactattagaagcgagatatccggagaccaatataataagcgtaaaagcatccataagtcatgatctaagaacagcggcagagctagtcaaatgtagagaagcaaacgattttcatcatgcgcatgatgcattccttgcatgcagagtgggactatttatacagaaaagacacccgtgcgtatatgaaaacccaattggattgtcgcaagtagtaagaaattatgtaaggcaacaagcagacatctttaaaagatgtaggactattccgggatcatctggctttatagtaaactcgttcatgacatcaggatttgataaagagacgggagaaatcttcaaagatgattgggatgcagaagctgaagttgagggaattagaagaagtttaaatttcagacaatgttttatatcgagaatgccctttgaagatcatggtgtattttgggatgcaactatatacagtccacgagctaagaaaacagctgcacttcctctaaaacaaggtctaaacccgtctagatacgggtccttttctagagaacaattcgcctatttctttatttataaagctcgaaatccaaggaaagagcagacgctttttgaatttgctcaagtacctgtgaggttaagtgcacaaatacgacaagacgaaaacgcattagaaaggtacgctagagaattagctaaagatcaagggctagaatttataagaattgagagatcaaaaatattaaagaaccaactaattgaaatagatggcgataggctatgtataacaggaaaagaggaggttcgaaacgcatgtgaattagcatttgcacaagacgaaatgagggttatacgtatgttagtcagtgaaaaaccagtgtctcgcgagtgcgtaattagcctttttaatcgtatcttactacatggtgatcaagcatctcgccgactcagtaaacaattaaaattagcactgctcagcgaagcattttcagaagcaagcgacaacgtgcaaaggaatgtagtactaggcttgattgctatttttaacgggagcacaaatatggtaaatctcagcgatatcggcggcagtaaatttgccggtaatgtcagaatcaaatataagaaagaattagcatcaccaaaagtaaatgtacatctgatagatcaatcagtaacaggaatgttcgaacgcagaacaaaaatcggtctttga

SEQ ID NO: 5542 - RNA, 4158 nt, synthetic construct
  misc_feature 1..4158: note = Cas9 variant
  source 1..4158: mol_type = other RNA
atgacaaaaccgtattcaatagggctcgacatagggactaactcagtcggatgggcagtaattacagatgactataaagtaccctcaaagaagatgaaagtacttggaaatacaagcaaaaaatacattaaaaaaaacttattaggtgcattgctatttgactcaggaataaccgctgaagggcgtcgactaaaaagaacggctagaagaagatacacacgaagacgaaatcgcattttataccttcaagaaatcttctcaaccgaaatggcaaccttagacgatgctttcttccaacgcttagacgattccttcctcgtccctgatgacaagcgagattctaaatatcctattttcggaaacttagtagaagaaaaagtttatcacgatgagtttccaacaatataccatctcaggaaacacttagctgattcatcgaaaaaagcagaccttagactcgtctacctagcattagcacatatgataaaataccgaggacatttcttaatagaaggagatttcaattcaaaaaataatgacctacaaaaaaattttcaagattttctagacacatataacgctatattcgaaagtgacctaagcctcgaaaactccaaacaattagaagaaattgtcaaagacaaaatttccaaatcggcaaagaaagatagaatactaaaattattcccaggagaaaaaaacagcggtatattttcagaatttctaaagctaatagtcggtaaccaagccgacttcagaaaatactttaatctagacgaaaaaaccagcctacagttttctaaagaaagttacgatgaagatctagaaacgcttcttggccatataggagatgattattcagatgtgtttctcaaagccaaaaaattatatgatgcgatcctactatctggaatccttacagtaaccgacaatggcacagaagctccactcagttccgcaatgataatgagatacaaagaacacgaagaagatcttgcccttctaaaagcatatatcagaaatattagtttagaaacttacaatgaggtctttaaagataacaccaaaaacggttacgcaggctacatcgatggtaaaacaagccaagaagatttttatgtctaccttaaacgattactagcaggtcttgaaggggctgactatttccttgagaaaattgaccgagaagatttcctgagaaagcagagaacattcgacaatggatccataccatatcaaatttatttacaagaaatgagagcaatattagacaaacaagctaaattttacccatttctagcaaaaaacaaagaaaggatagaaaaaatattaactttcaggataccctattatgtgggccccttagcgcgtggcaactctgattttgcttggtcaatacggaaacgaaacgaaaaaataactccatggaatttcgaagatgtaatcgataaggaaagtagcgccgaagcattcataaaccggatgacatcgtttgacctatatcttcccgaagaaaaagtactcccaaaacacagtctcctttatgagaactttaccgtttataacgaactaaccaaagtaagattcatcgcagaaggaatgagggattatcaatttctcgacagcaagcaaaaaaaagatatagtccgactttactttaaaggaaaaagaaaagtaaccgacaaagacatcatagaatatttacacgccattgacggatacgatggaatcgaactaaaaggaatagaaaaacagttcaactcatccctttcaacctatcatgaccttttaaacataataaacgataaagaattcctcgatgacagctctaatgaaacaatcatcgaagaaattatccacaccttaacaatgtttgaagacagagagatgatcaaacaaaggctatccaaatttgataacatttttgataaatctgtattaaaaaagctttcacggagacactatactgggtggggaaaattgagtgcaaaactaatcaacggaatccgtgacgaaaaaagcggaaatactatcttagactatttaatagatgatggcgtgtccaatcgaaacttcatgcaactaatccatgacgatgcactctcctttaaaaaaaaaattaaaaaagcacaaatcatcggcgataaagataatattaagcaagttgtaaaatcactacctggtagtccggccataaaaaaaggaattctacaatcgatcaaaatagtagatgaattagtcaaagtaatgggtcgagaaccagaatccattgtcgtagaaatggcaagagaaaatcaatacacaaaccaaggaaaatcaaactctcaacaacgcttaaaaaggcttgaggaaagtctaaagggattaggatccaagatactaaaagaaaatgttcccacaagactttcaaaaattgacaataatgcactacaaaacgatagattatatttatactatttacaaaacggaaaagacatgtatacgggagaagaactagacatcgatcgactatcaaattatgatatcgaccatattataccacaagcctttctaaaggatgactccatcgacaataaagtccttgttagttcagctagtaacagaggaaaatccgacgacgtaccgtcactagaagtcgtaaaaaaacgaaaaacattatggtaccaattactaaaatcaaaattaatctctcaacgtaaatttgataatttaaccaaagcagaacgaggtggcctatcccaagaagaaaaagcaggatttattcaaagacaactagttgaaacacgacaaattaccaaacacgtcgccagattactggacgagcgatttaacaacaaaaaagatgaaaacaatagaaccctaagaaccgtaaagataataactctcaaatcttctttggtatcacaattcagaaaagactttgaactatacaaggtaagggaaataaacgacttccatcacgcacatgatgcatatttaaacgccgtagtcgcctcagcattactgaaaaagtaccctaaattagaaccagaattcgtatatggggattaccccaaatacaattcatttagagaaaggaagtcggccactgaaaaagtgtatttctattcaaacataatgaacatcttcaaaaaaagcataccgctggcagacggaacagtaattgacagaccactaatagaggttaacgaagaaacaggagaaagtgtttggaataaggtcgcagatctcaacaccgtaagaaaagtgctttcctacagtcaagtaaatatagtaaaaaaagtagaagaacaaaaccacggcttagaccgaggaaagccaaaaggactcttcaacgcaaatctaagtagcaaacccaaaccaaatagtaaagaaaacttagtgggagcaaaagaatatttagaccccaaaaaatacggaggatacgctggaatatcaaatagtttcgcaatactagtaaaaggaaccatcgagaagggcgcaaaaaaaaaaataaccaatgtactggaatttcaggggatatccattttagaccgaatatattacagaaaagataagttaaattttttactcgagaaaggttataaagatattgaattaataattgaactccctaaatattcattgttcgaactaagtgacggttccagaagaatgttagcatcaatactcagcacgaataacaaaagaggagagatacataaaggcaatcaaatattcatatcacaaaaattcgtaaaattgctataccatgctaaacgcatatcttccacatttaacgaaaaccacagaaaatacgtagaaaatcacaaaaaagaatttgaagaattattctattatatcttagaatttaatgaaaattacgttggagctaagaaaaatggagaattactaaaatcagcatttcaatcgtggcaaaaccactccatcgacgaactatgttcatcattcatcggaccgacaggcagtgaacgaaaagggctatttgaactcacgtcaagaggtggagcagcagacttcgaattcttgggagttaagattccaagatacagagactacacgccatccagcctattgaaagatgcaacgctaatacatcaatcagtcacagggctttacgaaacacgaatcgacctaggcaaactaggcgaggactga

SEQ ID NO: 5543 - RNA, 4158 nt, synthetic construct
  misc_feature 1..4158: note = Cas9 variant
  source 1..4158: mol_type = other RNA
atgcaaacatactttggaatgaagaaaatattaggattagatcttggaacaaactcaataggctgggccctagtaaacgaagccaacgatgacaacgaaaaatctagtataataaaacttggagtaagagttaatcctctaactgtcgatgaacagtcaaatttcgaaaaaggaaaatccatcaccactaacgctgaaaggacaataaaacgctcaataagaagaagtttgcaacgttataaactgcgaagagaaaatctaatcgaaatcctaaaggaacacaattttatcacagatgataccatattatccgaagacggaaacgcatctacatttgaaacgtacaggctaagagcaaaagcagcatccgaaaaaatatcgctagaagagcttggccgcgttttattaatgattaacaaaaaacgaggttacaagtcatccagaaaagcaaaaaaccaagaagaaggacaactaatagacggaatggaagtagccaaagaactctacgaaaagaatatcacccctggtcaattcgtatttcaactattaaaacagggaggcaaattcattcccgacttctaccggtccgatcttcaagcagagtttgacaaaatttgggaatttcaaaaattattccatgctgaaattctagtagatgacttcaaaaaacagttagaacgaaaaggaaaactaaattcaagtaaaatattccttggacggtttggaatatacaccgcagaaaataaaggaaatgacaaacgactccaggcttaccaatggagagtagatgcccttacgaaagaattaacgaaagaagaattagcatatgtaataagcgatttaaacgggatcatttcaagctcaagcggatacttgggaagtatatcagataggagcaaagaactatatttcaacaaccaaacagtaggacaatttctaatggcacaattagaccattcaccacacacaagtcttaaaaatcaagtgttttaccgacaagattatctagacgagttcaatacactatgggaaaaccaagcgcattaccataaagtacttaccagcgatttgaaaagtgaaattagggatgtaataatattttatcaaagaagacttaaaacccaaaaaggcttaataagtttctgcgaattcgaaagtaggaaaatcgaagtagaaatcgatggcaaaaaaaaaatcaaaaatgttggatcccgagtatgccctaaaagcagccctattttccaagaattcaagatatggcaaattctcaacaacattgaattactagaaaaaagcagtaaagcaaaaagatttttagaccaagaagaaaaagaactattatttaaagaactaagcataaagagtaaaatctcgaaatcagatgctctaaaacttctcttcaaaaattcaagagaactcgacttaaattacaaggaaattgaaggtaatagaacgcaatcagcgctattcgacgcatatagcaaaattatagaattaagtggacacggagaatacgatttctcaaaaatggaggcctctaatatcatagaactagtgcaagaagtattcaccggattgaactataataccgaaatactctatttcgattcgtcattagaaggtaaagatttcgaaaaccaaccaatgtaccgactatggcacttgctatacagttttgagggagacgattccaaaacaggaaacgaaaaattgataaataaactaagcgaactatacggattcgagaaaaaatacagtattgtcctcgcaaacgttagcttccaagaagactatggatcactatcaaccaaagccatcagaaagatacacccttatttaaaagaaggaatacaatacgatgtagcatgcgaatttgcaggttaccgtcattcaaaaagtagtctcaccaaagaagaaatcgaaaataaaatacttaaagaccaattggagattctaccaaaaaacagtcttaggaacccagttgtagagaagatattgaatcaaatgattaacgtggtaaatgccctaaacgaatcatacggcaaaccagacgaaattagaatagaattagctagggaattaaaaaaaagtgcaaaagaacgtgaagaactaaccgcatcaataggagaaacaacaataaaacatgaaaaatatagagccatactcgagaacgaatttggtatttcacatgtaagcagaaacgatataatccgatataaattatatctagaactagaaaacagaggatacaaaactctatattctaatacctatgtatctcaagaaaaactgttcagcaaagaatttgacatagaccacatcataccccaaagctgtctcttcgacgacagtttttctaacaaaaccctagaatcaaaatcagtaaatatagaaaaaggcaatgacacagccttcgattatgtgttcgcaaaatatggtgaagccggcctctcggactacataatacacatcgaggaattgttcaaagacggaaaaatttctaagacaaaactaaacaaactaaaaatgaaaggtaatgagataccaagcgacttcatcgcccgtgatattagagatacacaatatattgcccgaatagcaaaaaacatactggaagagacagtcagaaacgtcgtatcaactagcggaagtatcacagatagattaagagaagactggcaactcatagacgtaatgcaagaactcaattgggaaaagtactcagcgcttggactcacggaaatatacgaaaatagagaaggccatacaataagacgaataaaagactggactaagagaaacgaccaccgtcaccacgcgatggacgcattaacaatcgcatttacaaaaagatcgcacattcagtacttaaacaatttaaatgctagatctgacaagtcaggctcaatctatggaatcgaaactaaagagctctatagagacgaccacggaaaacttaaatttaaaccaccaataccattaaatgaattcagggctgaagcgaaaaaacacctagaaaatacactaatttcgataaaagcaaaaaacaaagtagctaccataaatatcaacaccacctccaccaaagaaggaaaaaacaaaaaacggcaattaacgccacgaggccaactccacctggaaacaatatacggctcaatacagcaatatgtaacaaaacaagaaaaagtaggagcaagctttaatgaggagcaaataagcaaagtagccaaacaaaaatacagacaggcattactgaacagactccgagaattcgacaatgaccccaaaaaagcctttacgggaaataatagtttcgaaaaaaacccgatatacttagacgtactacaaacacagaaagtacccgataaagttgaaacagtctcaaaagaaattatctacacaattcgtaaagacataacgccagaactcaaaatagaaaaagtaatagataaaaagattaaaacaatattacaatctagactaaatgaatattccggtgattccaaaagagcattctccaatttgaaagaaaacccaatatggctaaaccaagagaaaggcattgaaataaaaagggttacaatatcgggaatttcaaacgcagtcgcaatacatgacaaaaaagacaagaacggaaatctaatactcgataacgagggaagtacccaagcagtagacttcgtaaacaccggtaataatcaccacgtagcaatatacaaggacgaaaggggaaacctacatgaatcagtcgtatctttcttcgaagcctgtacacgagtcaacttaggtggaccggtgatatttaaaaactataacaagtcagacgggtgggaatttctatttagcatgaaacaaaacgaatattttgtctttcctaatgagaagaccggattcaaccctaatgaaattgacctactcgatccagacaactatcgactaatctcacccaacctcttcagagtacaaaaaatcagttcaaaaaactacgtattcaatcatcatttagagacatcagccattactggtgaaaccttaaaaaacaagaaacagctatcaagtgtgacttatcattttatacaatctttgccgccgataaaagatatcgtaaaggtcagaataaacaacatcggccaaatcgtttgggtcggagagtactga

SEQ ID NO: 5544 - RNA, 4158 nt, synthetic construct
  misc_feature 1..4158: note = Cas9 variant
  source 1..4158: mol_type = other RNA
atggacgaacttcaaaactttgaaaaaggcaaaagtattacaaccaatgcagacagaacagctgggcgaagcatgcgaagaaacttacagcgttacaaactaaggagagaaaacttaatagaagttctaaaagaatacaattttataactgatgaaatgatactcagcgaaaatggaaacaggacaacttttgaaacctacagactgcgagctaaagcagccgtggaagagatatccttagaacaattcgctcgtgtattactcatgataaataagaaaagaggatataaaagtagtaggaaagctaaaggcgctgaaaacggaaccctaatcgatggaatggaagtagcgaaaaagatgtatgacgaaggaataacaccaggagaattgtgtttacaacttctaacggcaggaaaaagatacttccctgacttctataggagcgatttgcaggccgaatttgatagaatatggaactttcagaaacagttttacccagatagcctaatagataaagtaaaagacgaagtccgcggcaaaaacaaatcccagacatgggcaatactagcaaaatacttcgtttggaaagaagttgaaaattcgtggaatgaagaagaagcccaaacaagaagagtagaaaaggaataccgcctagtaggaataaagagaggagtaaagagagaggaactaaaattagaaaattttcaatggagagtaaaagcattaagtgaacgaatgaatcccgaagaattagcaatagtattacaagaaattaacgaacaaatatcaaatagtagtggatacctaggagctatttcagatagaagcaaggagctgtatttcaaccgacaaacagtaggtcaataccaaatggcggtcctagataacaatccgaatataggattacgtaacatggttttctacagacaaggatatttgggagagttcaacactatctgggaaaaacaagcggagttccacaaggaactaacggaagacttaaagaaagaaattagggacatagtcattttctaccaaagaagactaaaatcccaaaaaggattaataaatatctgcgagttcgaacgtcgtcaaattgaagttgaaattgatggaaagaagaaaataaaaaccataggctcaagggtaatcccccgaagttcgccattatttcaagagttcaaaatatggcaaacgctaaatgacatcgaagtctccgtactcggggtcaaaaacaaacgaaagaaacaagatgataattctaccacactcttagactcagcagaaaatatagattcactaaaattaaatgtatctagacctttagatgcggatgagaaaagtttattagccaaagaactatttataagagacaaattaaccaaatcggatgtcttaaaactactattcaacaatccacaaaatctgaatctaaattttaagaatatagatggaaacagaactggtagtgctctatatcaagcattcagcaaaatactcgaaatttcaggccatgaaagcataaattttaagaaatcagcagatgaaatagtagaacaagtaaaaacaatcttttcagccttaggatggaacacagaagtactttgtttcgactcagaaaaagaacttgataaacaaccttactttaaattatggcacctactttacagtttcgaaggagacagcacacccacaggagatggaaatctaattcagaaaatagccgacctttgtggatttgaaaaagattatgcgagcattttagcaaacataacgttccaagaagactacggaagtttatcaaccaaagctatacgtaaaatactaccacatcttaaagacggaaatcaatatgacgtagcctgtgaatacgcaggatataaacatagcaagtcttcattgaagaaagaagaaatcaaaaacaaggtactaaaagataaattagaattactccctaaaaactcactcagaaacccagtagttgagaaaatattaaaccaaatggtaaatgtaataaatgccatcataactacctatggcaaaccagatgaaattcgtatagaattagcaagagaactaaagaagaaagcgaagaaaagagaagagttaacaaaaactatagtagatacaacaaaaacacacgaaggaatacgagcgatattacaaaacgatttcggaatgtcacacgtttcgagaaacgccataataagatataaattatatgaagaactaaaagataatggatataaaacactgtattcaaacacctatatacctaaagaaaaattattcagcaaagacttcgatatcgaacacataattccacaagcacgattattcgatgactcgttttccaacaaaacgttggaggtcaaatcaataaacatcgaaaaaggctcaaaaacagcatatgatttcgtagaagaaaaatacggcgaacaaggactacaagagtacttgaacaggtgtgaggtcttgttcagggacaagaaaactaaactaagaaaattaaaaatgcaagaaagtgaaatccctgaaggtttcattgatagagacctacgaaatacgcagtacatcgcaaagaaagccctatcaatgctaaacgaaatctgcagacgcgtagttgcaacgaccggagcaataacagatgaattaagagaagactggcaattagtcgatgttatgaaagaattaaactgggaaaaatacaaagtcctagggctagttgaatatttcgaagataacgacggaagattaattggaagaataaaagattggacaaaaaggaacgatcacagacatcatgctatggatgcgctaacagtagcatttactaaagacgtatttattcagtactttaataacaaaaacgccagtttaaagcctgatacaaacgaagcagcaattagaaacaagtatttccaaaacggaaaagcaatcccgccaatgtcccttgatgagttccgagcagaagcaaagaaacatttaaatgatactttaatcagtataaaaacgaaaaacaaagtagtaacaataaatctaaataggacgaaaaagaaaaacggaataaataagaaacaacaacaaaccccgagagggcaacttcatctggaaacagtatacggatcccacaaacagtacgtcgttaaagaagaaaaagttaatgctagtttcgacgctgccaaaatagcaacagtaaacaaacccgcttatagggatgcccttcttagaagattacaagaaaacggtaatgattccaagaaagcatttaccgggaaaaattcactagataaacaacccgtgtggttagacgcaaaacaaaatgaatgcgtacccgaaaaagtaaaaacagttatgttagaaacggtatacaccgtcagaaagccaatagatgaaaaattaaacgtagacaaagtcgtagatgcccgaatcagaaaattacttcaggacagaattaaagaatatggaaacgccaagtccgcctttgctaatctagatgaaaatccaatatggttaaataaagaaaaaggcataacaattaaaagagtaagtgtaagtggaatctcaaaggcacaatctttacatgaaaagaaagataaagatggaaactttatattggacaaagattctaggaggataccagtcgatttcgtaaatacaggaaataaccaccacgtggctatttatagaaaacctgttttagataaaaagggtcaagcagttttcgacgagaatggagagttaaagttcgagttagaagaagtagtagtcagctttttcgacgcagtaacacgagtaaatttatcacaacctataatagataaggattataaacgatcagaaggatggaaattcttatttagcatgaaacagaatgaatatttcgtattcccaaacgaaaagaccggatttgacccaaaggaaatagatttattgaatccagaaaactatgcattgattagtccgaatctattccgggtacagaaaatagcaagcaaagattatgtattcaggcaccacctcgaaaccgtagttgccgatagaaaagaattacaagaaatcacatggaagcgaatcagctcgctttcaatattaaacagaataataaaagttcgagtaaaccacataggtcaaatagtgatgataggagaatactga

SEQ ID NO: 5545 - RNA, 4158 nt, synthetic construct
  misc_feature 1..4158: note = Cas9 variant
  source 1..4158: mol_type = other RNA
atgacaaaaccctacagtatcggacttgacataggaactaattccgtagggtgggccgtcataacagatgactataaagtaccaagcaaaaaaatgaaagttctgggtaatacatcaaaaaagtacattaaaaaaaatctattaggcgcgttactctttgactccggtataacagcagaaggcagacgtcttaaacgaacagctagacgcagatacacgaggcgacgcaacagaatactatatctacaagaaatttttagcactgaaatggcaacattagatgacgcctttttccaacgcttagacgacagtttcttagtgccagacgacaagagagattcaaaatatccaatattcggaaatctagttgaggaaaaagcctaccacgatgaattcccaacaatctatcacctccggaaatatctagccgatagcacaaagaaagcggatctccgattggtctatctcgcactagcacacatgatcaaatatagaggtcactttttaattgagggcgaatttaacagtaaaaacaacgatatacaaaaaaatttccaagatttcttagacacatacaatgcaattttcgaatctgacctaagtttagagaactcaaaacaactcgaagaaatagtaaaagacaaaatatcaaaaagtgcaaaaaaagatagaattctaaaactattccccggggaaaaaaattcaggaatattcagcgaatttttaaagctgatagtaggaaaccaagcagactttaaaaaatatttcaacttagatgaaaaagcacccttacacttttccaaagaatcttacgacgaagatcttgaaaccctattaggatatatcggcgatgattatagcgatgtttttcttaaagctaaaaaactttacgatgcaatactactatcagggatactaaccgtaacagacaatggtacagaagcaccattatcaagcgcaatgataatgcgctacaaagagcatgaggaagatctagcattattaaaagcctacattcgtaacatcagtttagaaacatacaacgaagtatttaaagacgatacaaaaaatggctacgccggatacatcgatgggaaaacatcacaagaagatttttacgtacatctaaaaaagctcctagtaggactggaaggtgcggattatttcctagaaaaaatcgacagagaagacttccttcggaagcaacggacctttgataacggaagtattccatatcaaatacacttacaagaaatgcgagcaatcctcgacaaacaagccaaattttaccctttcctagcgaagaacaaagaacgcatagaaaaaatactaacatttagaataccatactacgttggacctcttgcccgaggcaacagtgacttcgcgtggtccatccgcaaaaggaatgagaaaataacaccttggaatttcgaagatgtcatagataaagaatcaagtgcagaagcttttataaatagaatgacgagctttgacctttatctaccagaagaaaaagtactacctaaacatagtctgctgtacgaaacatttaatgtctataatgaactaactaaggtacgatttatcgcagaatctatgcgtgactatcagtttctcgacagcaaacagaaaaaagatatagttcgcttatactttaaaaataaacgcagagttacagacaaagatattatagaatatctacacgctattgacggttatgacggcatagagctaaaaggtatagaaaaacaatttaactcgtcattaagtacttatcatgacctactaaacataataaatgacaaagaattcctagatgactcttccaacgaagcaattatagaagaaataatacacaccctcacgatctttgaagaccgcgaaatgataaaacagagattatcaaaattcgaaaatatttttgataaatcagtcttgaaaaaattatccagaagacactatacaggatggggcaaactatccgccaaattaataaatggtatccgcgatgaaaaatcaggtaacacaatcctagattacctaatagacgatggcgtatcaaatcgaaacttcatgcaattaattcacgacgatgctttaagttttaaaaaaaaaataaaaaaagctcaaattatcggcgacaaagataatataaaacaagtcgttcaagcacttccaggtagacctgcaattaaaaaaggaatactacaaagtataaaaatcgtagatgaactcgtaaaagtaatggggcgaagacctgaatcaatagtagtagaaatggcaagagaaaaccaatacaccaatcaaggcaaatccaactcacagcaaagactaaaaagactcgaggaatctctcaaagaattagggtctaaaattctcaaagagaatatccccgcaaaactctcaaaaatcgacaataacgcgctccaaaacgatcgcttatacttgtattacttacaaaatggaaaggacatgtataccggtgaagaattagatattgataggctatcaaactatgatatagatcacattataccacaagcattcctcaaagataattcaatcgacaacaaagtactagttagcagcgctagcaacagaggaaaatcagatgacgtcccatcactagaagtagtaaaaaaacgaaaaactctgtggtatcaactccttaaatcaaaactaatctctcaacgaaagttcgacaacctaacgaaagctgaaaggggaggactatcaccagaagctaaagcaggatttatccagagacaattagtcgaaacgagacaaataaccaaacacgttgctagactgttagatgaacgcttcaacaataaaaaagacgaagataacaaaacactacgaactgtaaaaatcatcacactcaaatcaagtttagtctcacaattcaggaaagatttcgaactatacaaagtaagagaaataaacgacttccatcacgcacacgatgcctatctgaacgcagtcgtagcctctgcgctattaaaaaaatacccaaaactagaacctgaatttgtatacggggactatccaaagtataattcatttagagaaagaaaatcagcaacagaaaaagtatacttctactcaaacataatgaatatattcaaaaaaagcatatcactcgctgacggcacagtaatagaacgaccgttaatagaagtcaacgaagaaaccggcgaaagtgtctggaacaaagtagctgatttaaatacagtaagaaaagtattaagctacagtcaagtaaatatagtcaaaaaagttgaagaacagaatcatggactggaccgaggaaaaccaaagggactatttaacgccaacttaagttcaaaaccaaagccaaacagtaaagaaaacttagttggagctaaagaatatttagacccaaaaaaatatggaggatacgcaggtataagtaacagtttcgcagttttagtaaaaggcaccattgaaaaaggagcaaaaaaaaaaatcacaaatatactagaattccaaggaatatcaatattagacagaataacatacagaaaagacaaatttaactttctactagaaaaaggatataaagacatcgacttaataatagaactgcccaaatattccttattcgaattaagcgatgggagtaggcgaatgctagcgtcaattttatccacgaacaacaaacgtggagaaatacacaaaggcaatcaaatattcatatcacaaaaatacgtaaaattactttaccatgcaaaaagaattagcaatactttcaatgacaatcacagaaagtacgtagaaaatcataaaaaagaattcgaagaattattctattacatactagagtttaatgaaaactacgtgggcgctaaaaaaaatggagaattactaaaaagcgcctttcaatcgtggcagaaccattctattgatgaactctgctcctcctttatcggtccaacaggatctgaaagaaaaggactatttgaacttacctcccgaggaggcgcagcggactttgacttcctaggcgtaaaaataccaagataccgagactatacacctagttcactactaaaagatgcaactctgatccaccaatcagtaacaggtttatatgaaacccgaatagatctaggaaaactaggtgaagactga

SEQ ID NO: 5546 - RNA, 4158 nt, synthetic construct
  misc_feature 1..4158: note = Cas9 variant
  source 1..4158: mol_type = other RNA
atgaaaaataaaacttggtatctaggattgggagtaggaccaacaagcataggatgggcagcaactgatagcaactataaactactacgtaaaaacaagaaacggctatggggagtaagactctttgaagaagccaaaacggcagtagatagaagaacattccgagcagaacgacgaagactcgccagaaggaaatggagaatatcactgctagaagaactcttcgcgaaagaagtatctaaaaacgaccccaactttttcctcaggttaaaggaatcaaaataccatttcgaagataaatcgttaatgaacgaatatatactcttcaatgataaagattataccgataaagactactacaaagaatatccaacgatatatcatctcagactgtcacttacaacagaagaaaacccagatatacgcaaagtatacttagctgtacactccatgcttaaaaaccgaggccattttctactacaaggacaatcattcaatgactcgaatatagactctgtaataaaagaactactagaactagaaacagtaaaaataaatttcgaagtcaccgacgaagtaatccactcactaaagaaaattgccctagagaagaaaaatctaagtgataaaaataacgacgtaaagaaactataccccaaagaaaaacaacttcaagaaatattcaaattggtttttggtggaaaaacgtcacttgacaaactctacgacatagaagaatacaaagaactagacaactcagtcaaaagcatatccttcaaagaaaaagtctatgaagaagtaagaccggattacgaacaaatattgtcaaattacatcgaactcttggatttagcaaaacttgtatatgattcaatagtcttagcagacatcaagaaagaaggaaaaacgatcagtgaaagcaaagtagaattatataacaaacataaagacgaccttgccaatttaaagaaattagtaaaaattgatagtaaattatcggaagataaaaagaaagaagtttacttcaccatttttaaagaagacaaagaaaaaggaacaaattatgtgaactacactcaccgaagccaagaaggaaaatcatgttcttatgaagatttcaagaaatttttaaagaaagaactcgaaaaattagaagatagtccaacaaaaacaactattctagaagaactagacctcgaaacgtttctgcccttacaacgaacaaaagataattctgtagtcccttaccaaatacataaagaagaacttgtaaaaatactcgacaacgctgcaaaatatcacagtttcctagctgaaaaagatgattctggatatagcaccagagaaaaagttgtacaattattcgagttcaggattccatattatataggaccattaaacgcccaccacaacaccgaaaacggaggctattcttgggctataagaaagaaaggaatggaatccgtaccagtaacaccgtggaatttcaaagacgtaatcgacgaaagcgcgagcgcagaagcatttgtaaacaatcttaaaaacaaatgcgcttacctctctggagaagacgtcttacctaaaaactccctgctgtactccgaatatgctttattaaacgaactaaatgcactaagatatgaaggaaaccgaatcagcgtagaagccagggatgtaatagtaacaaaactcttcaaagaacagggcaagaaagtaacaaagaaaaccataaaagaattactaaaaactgaaggttttattgacggaaaaggggaaatagtaggaattgacaacatagttaaaaacgatctgaaatcctaccgcgatttcaagaaaatactggctgataaatttgacaaagaaagagtagaaaatataatattgtggatcaccctatacggcgaatccaggaaactaattaaagagaaaatcaccaaagtatacggagatttctacacggtagatgaaatagagaaaatgtctagactaacatacaaagattggggaatattatctagaaaattgctgactgaactggtttcagaaaaattatataacgaagaaactggcgaatgcttaaatataataggagcaatgagacaaggaacaatcctattcatggaattacttgccgataaattcgactacatgtcccaaatcaaaaatcacaacaaagaaaacaaagacgatataactgaaatcaccccagacatactggaaaatctacatgccagtcctgccgttaaaagatcaatctggcaaacagtaagaatagtagaagaactcaaaacaattatcggttgtgtccctacaaaaatctttatagagacgacaaaaagaaacaacgcaccctacaaagtacccacattgaacagaaacgacttagttacaaaatataaaacaataagagagcacgaaatttttgaactagaaaaagaactcaaaaacacactggactttacactaaacaaaaatcgattaataaacgaagaaccgtcaaaacttaaagcaacaaaattgtatctatactacacacaattaggaagatgtatgtacaccggtaagaaaatcgatctaggggaactattcgacaacaacaacaaatatgatatagaccatatatacccacaaagcaaagtaaaagatggatccttcaacaatatagtactcgtaacaaaagcgtcaaatgatatgaaagcagatgtgttccccctcaaaagtaaatttcaaacaaaagaaaataaaatattctggcgattccttaaagagaagaaattgataacagaagaaaaatataacagacttgtacgcacagaagaattttccaacggcgaactaactggattcattacgagacaattagttgaaacaagccaagctataaaagtcatatcaaatgtactaagagaactaaatccagagacaacaatctgctattctaaagcggaaaacgtatcctcatttagacaatcatttggaaaaataaaagaagcaaacagaaaagcggaaaacaacgaaaagctgatcagagttcaagaaataaacgactactacaacgcaaaagacgcctacctaagcatagtagtcggtaacgtatatgatgtaaaatttacgagaaatgtccacaattttatcaaaaataacaaggacgcaagaagatactctttaaatggacttttctatacagacgtgaagaatgctaacacgattgcatgggaaatggacaaaaccgtacacgttgtagagaaaacaatgaacaataataacatactaataacaagacggaccagcgaacaaaaaggagcattatatgatgcaacactttacaaggctaaagtcgcggaaaaagctaaagagggaacatattaccccttaaaaacaacagatagtaaaattaaagacgtcggcaaatacggcggatttacaaaaattaaaattgcctattattcaatatttgaatacacacttgatggcaagaaaggaaaacagaaaataacaagaatagttcctataccgatatacatttcacagaatataaaagatgacaaagccctattggaatatgcacaaactcgactccccggaaaagacctcaaaataaaatacagaaaactttgcataggctcattagttaaaatcaacaactttaattactacataggaggtaaaactaataacaatttcactttcgacagcgccgtacaagtaatcctcgacaaagacagtgaatcttacatcaaagaactcgcaaaatacctaaattggaagaaagaaaataaagacgggaaactatgggaatcaatcacagaagataaaaacatacaattatatgattcattagtgaagaaaatgaacaccggcatttttatccgcaaaacaccgaacaagtacaccgaactcctaacgttagaagtcaaaaataaattcataaacattgacattgacgaacaagtaaaattattactagaaatcctaaacttattaacgaataagaaattcacatctaaacttaatgaaataggaatcacagcatccagaggcgtatgttcattcaacttaagtaatcaaagtcagtttagtataatcgaacaatcagttacaggagtatacgaaaaagaaaagctaataatagagaagaagaaagaaggaatactttga

SEQ ID NO: 5547 - RNA, 4161 nt, synthetic construct
  misc_feature 1..4161: note = Cas9 variant
  source 1..4161: mol_type = other RNA
atgaatcaaaaatactcaattggcctagacataggaactaattcagtagggtgggctgtaattacagacgactacaaagtgcctgcaaagaaaatgaaagtattaggcaacaccgacaaacaaagcattaagaaaaacttgctcggagccctgctctttgatagcggagagacagcagaagctactagactgaaaagaactgctagacgacgctacacaagaagacgtaacagactaaggtacctccaggaaatattcgcagaagaaatgatgcaagtcgacgaatccttcttccaacgattagacgactctttcctagtagacgaagacaaaagaggagaaagacacccgatattcgggaacatagcggcagaggttaaataccatgatgaatttccaactatttaccatttaagaaaacatctagcagacataagtcaaaaagcagacttaagactcgtatacctagctctagcacatatgatcaaatttagaggacacttcctaattgaagggcagttaaaagcagaaaacacaaacgtccaagcattatttaaagatttcgtagaagtttacgataaaacagtagaagaatcacacctatccgagataacagtagacgcattaagtattctcacagaaaaagtatcaaaatcacgacgactcgaaaatctaattgcacactatccagcagaaaagaaaaatacattatttggaaacttaatagctctattcttaggacttcaacctaacttcaaaacaaacttccaattatctgaggatgcaaaactacaattctctaaagatacttatgaggaagacttagaaggattattaggggaagtaggagatgaatatgctgatttattcgctagtgccaaaaacctctatgacgcaatacttttatctggtatattaacagtcgatgataactctactaaagcacccttatcagcctcaatggtcaaaagatatgaggaacatcaaaaggatctaaagaaattcgaagactttatcaaagtaaacgccctcgatcagtacaacgcaattttcaaagataaaaacaagaaaggttatgcaggctacattgaaagtggagtaaaacaagacgagttctataaataccttaagggaatattattacaaattaatggatcaggtgattttctggataaaatagaccgagaagattttctcagaaaacaacgcacttttgataatggatctataccacaccaaatacacttacaagaaatgcatgccatacttcgtagacaaggagaacactacccctttttaaaagaaaaccaagataaaatcgagaaaatactcactttccgtataccatactatgtaggcccacttgctaggaaaggaagcaggttcgcatgggcagaatataaggcagatgaaaagataactccatggaactttgacgacattctagacaaagaaaaatcagccgaaaaattcattacacgaatgacactgaacgatctatatttacctgaagaaaaagtcctaccaaaacatagccttttgtacgaaacattcacggtatataacgaactaacaaaagttaaatatgtaaacgaacaaggtgaagcaaaattctttgacgctaacatgaaacaagaaatattcgatcacgtatttaaagaaaacagaaaagtcactaaagacaaattactgaattaccttaacaaagaatttgaagagttcagaatcgtgaacctgaccggtttagataaagaaaataaggtcttcaattcttcactgggtacttatcatgatttaagaaaaatactaaacaaatcatttttagataacaaagaaaacgcacaaataatagaagatataattcagaccctcaccttattcgaagacagagaaatgattagacaacgcttacaaaaatacagtgacatctttacaaaagcgcaattaaagaaacttgaaagaaggcattatacaggatggggaagactcagttataaactcattaacgggattagaaataaagaaaacaagaaaacaatattagactacctcatagacgatgggtacgccaaccgtaattttatgcaactaatcaatgacgatgcgttatcgttcaaagaagaaatcgccaaagcccaaattataggtgacgtggatgatatagcaaacgtagtacatgacttacctggatcgccagcaataaagaaaggtatcctacaatcagtaaaaattgtggatgaattagtaaaagtgatgggacacaatcctgcgaatataataatagagatggcaagggaaaaccaaacaaccgatagaggtaggagaaactcccaacaaagattaaaactactgcaagactcgctgaaaaatttagacaatccagtgaacattaaaaacgtagaaaaccagcaattacaaaacgatagactattcctatactacatacaaaatggaaaagatatgtacacaggcgaaaccttagacatcaacaacttatcacaatatgacatagaccacatcatcccccaggcttatatcaaagacgattcattcgacaatcgagtactcacttcaagctcggaaaacagaggaaaatcagataacgtcccatcaatagaagtggtttgtgccagaaaagctgactggatgcgcttacgaaaagcaggcttaattagccaacgaaaattcgataatctaacaaaagctgaacgaggcggcttgaccgaaaacgacaaagcaggattcataaaaagacagctagtagaaacgagacaaataactaaacacgtagcccaagtgctagatgcaagattcaatgcaaagcatgatgaaaataagaaagtaatacgagatgtaaaaatcataactctaaaatcaaacttagtatcacaattccgtaaagacttcaaattctataaagtacgtgagatcaacgactaccatcacgcccatgatgcctacctaaatgcagtaatcgggaccgcactcctaaagaaatatcccaaactcgcaagtgagttcgtctatggcgagttcaagaaatatgatgtacgaaaatttatagcaaaaagtgacaaagaaataggaaaagcaactgcaaaatatttcttttattctaacctgatgaactttttcaagaaagaagtcaaattcgcagacgggactgtagttgaacgacccgacatagaaacaagtgaagatggcgaaatagcttggaacaaacaaactgactttaaaatagttcgcaaagtattgtcttaccctcaagtcaacattgttaagaaaacagaagtccaaactcacggtttagatagaggaaaaccaaggggactattcaatgcgaacccatcacctaaaccaaaaccggatagctcagaaaatctagtcggcgtaaaaagaaacttagacccgaagaaatacggtggatatgccggaatcagcaactcatatgcagtattagtaaaagcaattatagaaaaaggagtgaaaaagaaagaaacaatggttttagagttccaaggcatatccatactcgatagaataacgtttgaaaaagacaaacgcgccttcttattaggaaaaggatataaagacattaagaaaataatcgaattacccaaatactcactattcgaattgaaagatggttcacgaaggatgttagcatcgatactctccacaaataataaaagaggcgaaatacacaaaggaaacgaactttttgtaccccaaaaattcacaactctcttatatcacgcaaagagaatcaataaccccatcaacaaagatcatatagaatatgttaagaaacatagagacgacttcaaagaattattaaactacgtgctcgaatttaacgagaaatatgtaggagctacgaaaaatggcgaaagactaaaagaagccgttgccgattttgattccaaatcaaatgaagagatctgtacttcatttttaggagcagtaaacagtaaaaatgcaggtctgtttgaattaaccagcctaggaagtgcatccgactttgaatttctaggcgtcaagataccaagatacagagattacacaccatcgagcctgctcaaggactccaccctcatacaccaaagtataacgggtttatacgaaacaagaatagacctaagtaaattaggagaagactga

SEQ ID NO: 5548 - RNA, 4161 nt, synthetic construct
  misc_feature 1..4161: note = Cas9 variant
  source 1..4161: mol_type = other RNA
atgactaaaataacagaagactacatagttggtttggacatcggcacaaactcatgtggatgggtagcaatggatagcaaaaacacaattttaagaatgcacggaaaaactgcaattggttcacatctattcgacgctggaaacagtgcagctgatagacgcgcgtttcgcacaactcgaagaagaataaaacgccgtaaatggagattaaaattacttgaagaaatttttgactcgcacctagccaaagtagatccgtattttttcgctagacttaaagagagcggactctcacccttagatactcgaaaaaacgtttcatcaatcatctaccccacttcgctagaagacaaaaaattttacgtagataacccaacaatataccatctaagatacaaactcatgacagaagaccgtaagttcgatctccgagaagtttaccttgccattcaccacatcgtgaaataccgaggaaacttcttgtacaacactccagttaaagcattcgaagcatcaaaaatagatgtaaaagggtcactaaaaaaactaaatgaactgtacgagggcttagactctgaattcaacgtcgaacttgacagcaacaacgccctggaaatagagaatataatacgcgacaaaaaaatcttcaaaattaacaaggtaaaagaaataaaccaacttctcagcttaaaaacagaagataaagaaaggacaaaacttatgaaagatgtctcaaaacaaatcgtaaacgccatcttaggatacaaaaccaagttcgaaaccattttactaaaagacgtcagtaaagacgaagcggatgattgggaatttaaactaaccgacgtagacgctgacaacaaattcgagaacctcataggagacttaaatgagaacgaacaagaaatactcctagtaattcgcaaactagctaacgcaataacactaagcaacatagttgaagaaggaaaaacattaagcgaatcaatgaaagataaatataaaaaacattcggatgaccttaagttgctaaaacaggttatttcggatcacccggacagggataaagcaaaaaaattggcacttgcatacgatctctacgttaacaatcgacacggaaaaattctacaagcgaaagatatcttagaaaaaaagaaaacccttagcaaagaagatttctataaagaaataaaaaaaaacctagacgactctaaagaatctcaagaaatattagacgctatatctctagattctttcatgccaaaacaaagaactaacgaaaatggagtcataccctatcaattacaccaattagaactagacaagataatcgaaaaccaaggcaaatactacccatttttaaaagaagtaaacccagtctcttcccatttaaaacaagctccctataaactagatgaattaataaggtttcgagttccctactacgtcggaccactaatatctcctaatgaatctacaaaaaataaacaaaccaagaaaaatcaaaattttgcctggatgataagaaaagaacagggccaaattacgccgtggaactttgatcaaaaggtagatcgaatggcttcagccaataaattcatcaaaaggatgacaacgatcgacacatatctactgggagaagacgtattgccagctaacagcctcttatatcaaaaattcacagtactaaacgaactaaacaacgtaaaaataaatggcaagaggataagtgtcccactcaaacaagaactgtacaataacttattcaagaaaaattcaacagtaacaacaaataaactaaagtcatatcttaaagaaaattacaagctaattaaagtagaaataaaaggtttaagcgacgaaaaaaaattcaactctggacttaccacatataacaaattaaaaaatctaaaaattttcgaccaacaaatagacgaccccaattacaacaaagactttgaacgtattattgaatggtctaccatattcgaagacaaggcgatatacaaagaaaaattaaagaccatagactggttatcagacagacagatagataaattaagcaaaattaggatgcaaggttggggccaactctcaaaaaaactactatcacaactaacagacaataacggacaaactattatagaacaactctgggactcccaaaacaactttatgcaaatagtaaatcaagccgattttaaggacgccatcgcagttgcaaaccaaaacctattagtagacacttcagtagaagacatactaaacgaggcctacacttctccagccaacaaaaaagcaatcaggcaagtggtaaaagttgttgacgatatcgttaaagcaacaagcggaaaagtaccgaaacaaatagcaatagaatttaccagagatgctgatgacaacgcaaaaatatcacaaagccgcgcaaacaaactacgcaaagtatacaaagagatgtctaatgaattagcgagtgaaactataagaaacgaactagaaagggtagcaaaagatcaaaaactcctaaaagataaacactacttatactttatgcaattagggagagacgcttacactggagaattaatagatatagacaacctcgaacaatatgatattgaccacgtactaccacaatctttcataaaggatgactctcttgaaaacagagtactagtaaaaaaagctgtcaataacggcaagagcgacaatgtcccagtcaaactatacggaaatagaatggcgacagatttaggaatgactatacgtcacatgtgggaaaagtggaaagaacaaggtctaataacaaaaactaaatacaacaacctaataatagaccccgataaaatcaacaaatatgaaagcagtggctttatacaccgacaattagtcgaaacatcccaaattataaaattggtttcgaccatccttcaatctaaataccccgatacagaaataatcgtcgtcaaagcaagatataatcactatctaagaaaaagattaaatttatacaaatccagagaagtaaacgattaccatcatgccatagatgcctacttatcagcaatatgcggcaatctactatatcaagtatacccatacctccgaccattcttcgtatacggacaatacaaaaaattttcatcagagcctgaaaaagaaaaaattatctatgacaaaacaagaagatataacttcatatcgcagatattcgaaaacaaagataatgacataatatccagagaaaccaaaaaaaaggtctttgacaaaaaagacattattgaaaaactcaaacgagcttataattacaaatacatgctagtaagtcgagaaaccgagacacacgaccaagaaatgttcaaaatgacagtttacccaaggctcagccgcgacacaaaaaaatcaagaaatctaataccaaaaaaaaaagatatgccaaccgagatctatggaggatatactaacaattctgatgcatatatgatcatagctagaatcaataaaaagaaaggaccagaatatagagttttcggtgtacccatgagagaactagtaaatttaagaaaggcagaaaaaaacggacactataaagcttacctcaaacaggtattagaaccagagataatgtactcgaaaaacggaaagaaaaataaaactataagcagcttcgaaattgtaaaagctaaagtaccatacaaacaagtcatactagatggagacaagaaatttatgctagcatcttcaacttatgtccaaaatgccaaacagctaactctttcacaatacagtatgcaagcaataacagataattgtgaaaacgacactgaagaagaaaaagcattggtagaagcctacgacgaaatattaacaaacatagataaatacctaccgttatttgatataaacaaattcagagaaaagctacacgcagggagagaaaaatttgtagatctaccattagctgaaaaaaaagagaccatattacaagtgctaaacggtttacacgacaatgcagtaatgcctaagataaaatcactaggactatcaacccctctaggtttcatgcaattccacactggcgtctcattaagtgagaacgcaaaactaatatatcaaagccccaccggtttgttcgagaagagattaaaaatttctgatctctga

SEQ ID NO: 5549 - RNA, 4164 nt, synthetic construct
  misc_feature 1..4164: note = Cas9 variant
  source 1..4164: mol_type = other RNA
atgtcggattccaaaaaattcgaaggcgaaaatgtaaaatccggcgataaaaaaactaacaaaaaccatggtaaagtcctaaaatcaagtcctaaagaaatcagaaaaaacacagaatattttataggacttgacataggcacgtcatcagttggctgggctgtcaccaacacagactacgaaatactaaaatttaatggcaagagaatgtggggaagtaggttattcaatgaagcatcaacagcagaggaaagaagaggtcaccgagtaaaccgcagaagaatacaaagaagacgagatagactaaacctgttagaagagatctttagtgaagaaatggcaaaagtggatcctgaattctttatgagacttaaagaatcaaagtttcacttggaagacaaagatgaaagaatactaggagagtcaaatataatatttaaaggaagcgaagacggagataagaaatactacgaaaaatacccaaccatttatcatctacgacataaattaatgcaaagttgcgaagatgtagacataagggaattatatatggcattacatcacatcataaaatacaggggccactttctattcaaaggagattttgaagaaaccggcactagcatagaaaacataataattgaattactagaactaattaataataacctaggagtaaaaaaattcgaatataacgaaagtctaattaatgaattgaaaaacatagtgagtaatacgagcaacaccataaccaacaaaaaaaagctactcggcgagtttttcaacaaaaaagaatacaaagcacacaagagtttattcatcttatcaatcggagccagtgtgaaacccgtagacttatttctagaggaagaatacaaagacatagatgatataaaaaatatcagtttcaagaatttagaatacgatcaagtacgcgatacctatgaatcgatttttttagacaaaatagaattcatcgacgtagccaaaagattatacgacgctacgattctcctgtcaataaaaccagaaggaaaaacattaagtgaagctaaagtagacatatataacaaacaccacaacgacttagaactactgaagaaagtcttaaaaacagacaaagagaaatatgactctatcctaaagctagatatcaagaaaggtaacaattacgtaaactacgtcaaaaaaagtaaaaacggtatatcatgtagtaaagaagaatttcacaacgctctcaagaaagtactagttaaaatagaaaaaacagatgacataaaatatatacttaatgaaatagaactggaacgcttcctaccattacaaagagtcaaagacaacagtgtcatcccctaccaaatccacagatatgagttgaaaaaaattcttgagaatgcaagcaaaaagtttacttttttaaatgaagaatcagatggccacacaaacatcgagaagataataaaaataatggaataccgcataccatactatgttggccccttgaatgatcaccacagcgtatataacaatggttttgcatgggtaagcagaaaaagaagtggaagaatcaccccctggaacttcgacgaaatggttgacaaagaagaatcagcagaaagatttatagaaaatttaacaaataaatgctcgtacttaataggagaagatgttctacccaaagaatcattactttactcagaattctcattattaaatgaactaaacaatataaaatatgacggcatatcattacccatcgatataaaaaaatcaatagtggaaaagatattcagagtagaaaaaaaacgagtaacgaaaaaatacattaaagaatttctaaaacaagaaggatattctgacggtaaaggagaagtaagtggcattgatatcgatataaagtctgatttaaaatcatacagagatatggtgaaaattttcggtaccgaaatagactatagaatggctgaaaatatcataaaatgggtaacgcttttcggagacagcaaagacctgctgaaaaccaaaataaacaaagaatatggagaaaaagtatccaaagatcaactcaaaaaagtatgtaagttaaaatacagggattggggacgactctcaaaaaaattcctaaccggcattcgatcaagcgtactcgtaaacgatgctacaggcgaaggatacaccataattgaggcaatgagaaatacagataataacttaatgcaactactaagaaacgaatacgactacctaaagaaaatcgatcaaataaatatgctcagcagaaaagacatagatgaaatcagtcatgacatattagatgacctatactgctcaccagctgtgaaacgatcactatggcaaacaatcaaaatagtagaagaaataaaaaagataatgggccatgaacccaaaaaagtctttgtagaagtaacgagaactaacaaagctgataaaaaaacaacaatcacgagaaagaatcgccttctagaactttactcagccataaatgcagaaagcagagattgggtcaacgaacttaattcaactgaagtgtcaaaatttaactctaaaaaactctacctttattacactcaaatgggtaaatgcatgtatactgggaaaaacattgacatagaatcattatttacagatatgtatgacatagaccacatctttcctcgaagtaaaacaaaagataatagtttcgaaaatttagtactcgtaacacgtaaagccaacgcggacaaaagagacgtttatccaatagacccaaaaatccaaaccgaaagaaaaagtctatgggatatgttacatgataaaaaactaattggggataaaaaatatgaccgtttaactcgaacaactggttttacggacgacgaaatgtctggattcatagcacggcaattagttgagacttcacaagcatcaaaagcagcggcggaaatgttaaaactaattaacaacgacagcgaaatagtatacgtaaaagcagaaaacgtctcagattttagacatgaaaacgaattcataaaagtcagagaaataaatgaccaccaccatgccaaagacgcatacctaaatatagttgtaggtaatgtttataacgaaaaattcacaaagaaccccgccaattacattaagaagggtggcggaaataattattccctcaattgcatattcaaccgaaacttagatcgtaacggcaaaagaatatgggacgaaaaaaaatcaatagacacagtgaacagaatgatgaaatcaaacgacgtccgagttacatttaaaaatagagtagataaaggaccgatacttaataaagtgacaatccacaaggcaagcgaattcatggacgacggtaaaaaaaataaaaaaggattcccaataaagtcctctgagaaaaacggcaataacagactctgtaatttatacaaatatggaggttacaaagatttaaactactctcattacaccatagtacgatacaacgtatatgaaaaaaaaggattagacatcaaatactacatgataccaattccatattatctctgcctatgcaatataaaccaacatgactacgtatacgactatataagtaacagatctaaaaaagacgtcaataatatagaaatcatagtaaacgaattaaagatgggctcgctaatcaatatcgacggatacaactactacctaggaggatcaaaaccaaaaactttttatgtcgacccagcatatcaaataatactagacaaagaaatagaaaggtgcattaaagagatagtaaaagccaagaacaatgagtatcgatttataaatactgataaaattaacaaaaacttaaacatgaaaatatacaaatacatcgtaaacaagaaaattattggagtttttagaaacagaaaatgggataaaggggaatacctaaattcctcagaaacaatagaaaaattttcaggcctctctgtcgaaagtcaatgtaacgtcatactaagattaataaatgatatgaggggaagcaacaaaggaggtgcaaacagcaaattcgacgaattagaaatgacaataagcagggcagaaatcccccaaacactcagtaatgtatcatccttcaagatcataaaccaaagtataactggtctatttgaaaatgaagtcaccatagtatga

SEQ ID NO: 5550 - RNA, 4167 nt, synthetic construct
  misc_feature 1..4167: note = Cas9 variant
  source 1..4167: mol_type = other RNA
atgacaaaaccatatagtataggcctggacataggaactaattcagtaggatgggcagtcataaccgacgattataaagttccatcgaaaaaaatgaaagtactcggaaatacctcgaaaaaatatataaaaaaaaatctattaggcgctttacttttcgactctggaataactgcagaaggacgcagattaaagagaacagctaggagaaggtacaccagaagaaggaatcgaatactgtacttacaagaaatatttagtaccgaaatggcgacattagatgatgcattctttcaacgcctcgatgactcatttttggttccagatgacaaaagagatagcaaatatccgatctttggaaatctagtagaagagaaagcataccacgacgaattcccaaccatctaccatctacggaaatacttagcagattccactaaaaaagctgatctgcgtttagtttacttagcattagcccacatgattaaataccgaggccatttcttgatagaaggcgagtttaacagtaaaaataatgacatacagaaaaactttcaagatttccttgacacatacaatgcaattttcgaatcagatctgtcgttagaaaattctaaacaattagaagaaatcgtgaaagacaaaatatctaaattagagaaaaaagaccgaatactcaaactatttccaggtgagaaaaatagcggcatcttctcagaattcctaaaacttatagtaggcaaccaagcagatttcaaaaaatatttcaatctagacgaaaaagcatcattacacttcagtaaagaaagttatgatgaagatctagagaccctacttggatatataggcgatgattacagtgatgttttcctaaaagccaaaaaactctacgacgcgatcttattatcaggaatccttacagtaacagataacggaactgaagctcccttatccagcgcgatgattatgagatataaagaacacgaggaagacctggggttattaaaagcctatataaggaacatatctctcgaaacgtacaatgaagtatttaaggacaatagtaaaaatggttacgcaggctatatagacggaaaaactaaccaagaagacttctacgtataccttaaaaatctgttatcaaactttgaaggggctgattacttcttagagaagatagatagagaagattttctgcgcaaacaaaggacattcgacaacggctctattccttaccaaatccacctacaagaaatgagggcaatcatagacaagcaagctaaattttacccattcttagctaacaataaagaaaggatagaaaagatactaactttccgaataccttattatgttggacctctagccagaggaaatagcgacttcgcatggagtataagaaaacgaaacgaaaaaataactccatggaattttgaagacgtaatagataaagaaagtagcgcagaggcattcattaacagaatgacatcttttgatttatatttacccgaagaaaaggttctaccaaaacattccctgctatatgaaacatttaacgtctataatgaactcacaaaagtacgctttatagcagaatctatgagcaaatatcaattcctagacagcaaacaaaagaaagacatagtaaggctatactttaaggacaaaagaaaagtgacagacaaggatataatagaatatttacacgcaatcgacggatacgatggaatagaattgaaaggaatcgaaaaacaattcaactcatccctttcaacatatcatgacctactaaatatcatcaatgacaaagaattcctcgacgattcctcaaacgaagccataatagaagaaataatacacacactcacaatcttcgaagacagagaaatgataaaacaacgcctatcaaaattcgaaaatatctttgacaaatcagttctgaaaaaactctcacgaaggcactatacaggatggggaaaactaagcgcaaaattaatcaacggaataagagacgaaaaatcaggtaacactattctagactatctcatagacgatggaattagtaatcgtaatttcatgcaattaatacatgacgatgcattatcatttaaaaaaaaaatccaaaaagcacaaataataggagacgaagataaggggaatataaaagaagtagtgaagtctctaccaggcagtccagcaataaaaaaagggatcctccaaagcatcaaaatagtcgatgaattagtcaaagtcatgggaggtcgaaaaccagagtccattgtagtagaaatggcccgagaaaatcaatacaccaaccaaggtaaatcaaacagtcaacaaagattaaaaagactagaaaaatcgcttaaagaactcgggtctaaaatcctaaaagaaaatataccagcaaaacttagtaaaatagataataatgccctacaaaacgatagactttacctttactaccttcaaaacggtaaagatatgtacacgggagatgacctcgacatcgaccgtttatccaattatgacatagaccacataatcccccaggcattcttaaaagataatagcatagacaacaaagttttagtcagttcagcctctaaccgaggcaaatccgatgacgtcccaagcttagaagtagtaaaaaaacgaaaaactctctggtaccaactacttaaaagcaaactaatcagtcaacgcaaattcgataacttaacaaaagctgaacgaggaggactaagtcgagaagacaaagcgtcattcatccaaagacaactggtagaaacccgccaaataaccaaacacgttgcacgactattagacgaaaaatttaacaataaaaaagatgaaaataaccgggcagtaagaacagtaaaaatcattacattaaaaagtactctagtgagtcaatttagaaaagattttgagttatacaaagtaagggaaatcaacgacctacatcacgcgcacgatgcctaccttaatgcagtggtagcttcagcactactaaagaaatacccaaaactagaacccgaatttgtatatggcgattacccaaaatataattcatttagagaacgcaaatcagccactgagaaagtttatttctacagcaacatcatgaacatatttaaaaaatccatcagcttagctgacggtaccgtaatcgaaaaacctttaattgaggtaaacgaagagacaggagaatcagtatggaataaagagtcagatctcgctacggtaagaagggtcctttcatatccccaagtaaacgtagtaaaaaaagtagaaaaacaaaaccacggacttgatagaggaaagccaaaaggcttattcaacgcaaatctcagttcaaaaccgaaaccgaattctaatgaaaacctagttggtgccaaagaatacctagatccgaaaaaatacggtggttacgcaggtatatcaaactcattcgccgtactagtaaaaggaacaatagaaaaaggagcaaaaaaaaaaattacaaacgtactggaatttcaaggaataagcattttagacagaattaattacaggaaagacaaattaaacttcctcttagaaaaaggctacaaagatatagaattgataattgaattaccaaaatactcactttttgaattatctgatggttccagacgaatgctagcttccatattatccaccaacaacaaaaggggagaaatacacaaaggcaatcaaatatttctatcacaaaaattcgtcaaacttctataccacgctaaaagaatatcaaacacaataaacgaaaaccatagaaaatatgttgaaaaccacaaaaaagaattcgaggaactattctattatatcttagaatttaacgaaaattatgttggggcaaaaaaaaacggcaaactgttaaattcagccttccagagttggcaaaaccattctatagatgaattatgctcctcatttatagggccaaccggaagcgaaagaaaaggcctttttgaattgacatctcgagggtcagcggccgactttgaatttttaggggtaaaaataccaagataccgagactacactccatcatcattactgaaagatgctaccctcatacatcaaagtgtaacgggactatacgaaactagaatagatctagcaaaattaggagaaggttga

SEQ ID NO: 5551 - RNA, 4167 nt, synthetic construct
  misc_feature 1..4167: note = Cas9 variant
  source 1..4167: mol_type = other RNA
atgacaaaaccatactccatcggcctcgacataggaacgaactctgtaggttgggcagtcataactgacaactacaaggtgccttcaaaaaagatgaaagttctaggtaacacctcaaaaaagtatataaaaaaaaatttactaggagtattattattcgatagtggcataacagccgaaggaagaaggctaaagaggacagcaagacgaagatacacacgacgaagaaataggatcctgtatttacaagaaattttttccacggaaatggcaaccttagatgacgcttttttccaacgcctagatgactcattcttagtgccagacgataaacgagattctaaatatcctatattcggaaatttagtagaagaaaaagtttaccacgatgaattcccaacaatatatcacctacgaaagtatttagcagactcaaccaaaaaagcggacctacgcctagtttacttagcactagcacatatgattaaatatagaggccattttttgatagaaggagaattcaattccaaaaataacgatatacaaaagaactttcaagattttctcgacacttataacgccatattcgaaagtgatttatcactagaaaactcaaaacaacttgaagaaattgtgaaagacaaaatttcaaaactcgaaaagaaagacagaatcctcaaacttttcccaggagaaaaaaattccggtatcttttcggaattcctaaaactgatagtaggaaatcaggctgacttcaggaaatgctttaacctagacgaaaaagcatcattacacttttccaaggaatcttatgacgaagatctcgagacactattaggatatataggagacgactactcagacgtcttcctaaaagcaaaaaaattatatgacgcaatacttttatctggatttctaacagtcacggacaatgaaaccgaagcgccattgagcagcgcaatgataaaaagatacaacgaacacaaagaagacttagcactattaaaagaatatatacgaaacatatcattaaaaacctataacgaggttttcaaagatgatacaaaaaatggttacgcgggttatattgacggtaaaacgaatcaagaagacttttatgtttatctaaaaaacctacttgctgaattcgagggagcagactatttcttagaaaaaatagaccgcgaagattttctcagaaaacaacgcaccttcgataatggtagtataccctatcagatacatttacaagagatgagagcaattctagacaaacaagcaaaattctatccattcttagccaaaaataaagaaagaatagaaaaaatattgacctttagaatcccatattatgtcggacctctagcaagaggaaattcagattttgcatggtcaataagaaaacgtaatgaaaaaataacaccatggaacttcgaagacgtgatagacaaagaatccagcgcagaagcattcataaatagaatgacctcatttgatctgtatttacccgaagaaaaagtactaccaaaacattcattactctacgaaacctttaatgtgtataacgaactgacaaaagtaagatttatagcggaatcaatgagagattaccaatttctagacagcaaacaaaaaaaagatatagttcgattatacttcaaagacaaaagaaaagtaaccgataaggatataattgaatatctacatgcaatctacggttacgacggaatagagctcaaaggaatagaaaaacaattcaatagttcattatctacgtatcatgacctgctaaatataataaatgataaagaattcttagacgactcttcaaatgaagctataattgaagaaataatacatacactaacgatcttcgaagaccgtgaaatgataaaacaaagactaagtaaatttgaaaatatatttgataaatcagtactgaaaaaactatccaggagacattacacaggatggggtaaattatccgccaaattaataaacggaattcgtgacgaaaaatctggtaatacaatcctagactacctaatagatgatggcatatccaatagaaatttcatgcaactgatacacgacgatgcattaagtttcaaaaaaaagatccaaaaggcgcaaataataggtgacgaagacaaagggaacattaaagaagtagtaaaatcattaccaggatcacccgctataaaaaaaggcatattgcaatctattaaaattgttgatgaacttgtaaaagtcatgggaggaagaaaaccagaaagtatagtggtagagatggcacgcgaaaaccaatataccaaccaaggaaaatcaaacagccaacaacgactaaaacgacttgaaaaaagccttaaagaattgggttcaaaaatactcaaagaaaatatcccagcaaaactttcgaaaattgacaacaatgcattgcaaaacgaccgattatacctctactacctacaaaacggtaaagatatgtacacaggagacgacctcgacattgacagattgtcgaactatgacatcgaccatataataccacaggcattccttaaggataactcaatagacaacaaagtactcgtaagttcagcgagtaaccgaggaaaatcggatgactttccatctctcgaggtagtcaaaaaaagaaaaacattctggtaccaactacttaaatctaaattaatatctcaacgcaaatttgacaatctcacaaaagcagagcgcggcggtctattacctgaggacaaagcaggctttatacaaagacaactcgttgaaaccagacaaataacaaaacacgtcgcaagactgctagacgaaaaattcaataataaaaaggatgaaaataatcgtgctgtacgaacagtaaaaataataacattaaaatccaccttagtttcacagtttagaaaggattttgaactatacaaagtcagagagatcaacgactttcatcacgctcatgatgcttacttaaacgccgttatagcaagcgctctactcaaaaagtatccaaaacttgaacctgaatttgtgtacggtgactacccaaaatacaattcatttagagaacgcaaatcagctacagaaaaagtttacttttacagcaacataatgaatatttttaaaaaatctataagtctagcggatggcagagtaatagaaagacccttaatagaagtaaacgaagaaaccggagaatcagtatggaacaaagagtcagatcttgccacagtaagaagagtattaagttacccacaagtcaatgtagtaaaaaaagtagaagaacaaaatcatgggttagatcgtggcaaacccaaaggactatttaacgcaaacctttcaagtaaaccaaaacctaactcaaacgaaaatcttgtaggtgctaaagaatacttggatccaaaaaaatacggtggatacgcaggaatatcaaactcattcgctgtattagtaaaagggaccattgagaagggagcaaaaaaaaaaataaccaacgtcttagaatttcaaggcatatcaatattagatcggatcaattacagaaaagacaaattaaattttttactggagaaaggatataaagacatcgaattgataatcgaactaccaaaatattccttgttcgaattatcggatggatcaagacgcatgctagcgtctatactatcgacaaacaataaaaggggagagatccacaaaggcaatcaaatatttctctcacaaaaattcgtcaaactcctctatcacgcaaaaagaatctctaatacaataaacgaaaaccatcgaaagtacgtagaaaaccacaaaaaagaatttgaagaactattctactatatactcgaattcaatgaaaattatgtaggtgcaaaaaaaaacggcaaattactaaactcagcatttcaatcatggcaaaaccattccatagacgaactgtgcagttcattcataggtccaaccggatcagaacgaaagggactcttcgaattaacatcgcgcggcagcgccgccgattttgaatttttaggagttaaaataccacgatatcgcgactacacgccttcaagcttattgaaggacgccacgttaatccatcagagtgtcactggcctatacgaaacgcgcatagatctagcaaaactaggagaaggatga

SEQ ID NO: 5552 - RNA, 4167 nt, synthetic construct
  misc_feature 1..4167: note = Cas9 variant
  source 1..4167: mol_type = other RNA
atgacaaaaccatattctataggtctagatataggtacaaattccgtagggtgggctgtaatcacagacaattacaaagtacccagcaagaaaatgaaagtactaggcaacacttccaagaaatacatcaagaaaaaccttttaggcgtgctactatttgactccggaataacagctgaagggcgaagactaaaaagaacagcacgaaggcgttatacaagacgtcgcaatcgcatcttatatctccaagagatattcagcaccgaaatggcaaccctcgatgatgccttcttccaacgactagatgattcattcctcgtaccagatgataaaagagactccaaataccccatattcggtaatttagtagaagaaaaagcatatcatgacgagttccctaccatctatcatctccgaaaatacttagctgactctaccaagaaagcagatttaaggctcgtatatctagccttagcccacatgataaaataccgaggccatttcctaatagaaggagaatttaacagtaaaaataacgacattcagaaaaactttcaagatttcctcgacacatacaacgctatctttgaatcagacttatcattagaaaactcaaaacaactcgaagaaatagtaaaagataaaatctccaaactagaaaagaaagataggatacttaaactattcccaggagagaaaaacagtggtattttctcagagttcctaaaattaatagtaggaaatcaagcagatttccgaaaatgctttaacttagacgaaaaagccagtctacactttagcaaagaaagttacgacgaagacttagaaacattactcggatatatcggagacgattactccgacgtattcattaaagctaagaaattatacgatgcgattctattatcgggctttctaactgttactgacaacgaaacagaagcaccattatcatcggcgatgataaaacgatacaacgaacacaaagaagaccttgcacttctaaaagaatatatacgtaatatttcattaaaaacatacaatgaagtattcaaagatgatacgaaaaacgggtatgccggttacattgacggcaaaacaaatcaagaagatttttatgtatacctcaaaaacttactagcagagttcgaaggggcggattatttcttagagaaaatagacagagaagatttcctaaggaaacaaagaacatttgataatggatcaataccctaccaaatccatctacaagaaatgagagcaatcctagataaacaagcaaaattctacccatttctagcgaaaaacaaagaaagaatcgagaaaatactaacatttaggataccatattatgtaggtccattagcaagaggcaatagcgactttgcatggtctataagaaaaaggaacgagaaaataaccccttggaatttcgaagacgtcattgacaaagaatccagcgcggaggcttttattaatcgaatgaccagtttcgacttatacttacccgaagaaaaagtgcttccaaaacactcactcctatacgaaacctttaatgtatataacgaactaaccaaagtaagattcatagccgaaagcatgcgagattaccaatttcttgactcaaaacagaagaaagatattgttagactatatttcaaagataaacggaaagtgaccgacaaagatataatcgaatacctacatgctatttacggatacgacggtattgaattaaaagggatagaaaaacaattcaattcaagtctctcaacatatcacgacttactcaacataatcaatgacaaagagttcctggatgattcaagcaacgaagccattattgaagaaataatacacacactaacaatctttgaagatcgagaaatgataaaacaacgcttaagtaaattcgaaaatatttttgacaaaagcgtactcaagaaactttctcgacgccactacaccggatggggaaaactatctgcaaaattgatcaacgggatacgtgacgaaaaatcgggtaatactattctagactatctcatagacgatggaatctccaaccgcaactttatgcaactaatacacgatgacgcactttcatttaaaaagaaaattcaaaaagcgcagataattggagatgaagacaaaggcaacataaaagaagtagtaaaatccctaccgggatccccagctatcaagaaaggaatattacaatcaataaaaattgtcgatgaactcgtaaaagtgatgggaggccgaaaaccagaatcaatagtagtagaaatggcacgcgaaaaccaatatacaaaccaaggcaaaagcaattcacaacaaagactaaaaagactcgaaaaatcactgaaagaactaggaagcaaaattctaaaagaaaacataccagcaaaactttcaaaaatagacaacaatgccctacaaaacgatagactatatctatactatctacaaaatggtaaagacatgtatactggagacgacctagacattgacagattatcaaactacgacatagaccatatcatcccacaagcatttctaaaagataattcaatagataataaagtcctcgtatcttcagcctcaaaccgcggcaaatcagatgactttccatctctagaggttgttaagaaacgtaaaactttttggtatcaactgttaaaaagcaaactgatttcacaacgcaaattcgacaacttaacaaaagctgaacgaggcggactactcccagaagacaaagcgggtttcatacagagacagctggtcgaaacacgacaaattactaaacacgtagcacgattactagacgaaaagttcaataacaagaaagacgaaaacaacagggccgtacgcacagtaaaaataattacattaaaatccacacttgtgtctcaattcagaaaagactttgagctctacaaagtgagagaaataaatgattttcatcatgcgcatgatgcttatttaaacgcagtcatagctagcgcactgctcaagaaatatccaaaattagaaccagaatttgtttacggagactacccaaaatataactccttccgtgaacgaaagagtgccactgaaaaagtctacttttattcaaacataatgaatattttcaagaaatccataagcctagcggatggacgcgtaattgaaagacccttaatagaagtcaacgaagaaactggagaaagcgtatggaataaagaaagcgacttagctacagtacgaagagtcctctcctacccccaagtaaatgtagtcaagaaagtagaagaacaaaaccacggactagacagaggcaagccaaaaggacttttcaatgcaaatctctcaagtaagcccaaaccaaacagcaacgaaaatttagttggagcaaaagaataccttgatcccaagaaatacggcggatacgccggaataagtaactcattcgcagtcttagtaaaaggaacaatagaaaaaggagcgaaaaagaaaataacaaatgtcctagaatttcaaggtataagcatcttagatcgaataaactacaggaaagacaaactgaatttccttctagaaaaaggttacaaggacatagaattaataatagaacttccaaaatactctctattcgagctaagcgacggatcacgtaggatgctagcgtccatattatcaacaaataataagcgcggtgagatacataagggaaatcaaatattcctgtcacaaaaattcgtcaaattactataccacgctaaacgaatatcaaacacaatcaatgagaaccacagaaaatatgtagaaaaccacaagaaagagttcgaagaactgttctactacatattagaatttaacgaaaactatgtaggagctaagaaaaacggcaaattactcaactcagcttttcaatcatggcaaaaccattcaatagatgaattgtgttcatcattcataggtccaaccgggtcagaacgcaaaggactctttgaactaacatccagaggatccgcagccgactttgaatttttaggtgtaaaaatccagagataccgagactacacaccaagctcattactaaaagatgctactttgatacatcaatcagtaacaggcctgtatgaaacaagaatcgacctagcaaaactaggagaaggatga

SEQ ID NO: 5553 - RNA, 4167 nt, synthetic construct
  misc_feature 1..4167: note = Cas9 variant
  source 1..4167: mol_type = other RNA
atgaaaagaattttaggattagatcttggcacaaattccatcggatgggcactcgttaatgaagctgaaaacgaaaaagaaatttcaaaaatcattaaactaggagtacgagtcaaccccttaacgattgacgagaaaaccaatttcgaaaaagggcgtccactatccaccaacgcggaccgaaccctaaaaagaggtgcaagaagaaatcttcaaagatataaattaagaagagaaaatttaatagaaatactaatagacaatcatatcataacaaaagaaacccctttgacagaaatcggcaagggtacaacatatcagacgttatcattaagagcaaaagcagtaagagaacgcatagacttagaagactttgcaaaagttctacttgcaataaacaaaaagagaggatataaaagttcacgaaaggcttcgaatgacgaagaagggcaagcaatcgacggtatggcaattgccaaagaactctatgaaagaggaataacacctggacaatacgttctcgaattattagaaaacgatagaaaatacataccagatttttatagaagcgatctcaaacaagaatttaacaaaatctggaataaccagaaaaccttctatccggaaatactaacagacgaattattcaaagaactcgacggtaaaaacaaaagtcaaacttgggctatctgccaaaaaccttttaacataaaaggaataaaacgtataacaaaaggacgagaaaagacaatagaaaactatcattggcgggttaaaggcttatcaggaaaactgaacttagaaaaattagccataatcctacaagagattaataatgatatcaatcagagctcaggctatctaggaggtatatccgacaaaagtaagaaattgtatctaaataaagaaactgtgggtgaatttctttataagcaaatagccaaaaacccacatacaagtttaaagaaccaagtgttttaccgacacgattatctagatgagttcgaacaaatttggaaaacacaatccaatttcaacgcaaatttaactgacgaattaaaacaagaaatcagagatgttatcatattttaccaaagaaaaatcaaatcccagaaaagccttatatccttctgtcaattcgaaagttgggaacaagaatatttcgacaaagaaactggtaaaaccaaaacacggacagtcggaagaagggtaatcccaaaatcctccccactattccaagagttcaaaatatggcaaaacctaaaccacctcgtcttcacaaacagtgaaacagacgagaaaatagaaatcaaagaagtagaacaagaaataagaaaagagttgtttgaagaactgaacctcagaggcgacctaaatccaaatgatttactaaaaatactcagatcacaatttaaaataggtaaattatcaaattggaaatgcaactttgaaaagatagagggaaaccgtacaaacgccgcactttttaacatctaccagaaaatctcagacttcgaaggatacggtattgattggaacaagtccaacgctaaaaagataagaaaagagctaaaagcaacatttccagaaataggaatagacgcaagcatattagaatttgacgcatataagaaacaactcacaaaccaaagtagctatgaactatggcaccttctttactcagcggaagaagacttcaaaatatcggaacaagataaactaatatacggaaattcatccgtctcattgaaaaagaaattacacttaaaattcggatttaaccctgaatatgcaaaaatgttagcaaacctctcactgatgagtgattacggtaacctctcagcgaaagctataaagaaaatactaccttaccttgaagatggccatctgtattcagaggcttgcagactagcaggttataaccattctaaatccttaacagcggaagaacttgagaaatttgaacccaaggcaaaactcgacttactaaagaaaaacagtctaagaaaccccgtcgtcgagaaaattttaaaccaaatggtaaacgttgtcaatcaagtaatcgacacatacggaaaaccagacggagtcagaattgaactcgcaagagagctaaagaaaagcgcaaaagaaagagctgaaatgacaaaaggtatcgccgatggcacaagacgcaacgaagaaataaagaaaatcatcacccaaaaatttggtatccccaacccaacaaaaagtgatctagtaaggtaccgcttatggcaagaactagaatcacgaggatacaaagacatattcaccgacaaatatatcagccctgataaaatattttcaagcgaaattgacatagaacacataatacctaaagcccttctattcgacgattcctttagtaataaaaccctctcgtttagaaacgtaaatttaaagaaagcaaatcgaacagcccttgacttcataacacaagattaccagagcaacgtagaagcatacaaagaacgggttgaaacatggaacaaagacaatcacatttcaaaaggtaaaagaaacaaattactaatgtcactaaaagatataccagatgggtttatagaaagggatcttagaaactcccaatacatagcacggaaagctaaaagaatgctttacgaagtattcccaaatgaagttctagccacttcgggatcaataacagacaaattaagatccgattgggatttaataaacgtaatgaaagaacttaatctaccaaaatacaaagccttagggctaacagaatacgaagaacgactagataaaggcacagaagagttatttaaacacgaagtcatcaaagactggactaaaagaaatgaccacagacaccatgcaatggatgcactcgctgtagcattcacaacccacaaccatatacaatacataaacaatctgaatgcaagaaaagacattacccaagataatcatccaataattaaaaacatcgaaaacctaattacagaagttaattccaaaggtaaacgagtatttaaagctcccatgtcgtcatttagagaatccgcaaaagaacaaatagaagcaatattagtatcatttaaaaacaaaaataaagtggttactaaaaatataaaccaaactaagaaagaaggaggattcaattaccaaaatgctaaaacacctagaggacagttacataaagaaactatatacgggaaaagtaaacaaccgcttgaaaaaccagttaaaatcaacaatcgattctgtaagaaacaagtcgggctaataattaattttaaagaacaagaagcagtattacatcacctgaagaaatatgacaataacgagaaaatcgcattttctaataaaacccttaaaagtgacccgatacaagttaacggttcaccccttcgagaagttaaaatattcgaagaaatttttacaataagaaaagacatcaatccagacaacttcaaaacccaaaaacacttagacaaaataatcgataaaggaataaaagaagtaatgaagaaaagattagaagaatacaacggcgacttcaaaacagccttctccgacttagacaaaaatcccatctggctaaatcaatctaaaggaattacaataaaaagagcaactataagcggagtgactaatgcagaaccattacaccaagctaaagaccacctaggaaatataattttagacgataacgggaaagaaataccaatagattatgtatcgaccggcaacaaccaccacgtagcaatctatcaagacgaaagtggaaacctacaagaagaagtagtctctttctacgaagcagtaatccgtaaaaaccaagaccaacccataatcaagaaacgacacccaaaaggatggaaatttttattcactatgaaacaaaatgaaatgttcgtcttcagctcagaaaattttaatccatcagaaatagacctactggacgagaaaaacgcagcaattataagtccaaacctgtttagagtgcagaaaatagccacgaaaaactatatgtttcgccaccatctggaaacagaagtcacaaataatttagacttcacatatcgacatttccaagcaaccgaatggttgcgaaatctatgcaaagtacggatcgaccatattggtagaatagtccaaataggtgaatactga

SEQ ID NO: 5554 - RNA, 4170 nt, synthetic construct
  misc_feature 1..4170: note = Cas9 variant
  source 1..4170: mol_type = other RNA
atgataataagaacgtatgaacttaaaacaataactacaattgcaatactaaaaatgtttcaactactcaccggaggtttaagtatgacaaaattaggtaaaccatacggaatcggtgtagacataggctcaaatagcataggtttcgctgctgtcgatgaaaacagtcatctcataagactcaaaggcaaaacagtaataggagcccgattatttgaggaggggaaagcagcagcagataggagggcctcgcgaacgactagaagaagactaagtcgaaacagatggagattatcctttttaagagactttttcgagagtcatatcacaccaacaggtccaaatttctttatgcgtcaaaaatacagcgagataagcccgaaagataaagctaggtacaaatatgagaaaagactatttaatgacagaactgacgctgaattttaccaacaatatcccactatgtaccatctaaggaatagattattaacggacccttcaaaagccgatgtaagagagatttattttgccatacatcatatactaaaatctagaggccactttttgacatcgggttatgccaaagactttaatactaacaaagtagctcttaacgaaatatttcccgcactacaagacgcatatgcacaagtatatccagacctagacataacctttgatgaaaacaaagttaatgaatttaaaacggttcttttaaatgaaaaagccactccaagtgacacacaaagagctctagtcaatcttttacttgcagaagacggagacaaagatattctgaaacaacaaaaacaagtactaacagagttcgcaaaagccgtcgtcggactcaaaacaaaattgaatgtcgcactagggaccgaagtggatagttcggaagctaccgtctggaatttcagtctaggacaacttgatgataaatgggcaggcatagaatcagctatgactgatgaaggaacagaaatcctagaccaaataagagatctatatagagcaagattactaaatggaatagtgcccgccggtaaaacattaagccaagccaaagtagatgactatgcccagcaccacgaagacctagaattattcaaagactacttaaaacaactagaggatgatggaacagctaaagcaatacgacaattatacgaccgttatattgatggtgacgacgcgaaaccatttgttcgagaagattttgtcaaagcactcacaaaagaagtaacagcacaccctaatgcgaaaagtccagaactattagaaagattagcgcaaccggactttatgttgaaacaaaggaacaaagcaaatggagcaattccggttcaaatgcaacaacgagaactagaccaaataattaagaatcagtcagtgtattatgactggctggcagcaccgaacccagtagaaaaacaccgcaaaagtatgccataccaactagatgaactactcaatttcaggataccctactacgtaggcccattagttacagcaaaagaacaaaaagcggcacaaggaggtgtatttgcatggatggttagaaaagatcctgacggtaatattacaccttataatttcgatgaaaaagtagatagagaagcaagtgctaatacattcatacagagaatgaaaacaacagacacttatttaataggcgaagatgttctgcccaaacaatcactactatatcaaagatacgaagtactaaacgagctaaacaatgtaagggtaaataatgaaaaattaagcatagagcagaaacaacaagtaatacgagagctatttgaaagacacaattccgtcacaataaagcaatttgctgaaaatctacgtgcacatggagattatgcacacatacctgaaataagaggacttgctgacgagaaaagattcttatcatcactctctacttatcgacaattaaaatcactactaccagatgcgatagatgacccagcaaagcaagcagacatagaaaacataatagcatggtccactgtatttgaagatgcggcaatcttcaaaaccaaactaaaggaaataaattggttagattcgcaaaccattacaaaattatcaaatataagatacagaggatggggccaattttcccataaattcctaaacggactaacattaggaaatggacatactatcatacaagaattatttctttcgaacaacaatcttatgcaaatactgacagatgaaacactacaaaagaaaatgacagaattaaatgcagataaactaaaagcggctaacattaacgatgcaattgacgatgcatacacatcaccttccaataaaaaggctttacgccaagtacttagggttatagaagacataaaacgtgcggccgatggacaggacccgagttggctctatgtcgaaacagcagacggtggcggcacacctggcaaaagaacaagagcaagacaacatcaactgcaagaaatttacgcaaacgctgcacatgaactgatagattccgcagtcagaggagagttagaagataaaattgcagacaaagccgatttcaatgataggctagtgctatactttatgcaagggggcagagatatatatacaggcacgccactaaacatagaccaattatcttcatatgacatcgaccacattctaccccaatccttgataaaagataactcgcttgataatagagtcctagtacacgcaattataaatagagagaaaaacgccaccttcgcatccacaatttatgcacagaaaatgaacgccacctggaggcaatggcatgaagctggcttaatttccggaagaaaattaagaaatctacagatgagacccgatcaaatagataaatacgcttcaggattcgtcgccagacaattagtagaaactcgccaaatcatcaaactaacagaacaaatagttgcagctcaatacccagaaacaaaaattattgcagttaaagcaggcttatcccatcaactccgagaagaattagagtttcctaaaaaccgcgacgtaaatcactatcaccatgcatttgatgctttcctggcggctagaataggcacctatttattaaagcgttttcccaacctacaagccttctttacttatgggaaatttaagaaagctgacgttaagaaattacgaggcttcaatttcattagagatatcacacatgccgaggataaaatagtagtaaaagatacgggagaagtaatatgggataaaaagagagatgtcgatgaattagatagaatatacaattttaaaagaatgttaattacacatgaagtacatttcgaaaaggcggacttatttaaacagacagtttacggcgcgaaagacagcaaagaagcgggaggcaagaaacaactcatttctaaaaagaaaggatatccggttgatatatacggaggctacacgcaggaaacaggatcttacttatcagtagtgagattaacaaagaaagctatgtacgcagtggtaaaagtaagtacacgagacgcagctaaattagccgtagcaaaatctataagtgaacaaaaagaaaatgagacactaaacgatatcatagatgaaaaattatcgaaaataagtaaaaacggaaaaattacacacgaattattcgaagtagtcttaccccgtgtgggtcagaaaacattatttaaaaacagtaaatacaacctattcttggtgaactctgatacatatatgcataattaccaagaactctggatgccaagagaataccagaaaatgtggaaagatatctccttatcaaaatatggtgacgcgcaaactgaagaccaactagaccaaatttttggattcatagtatctcaagttaactcctatttcaatttatatgatataaatcaattccgaaagaaattaaacgacgctgcggataaatttgcaacactccctatgagagacactgatgatatgcaaggcaaaatagcaacaattggacaattactaattggcctacaagcaaatgccgcaagaagcgatttaagaaatttagacataaaaacccctttaggcctcctacaaattcctaacgggatatcgctcgactcagacacatcagttgtctatcaaagtccaactggtttattagaaagagaagtacatttatcagacctatga

SEQ ID NO: 5555 - RNA, 4170 nt, synthetic construct
  misc_feature 1..4170: note = Cas9 variant
  source 1..4170: mol_type = other RNA
atggcaagagactattcagtcggtttagacattggaacaagctctgtcggttgggcagcaatagacaacaaataccatttaattcgagcaaaaagcaaaaatctaataggtgtacgcctttttgactcagctgtcaccgctgaaaaacgccgaggatatagaactacaagaagacgactgtcaagacggcactggcgcctaagactcttgaacgacatttttgccggtccattaaccgacttcggcgacgaaaattttcttgccagactaaagtatagctgggtgcatcctcaagaccaatcaaatcaagctcactttgcagctggcctactctttgacagtaaggaacaagataaagatttctatcgcaaatacccaactatttaccatctacgattagcgctaatgaacgacgaccaaaaacacgatttaagagaagtttatcttgcaatacatcacttagtaaagtatagaggacatttcctaatagagggagatgtaaaagcagattcagccttcgacgtccatacttttgcggacgccattcaaagatacgctgaatccaataactctgatgaaaatcttttgggaaaaatagacgaaaagaaactgtcggcagccctaaccgacaaacacggatcaaaatcacagcgtgcagaaaccgctgaaacagcgttcgatattcttgacttacaatctaaaaagcaaatacaagccattctaaaatcggttgttggtaaccaagccaatctcatggctatatttggattagattcttctgcgatcagtaaagacgaacagaaaaattataaattttcctttgatgacgcagatatcgacgagaaaatagcggactcagaagcattactatcagatacggagttcgagttcctatgcgatctaaaagcagcgtttgatggtttgacattaaaaatgttacttggagacgataaaacagtatcggccgcaatggttcgtcgattcaatgaacaccaaaaagattgggaatacataaaatcacacatcagaaacgctaaaaatgcaggaaatggcctttacgaaaagagcaagaaatttgatggaataaatgcagcatacttagcactacaatctgataacgaagatgatcgaaagaaagcaaagaaaatctttcaagatgaaatatcatccgcagacataccggatgatgtaaaagcagacttcctaaagaaaatagatgacgatcaatttttgccaatacaaagaaccaaaaataacggcacaataccccatcaactacacagaaacgaattagaacaaattatagaaaaacaagggatttattacccatttctaaaagacacctaccaagaaaactcacacgaattaaacaaaatcactgcattaataaatttccgcgttccatactacgtgggacctctagtagaagaagaacagaaaattgcagacgatggcaaaaatataccagatccaacaaatcactggatggtacgaaaatctaacgataccataacaccgtggaatttgagtcaagtagtagatcttgataaatctggaagaaggttcatcgaaagattaacaggaacagatacatacttaataggagaaccaactcttcccaaaaatagtttactataccaaaaatttgatgttctacaagaactaaacaacatacgagtctccggaagaagactagacataagagcaaaacaagatgcttttgaacacttgtttaaagtacagaaaaccgtatcagcaactaacctcaaagatttcctggtgcaagcaggatacatcagtgaagatacacaaatagaaggactagccgacgtcaatggcaaaaacttcaataatgcattgactacatataattacttagtatctgtattaggtagggagttcgttgaaaacccaagtaacgaagaactactagaagaaataactgaacttcaaactgtctttgaagacaagaaagttttacgtcgacaacttgaccaactagatggtctaagtgatcataatagagaaaaattgagtagaaaacactacacaggttgggggagaattagcaagaaactattaacgacaaaaattgtacaaaatgcagacaaaattgataaccaaactttcgatgtaccacgaatgaatcaatcaatcatagatacactatataataccaaaatgaatttaatggaaatcataaacaacgcagaagacgattttggagtcagagcctggatagacaaacaaaatacgacagacggagacgaacaagacgtttacagtcttatagatgaactagcaggtcctaaagaaattaaaagagggatagtacaatcgtttagaatattagatgatataaccaaagctgtagggtacgcacctaaacgcgtctacttagagttcgctagaaaaacacaagaatcccatttaaccaactccaggaaaaatcaactctccactttactcaaaaatgcaggcctctcagaattggttacacaagtcagccaatatgatgcagccgcacttcaaaatgacagattatatctatactttctacaacaagggaaagatatgtacagtggggaaaaattaaatttagacaacttatctaactacgatatagatcacataataccacaagcctatacaaaggacaactcacttgataatagagttctagtaagcaatataaccaatagaagaaaatccgattcctccaattacttaccagctcttatagacaaaatgagaccattctggtctgtactatctaagcaaggtcttctatccaaacataaatttgcaaatttaacccgaacaagagacttcgacgacatggaaaaagaaaggtttatagctagatcattagtcgaaactcggcaaatcattaaaaacgtcgcttccttaatagactcacacttcggtggagaaactaaagcagttgcaattcggagctcattaacagccgacatgagaagatatgtagatatacctaaaaatcgtgacataaatgactatcatcacgcattcgacgctttattattcagcactgtaggccaatacaccgaaaattccggtctaatgaagaaaggacaactatcagactcagctgggaaccaatataaccgttatatcaaagaatggattcatgcagctcgccttaatgcacaatcacagagagtaaatcccttcggcttcgtagtcggcagtatgagaaatgctgcaccaggaaaattaaatcccgaaactggcgaaattacgccagaagaaaatgctgattggtcaatagctgatctagattaccttcacaaagttatgaatttcaggaaaatcacagttaccagacgcttgaaagatcaaaaaggacaactatacgatgaatcccgatacccatcagtcttacacgacgcaaaaagcaaagcctccattaactttgataaacataaaccagtagacctatacggcggtttttcatctgcaaaacctgcatatgctgctctaatcaaatttaaaaacaagttcagacttgtaaatgtattacgacaatggacatactccgataaaaattccgaagactatatattagaacaaataaggggtaaataccccaaagctgaaatggtattgagccacatcccatacggacaattagtaaagaaagatggagctctagtcactatatcatcagcaaccgaactccacaactttgaacagttatggctccctttagcagattacaaattaataaataccctactgaaaactaaagaagataacttagtagatattctgcacaacagactcgaccttcccgaaatgaccatagaatcagcattttataaagcctttgactcaatcttatccttcgcatttaacaggtacgctttacaccaaaacgccctcgtgaaactacaagcccatagagatgacttcaacgcacttaactacgaagacaaacaacaaacattagaaagaatactagacgcattacatgccagcccagctagctcagatttgaagaaaataaatctatcatcaggatttggacgtttattctcaccttcacatttcaccttagcagacaccgacgaatttatatttcaatcggttacaggattattctccacacagaaaacagtagcccaactataccaagaaacaaaatga

SEQ ID NO: 5556 - RNA, 4170 nt, synthetic construct
  misc_feature 1..4170: note = Cas9 variant
  source 1..4170: mol_type = other RNA
atgaaaaactataacatatctctagtcccgtcccccagtggtgtcggatacgctgtaacagacgacaacctaaacataataaaaccagttcaccatgtatcgggaatcggaagtcgtttattcaatgaaggatcaagtaaacaagatagacgcaattccagatctgccagaagatccagacatagacaacaaggacgaataaaagctctgaacagtataatgaaagacgaaatcataaaagtagaccccactttctttgacaggctttaccaaagcgaactcagcccacttgacaaaaataagaaatatcgaaatataatattcgataaaccttcagtcgaaagctattattacaagaaattcccaacaatctaccatcttgaaaaatacctcataaacacagacgggaaagcagatataaggctaatatactgggcacttcactctctactcactcacagaggacatttttataacacgacaccagtctcgcaatttaaacctggagcattaaacattaaagacaaattcattgaactaaatcaacttaaccaagtaaaaacattcgagttctcagtcgcaaacacacccgaaatcgaacacatactcaaagacaggtatatctcaaaacaaaacaaaataaaccaactcgcggaacttctatttgaacaagaacccgaaaaagacatccaaaaagccaatactaaagtcgcaaaaaccatagccaaagctatacttggaaacaaatttcaattagatgaaattattggactcgacgtaaataaatccgagaagaaagaatggagcctgcaactatcagatcttaacctagactcaaaaatagatgaactttccgatagtctaacagatcaacaattaagaatactcgaaatactacaagaaatgtacgccgccacaacattgctagacattctacaaggatcagatagtctactggatgcaaaaatcaaaagctacaatgaatacaaacaaaatagattattattctttgatcttctaaaaacccttcctgataagaaagcacacctcttaagacaaggctacaccctataccttaacaatcaccatcgcgacttagcttctgctcgcaaagacttagggatagtagcagcaacaaacttctccaaaacagacttatatgcacttatcaagaaaacattgaaagacgaaccagaaactccagaaagcaagaaagtcttagggctaatcgataaaggcgaatttctgaacaaacaacgaacagacttaaacacttacattccttaccaactaaacgcattaatactaaataaaatactgaaaaaccaaggcaaacactatccattcttaataaaagaaaatccagcagaaccagatagaaaagaagcaccatatgaaatatcacaattaatgcaatttaccattccatattactgcgggcctctagcaacaccagaagaacagaaaaacctccctgaatcaagcagattcgggtggctagtcaggaaagaagaaggcagaattacaccgtggaatttttacaataaaatcaacgtcatagaaacagctaatgcattcattaaacgctccataggaaaagacacctacttactgtccgaaccagtattaccagacaattcattactctaccaaaaatacaaagtactaaatgaactatcttcgatttctttagttgacgctaataccaagaaagagaagaaactcactgcaaaaataaaacaactcctttataaagaagggtttaagaaacacgtgaccgtatcaaaaacaatggcacttaaaatattgaacgacaacaacgtcccaacatcagatatactcggactatcaacaggcaagaaattcgacaactccctaagcacatacaactcatggaagaaagcattcccagagcaaatcgacaatcctcattaccgtcaagacctagaatatatgatagaatggtcaaccgtctttacagatagaaaaattctagttgaaaaattaaaagaaatagagtggttgcgtccagagcaaattaaattcgttttggaacatagattaacgggatggggaaaactaagtaaacgcctattagtggaactcaaagataataaaggtaaatcaaacatagacaatttattcaacaccaagaaaaatttcatgcaaatcgttagccaacaagtatataatactcaaatagaagcaatcgcgctaaaaaccaccaaaaaccaatccctcgataacatcttagaagctgcctatacaagtcccgccaatagaaaagcaatccgtcaaacaatgaaagtagtaaacgaaatcgttactctggcaggtaaaggaactcaccctgataaaatcttccttacattccaacggtccaaagagcaagaaggtaaattgactacagatagagcctcatcgctacttaaaatataccgaggaatcaaagacccactctgtactaaagagctagtggatgaactctccaaaaatgtaagagcaaatctaataaaaactaaagagtacttatattatcagcaattaggacgcgacgcattaactggggaaatcatagacaaaacagaccttagaaattatgcagtacttcacataattccccgaagcgtagtagtagacgattcgataaataacctcgtacttactaaagtcaaaaatgcaaaagaatcaatagtcgtacaatacggtagcaaaaacatctccgacattagtatgtcagtcaaagacttttggaacagattacagaaactaggcttattttcaaaaggaaaactaagaaaccttacaactgacttaacagaactaaatcaatacgaaaaacaaggttttatagcaagacaattggtagaaactaaccaaatagtgaaacttcttgcaactattctacaaggtcaattcccacataccaaaataattgaagtccgtcaagaacaaatagcaaacataagatatcaactcgacatatatcgactaagagatctgaatgtatattataggggaatggacgcttatctagcagccgttgttggaacgtacctgtacactgtatacccaaaagccagacgattctttgtttatggaaaatacctcaaacaggataaaaacaaccgagaagaaggacaattcaaaacttccggacattcatttaatttcctgtggaaattattttatggtggagaagacgaaatatacgtacaaggcactaataacatagcattcaataagaaagatctcttgcagaaaataaaagaagttaataattacaaatttcaaaatgtatccttagcaacaggtactagaaggtccgatttatttaaacaaacgatatacccgcgacaagagcgcgacgtaaagaaatcaagaacattaataaccaagaaaaatggactattcactgacatttatggtggatacacaggaaacgtcaactcatatttcgttcttgtacaaacaaaatataagaaagacccagacaaattcaacctttatggcgttccaaataggtatgtcgcaatgctggaacaatccaaatcaaaaggtaattatgaaaccaaattaaaagaagtcatggaacctataattaaaaattcgaacaagcgaatgattggatataaaattctaaaggatagaatattatacaatcaaataattgaagacaatggttacaaattctttataacctcctcacaatacaggcataacttcagacaaatgatactcagcgaccaatctaagaaaattctaatggattatgtctttgacccaaatttctatagacataagaaaaccgaggacgtaaataatgacaaagacgctaaactcattaaagtctacgatgaaatattataccaaatagatcattaccttcaaatattcacaatcggacatcatatagataaattaaagaaagcacgcccgttgtttgaaaaatgtacactagccgaaaaagcacaagtattaaacgatatattaataattgctggctctaaccaaaccgaattagcactaaaaccattaaaaacaactaaactaacattctcgaaacaaaactgtccattgacaaaagacgcaatcttctactaccaatctcctaccggaatgataacaagaaaagaaagtatcaaagatatactcaaacaaaacatttga

SEQ ID NO: 5557 - RNA, 4173 nt, synthetic construct
  misc_feature 1..4173: note = Cas9 variant
  source 1..4173: mol_type = other RNA
atgagtcgcaaaaacatagtggaagactacgcaatttcgcttgacataggtaacgcatctgtgggatgggttgcatttacaccaaactatagacttgtaagagctaaaggtcatgaattaattggagccagactgttcgagccagcgtcaacggcggaggaaagacgaatggctcgaacaaccaggagacgatattctcgtagaagatggagattacgaatgttagatagcatgtttgatcaagctctaagtgaagtagatccatcgtttttgatgagaagaaaatatagttgggtacatccagaagataaaaataacgaagcccattggtttggcggagtattatttgatagtaatgaacaagataaaagattttacgagaaatatccaactatataccatctacgaaaaagtttaatggaagatgacgaaagacatgatatcagggaagtttatttagcaattcatcatatgatgaaatatcgaggaaatttcctaacggaaggtgaattagctccatcaagtgtgttcgatgttgaggatttcctaaaattattaacagaaatactccaatatgcagatgaaggcgaaacagatgaagatttagaattacaagcagacgctaatggactaacagaagccctttgtaccacaaaaggttcaagaagcatacgagccaaaaatgcaatatcgattctaaaagaaggggcagcattatcgaaaagacaagaagcaataatttcagcagtatttgcaggactagaagggaacaaattggacctaacaaaagtatttccaaacaaagaatatacacccgaagataagaaaactctcgcactatatttcaacaaagccgattatgatgaaaaacgagtagcaataggagatagtggattattagaagataatgaatgtgactttcttgattgtatcagaagacaatacagtgcaatagcacttaaacaactcctgggagacttcacttcaatcagcgaatctatgtgtgccagatacgaacaacaccaacgaaattgggatttaataaaacgatactgtagggaagaaagtaatgcagaaaatatcaataaaaactatggcgcacttgtcggttgggaaatcgtcggtggacaaagaagatcaataagaggggcgaaagactacgaaaacaagagaaaagcagcaaacaaattctttgaagaacttataaaaggaagcgcgttgccagaccaagaaaaagaaagattattacacgacatagaaaacgacgaactattcccagtacaacgagactccggcaatggggtaattccataccaactccacttgaatgaactgaagaaaataatccaaaaacaaggccgttattatcccttcctactggaaacatacataaaagacggaaaagaagtaaacaaattagaaggactattggcattcagagtaccttattacgttggaccattagtatcaagagatgatatgcagtctagtgataatagagaaaatcattggatgatcagaagaaagaaaggagtaataacaccctggaattttgatgaaatggttgataaagacaaatcaggacacgagtttataaaatcattagtaggaaccgacagctaccttttaggtgaaacaaccctccctaaaaacagtctactctatcaagagttcgaagtactgaacgaactcaataacgttagactaagcattcggacaggaaaccattgggcagataaacgaagggtgagattaggacataacgagaaaaagttgttactcgaagaattattcgctaaacaagctacagtcacaaagaaagctgccgaaaatctattaagaagaacctatggtaacacgtatgagataagtggcttagcggatgaaaagaaatttgtttcatccctgagttcatatggcaaaatgtgtcgaacattaaaagcaagttatgtcaactcacataaagacgttgtagagaaaattatagaactacaaacagtatttgaagacaagaaaacactcaaacatcagctacaactattaggagaactagctgaaaccaactgcgaactactatcaaacacacactatacaggttggggaaaactcagcagaaaactactaacctcaaaagtagttgtctgcaaaataggaaatgacttcgccccagcaaaacactccataatagaaataatgagagaaacagaccgaaacttcatggaaataataacggacaaagacctgggagtaggtgaatggataaaccaacaaaacgtaggagccgaagatggcaatagttaccaagacataatagacgatcttagagtcagtccaaaagtcaaaagaggtatcaatcaagcaataagagtgattgacgatataagtaaagcagtaggtaaggaaccatcccgcatattcctggaactagctggtgacgtgcaacaaagcgcaagaactgtatctaggaaaagtcgactacaaggtttgtataaatctgcaggattacaaaaagagttcagagatttagctgaaagtctaaatgagtgttcagataacgatctacgcgatgatagactatttctttattatacacagttaggaaaggatatgtacactggggaaccactaaacctagatagactgagtagcgactatgatatagatcatataataccacaggctgtcactcaaaatgactcattagacaacagagttttggtagctcgggtagcaaatgcaaggaaaactgattcgtttcaatatctccctgagatcgccaatagaatgcgtaatttttggcaagagttgttagatgcaggtcttatatcacgagtaaaatttgatagacttaacagacaaaacgatttctcatcacatgaaaaagaacggttcgttcaaagatctttagtagaaacacgacaaattatgaaaaatgttgcaacaatcatgcgaaaaagatatggtaatagcgcagctgtaatagggcttaatagtgaattaactaaagaaatgaggcaatacctaggattttcgcacaaaaatagagacattaacgattaccatcacgctcaggatgcactttgcctcggaatagcaggccaatttgccgtcaatagaggattctttgctaatggaatggtttcagatggagcggttaattcatataatctatacctacaggattatcttaggggatacagggagaaaatgagcgcaggagaacgaagaagaaacaaagcatttggcttcatagttggatccatgaactcacaagatagtgacaaacggataaatccaaaaacaggagaaatagcatgggacgacgaagataaagtctacctaaggaaagttatgaactaccgcaaaatgctcataacacaaaaagtaggagatagttttggagcactctacaatgaaactagatacggaacaagcgcaaaagaaggagtaaacggaataccatttgataagcataagcaagatacagctttgtatggaggattcagctcagcaaaaactgtatatgtagtgcttattgaagccaagaaaaagactaggttagtcaacataaccatgcaagaatacgcagaactcggtgaccatccaagcgacgacgcactccgcgctgtacttgcgaaaaagaaacccgaatatggaaaggcaagaatactattaagacacattcccccaatgcaactaataagatacggtggagcattagtaacagttaaaagcgcaacagagcttaacaacgcgcaacaattatggctcccatacaaagaatactgtctgtttgatgacgtcatatcttcagctatagatgtagatgaagccagactatgccaaatgttagatgtaattctcgacgcaatccaaaaatactacccaaaacagcgtttcgatgagactggattgtctgcattccacaatgctttcaatgaagtatcagcagaagataagaaaagaattgtaggagaaatggtcggaatgcttcacgcagatgctaaaaacgcaaatcttaaagcattaggcatgagtggacgatggggacgaatgtccaatcagtcaggctacacttttgcagactctgatgagtttatctttcaaagcccttcaggattattcgaaaaacgtatctctgtaggtgaattgaagaaaagacgagcaagatga

SEQ ID NO: 5558 - RNA, 4173 nt, synthetic construct
  misc_feature 1..4173: note = Cas9 variant
  source 1..4173: mol_type = other RNA
atgaaggaagttaaggattacatcataggattagacattggaacaaactcttgtggatatgtggtaacggacaaacaaaataatatactaaaactaaaagggaagactgctattggagcacgactttttaaagaaggtgaagcagcagcagatcgacgtgcattcaggactacaagaagacgcctcgcgaggagacgatggaggctcggactcttagaagaaatatttgacgaagaaatggctaaagtagactcctcattttttagaagactgaaagaatcagattactcaccaaaagattcccgtaaacaattcaactccatagtttttgaaagcagtgaagcagataaagacttctacgataaatatccaactatatatcacttgagaaatgcgctaatgcacgacgaccaaaaacatgatttaagagaaatttttcttgcagttcaccatatagtaaaatacagaggaaatttcctacgcgaagactctgtaaaggcctttaaagccgctaaatttacactacaaggcgaagatggaataggaccagtcgacaaacttaatgacttactcaaagaaatctatatcgaggcagctccagaacttgcaacggataacctttcaaagattgaagaaataataaaagataaaaaactctacaagcaagacaaactaaaacaagttgcaactttactaacaaaagaagccgatacaaaagacaaagcaaagcttaacaaagacgtagcaaagcaagtcgcaaatgcattcatgggatatatgataatatttgatacaatattcaacctttcggatgttgactcaaaagattataaagttaaatttagcgatgcaaatattgacgagaaacttgatacattaacttctctacttacagacaaacaaacagaatttgtcctagaattacaaaatatatataatactatagtccttaacgaaattgtccctgacggcaaaagcttatccgaaagtatggttaagaaatatgacgatcacaaggaggacctaaagttatttaaagcatatctaaactcccttacagacgtaaaaaaagtaaaagagctaaaagcagcatatgtattgtacgttaataacagaaaagcgaacctactagccgcaaaaaaactacttggaaaaaaagctgataatatgaacaattttgaaattttctccaaatttgtagcagataatctagatgactcagaactagccaataagataagagcacgtcttgacttaggtgaatttctacccaaacaacgaactaaccaaaatggggtaatcccataccaattacaccaagttgaactaacacaaatacttgagaaacaaggcaaatactacccatttttaatcgcacctaacccagtcgaatcacatagaaacaatgcaccctacagaataagtgaacttgtatccttccgtgtaccatactatgtcggaccattaatagaccctaataatgcagaatcagaacaagacaaagcaaactcgagcttcgcctggatggtacgccaaaaacaaggacaaataaccccttggaatttcgaagaaatggtagacacaaccgaatctgcgaataaatttatcaaaaggatgactacaaaagatacttacctcctcggcgaagacgtacttcccgcatcaagcctcatatatcaaaaattcgtaatactcaacgaattaaacaatataaaggttaatggaataaaactcacttctgaagaaaaacaccagatatttgatgaactttttaaagtacaaaaatccgtaagtctaaaaaaccttgtaaacttcctaacagcacacggctgcgtagcgccaaatgtcactggcttatccgacggaacaaaatttaattcttcttattcaacgtatatagattaccggaaaatatttggcgccgagattgacaacaaagacaaacaagcggacttcgaaaaaatgatagagtggtcaacagtatttgaagatagaaaaattttcaaaagaaaacttgaagaaattacctggctcacaccagatcagataaaacaagtctcaagtaaaagatacagcgggtggggaagactatctaaaaaactactcacgcaaataacagacgaaaatggtgtaaatatcctacaaagactatggaacgaaagtgagaaccttatgcaaatactaagcgacccagtaataaaagaaaaaattgtagcagccaatagctcttttacaaaggcaacggacatggaagatatattagctgaagcttacacatctccacaaaataagaaggcaatacggcaagtaatgcgggtcgtagacgacataatagcagcagcccacggtaaaaaacccagccaaatagcaattgaatttgcgcgtgaagatcaagacaaccctcaaatgaccaaaagtcgaaaagcacaattagaccaaatatatgcaaaaattagcgacgaattcttagacaacgctgtaaaaaacgaactaaaaaatatgaaagataataaacctttagctaaagataaagtttttttatactttaaacaaatgggcagagacgcatacacaggagagaaactaagcctcgataatcttcaagactatgatatagatcacatctatccccaatccttcataaaggacgattccttcgataatagagtattagtacagagagcagtaaacaacggaaaaagtgataatgttccagtcctacttttcggaaacaaacaagcagcggatctaggtatgactataagacaaatgtggaaaaagtggcttgaattagggctaatatccaagagaaaattcaataatctaatcacagaccctgaaaaaataagttcctacatggctagcggattcgtgaaccgccaattagtagaaacatcgcaagtcattaaactagtagcgaacatcttacaagcaaaactccctgacacagaaataatagaagtaaaggcttcttataacagcattctaagaaaagaattcaatttatacaaatctagagaagtgaacgattaccaccatgcaattgacgcgtacttaaccactatagtaggcaactatctttaccaagtatatcctaaattacgaccctacttcgtatatggacagtttaaaaaatttggaaaagcagaatccaaagaagacgatccagtcaagaaaatcaaacaattcaattttatttaccaacttctatggggtaaagatgacgcgatatgtatatcacatactgatcaacaagtttttagccgttctgatataatcaataaattaaccacagcatataactttaaatacatgaatgtctcacaagaagtttacaccaatagcaataacgtattcaaacagacagtattcccaataatcgaacgtgacacagctaaatcgagatctctaataccaaaaaaactcgatcgacctacagacatatacggaggatattcaaacaacaacgacgcgtacctcgcactagtaaaagtagacaaaaaaaagggatccgaatacagagtcgtcggaatacctatgagagctgcagcgatgttaaaagcctcaaaaaattatgacgaggatcttagaaaagtaatcgagcccatggtaatgcttgataaaaatggcaaagcgaaacgaggcatagaaggatttagagttctcgtaggaaaaatgcccttcaaacaagccgtcttagatggagataagaaatttatgttaacaggtacaaacgacatgccaaatctaaagcaactcgttctatcgcagcaaaatatgaaatacatattagactacatagatgatatagattgcagaaaacataaatttggaaacaaaactcaagacggaaataaatgcttactagaagtatttgatgaaataatacaaattgtagacaaacattttgaattattcgacaatagatccttcagagaaaaactccgcaactcgagagttaactttataaacctcgctttatctaagaaagcagaagccctacttgccattctaaacggactacatgctaatagtatgagaacaaccatcaaagaactgaaaatatccgaccttggacggatccaatcatccgtgatctcaccagaagcacaattaatttatcagtcacccacaggccttttcgaaaggagagtaaaggttaaagacctatga

SEQ ID NO: 5559 - RNA, 4176 nt, synthetic construct
  misc_feature 1..4176: note = Cas9 variant
  source 1..4176: mol_type = other RNA
atggaaaataaacaatactacattggactcgacgtgggaacaaattctgttggatgggcagttacagacacaagttataaccttttaagagcaaaaggaaaagatatgtggggagcaaggttattcgaaaaagccaatacggcggctgaacgccggacaaaaagaacaagtcgaagacgatcagaaagagaaaaagcaagaaaagcaatgcttaaagaattatttgcagacgaaataaatcgtgtagatccaagtttcttcatacgactcgaagaaagtaaattctttctagatgaccgatcagaaaataacaggcaaagatatacattatttaacgatgcaaccttcaccgacaaagactactatgaaaaatacaaaacgatcttccacctcagatcagcattaatcaattcagacgaaaaattcgatgtaagattggtattcttagcaattctaaacctatttagccacaggggacactttctaaacgcatctctaaaaggagacggagacatacaaggcatggacgtattttataatgacttagtagaaagctgcgaatacttcgaaatcgaactaccaagaataacaaatatagataacttcgagaaaatcctatcccaaaaaggcaaatcacgaacaaaaatactagaagaactaagtgaagaactaagtataagcaagaaagataaatctaaatacaacctaataaaactaataagtggactcgaagcatccgttgtagaactatataacattgaagacatacaagatgaaaataagaaaatcaaaataggatttcgcgaatcagactacgaagaaagttcgcttaaagtaaaagaaattatcggggacgagtacttcgatttagtcgaaagagcaaaaagtgtacatgatatgggattgctgtcaaacatcataggaaattcaaaatacctatgcgaagcaagagtcgaggcttacgaaaatcatcacaaagatttgctgaaaattaaagaactattaaagaaatatgacaagaaagcatacaacgatatgttcagaaaaatgacagataaaaactactcggcatacgtcggttcagtaaattcaaatatagcaaaagaaaggagaagcgttgataaaagaaaaatagaagacctatataaatacatcgaagacacagcactcaaaaacataccagacgacaacaaagacaaaattgaaatactagagaaaataaaactaggagaatttctaaagaaacagttaacggcgtcaaacggagtaatcccaaaccaactccagagtagagaactaagagcaatcctaaagaaagctgaaaactatctaccatttctgaaagaaaaaggagagaaaaatttaactgtttctgaaatgataatccaactattcgaatttcaaatcccatattatgttggacccctagacaaaaatccgaagaaagataacaaagcaaattcatgggccaaaattaaacagggaggtagaatactgccatggaacttcgaagacaaagtcgatgttaaaggcagtcgtaaagagttcatagagaaaatggtcagaaaatgtacatatatatcagacgaacacactctgccgaaacagtcactcttatatgaaaaattcatggtattgaacgaaataaacaatattaaaatcgacggagagaaaatatcagtagaagctaaacagaaaatttataatgacctattcgtcaaaggcaagaaagtctctcaaaaagatataaagaaagaattaataagtttaaacatcatggacaaagacagtgtactatcaggaacagacacagtctgcaatgcatacctatcgtctatagggaaattcacaggtgtattcaaagaagaaataaacaaacaaagcatagtggacatgatcgaagatataatattcctaaaaaccgtctacggggacgaaaaacgatttgtaaaagaagaaattgttgaaaaatatggtgatgaaatagacaaagataaaataaaacgaatcttaggctttaaattttcaaactggggaaatctctcaaaatcattcttagaattagaaggagccgacgtcgggaccggagaagttagaagcataatccaaagtttatgggaaacaaactttaatttaatggaactcctaagctcaaggttcacctatatggacgaactcgaaaaacgagtcaagaaactagaaaaaccattatcagaatggacaattgaagaccttgatgacatgtacttaagttcaccagtaaaaagaatgatatggcagtctatgaaaatcgttgatgaaatacaaacagtaataggctacgccccaaaaaggatatttgtagaaatgactagatcagaaggtgaaaaagtaagaacaaaatcccggaaagacagactaaaagaattatacaacggaataaaagaagactcaaagcaatgggtaaaagaactcgactcaaaggacgaaagctactttagatcgaaaaagatgtatttgtattacctccaaaaaggacgatgcatgtacagcggagaagtaatagaattggataaactaatggatgacaacctctacgacatagaccatatatatcctcgaagtttcgtaaaagacgattccttggacaatctagttctagttaaaaaggaaataaataacaggaagcaaaatgatccaattactccgcaaatacaagcatcatgtcaaggcttttggaaaattctacatgaccaaggattcatgtctaacgaaaaatacagtagactaacccgaaaaacccaagagttcagcgatgaagaaaaattatcattcatcaatcggcaaatagtagaaacaggacaagctactaaatgtatggcccaaattttgcaaaagagtatgggagaagacgtagatgtcgtattcagtaaagcaaggctcgtatcagagttcagacataagttcgagctatttaaaagcaggttaatcaacgatttccatcacgctaacgacgcctatttaaatattgtagtaggcaacagttattttgtaaagtttacaagaaatccagcaaatttcataaaagatgcaagaaagaaccccgataaccctgtatataaatatcacatggacagattctttgaaagagatgttaaatccaaaagcgaagttgcgtggataggacaaagtgaaggaaactccggcacgatagtaattgtcaagaaaacaatggctaaaaactcgccattaataacaaagaaagtagaagaaggacatggatcaataactaaagaaacgattgtgggagtcaaggaaattaaatttggtagaaataaggttgagaaggcagacaaaactcccaagaaaccaaacttacaagcatacagacccataaaaacaagcgacgagagactctgtaatatattgagatatggcggacgaacaagcatatcaatcagcggctactgtttagtagaatatgttaagaaaaggaaaacaatacgatccctcgaagcaataccagtttacttaggaagaaaagatagtctatcagaagaaaaactactaaactacttcagatataatctaaacgacggcggaaaagatagtgtaagtgatataagattatgcctaccatttataagtacaaactccctggtgaaaatagatggatatctatattacttaggaggtaaaaacgatgacagaatacaactatacaacgcgtatcaattaaaaatgaagaaagaagaagtagagtatatccgaaaaatagaaaaagcagtaagcatgtcaaaatttgatgaaatcgatagagagaaaaacccagtgctcacagaagagaaaaatatagaactatataataaaatacaagataaattcgaaaatactgtatttagcaaaaggatgagcttagtgaaatataataagaaagacttatcatttggagactttctcaaaaacaagaaatccaaattcgaagaaatcgacttagaaaaacaatgtaaagtactatataacataatctttaacctatccaacttaaaagaagttgacttgagtgatatcggtggtagcaaaagtactggaaaatgtagatgtaagaaaaacataacgaactataaagagttcaaactcattcaacaatccataacaggattatattcctgcgaaaaagacctaatgacaatatga

SEQ ID NO: 5560 - RNA, 4176 nt, synthetic construct
  misc_feature 1..4176: note = Cas9 variant
  source 1..4176: mol_type = other RNA
atgaaagaaatcaaagactacattattggtctagatataggaaccaactcctgcggatatgtagtaactgacaaacagaacaacatactaaaattaaaaggtaaaacagctatcggtgcacgactatttaaagaaggagaagccgcggcagacagacgagcgtttagaacaacacgacgaaggttagcacgcagaaggtggcgattatcactcctagaagaaatattcgatgaagaaatgaataaagttgacccatcatttttcaggcgattaaaagaatccgactactccccgaaagaccgaagaaaacaatttaattcaatcgtatttgaatcatcagaagcagataaagcattttatgaaaaatatcctaccatataccatctgagaaatgctcttatgcatgataatcagaaacatgaccttagagaaatattccttgctgtacaccacatagtcaagtatcgaggtaacttccttcgtgaagattcagtaaaagcattcaaagcagctaaattcactctacaaggtgaagatggaataggtcccgttgataaattgaacgacctcctaaaagaaatctacatcgaagctgccccagaactagccacagacaatctatctaaaatagaagacataatcaaagacaagaaactttataaacaagacaaactaaaacaaatagcaaatcttctcccaaaagctgtagattccaaagacaaagcaaaacttaacaaagatatagcaaaacaagtagcaaatgccctaatgggatatatgtttaggttagacactttattttcatttacagacgtagatgttaaagattacaaattaaaattctccgacgcaaacatagacgaaagcctagacgcacttacatctctattaacagatgcccaaatagagttcgtcctcgaactacaaagtatatataatacaattgttttaaacgaaatagtccccgacggtatgtctctctcagaatctatggtcaagaaatatgatgatcataagaaagatttaaaactatataaagaatacatcgactccttatcagatcagaagaaagcgaaacaattagaagcagcgtatgctctatacgtaaattaccgtaaagcagatctactagctgctaagaaactatttgagaaaaagaaaataggagacaagaaattcgtagacgtgatatccaattttgaagtcttcgggaaatttgtaagcgacaatttagatgactcagaattagcaaataaaatcaaagctagacttgacctcggcgaatttctccccaaacaacgcacgaaccaaaacggagttataccatatcaactccatcaagtagaactaacgcagatcctagaaaaacaagggaaatactatccattcttaataacacccaacccagtagaatcacatcgtaataacgctccttatgaaatctctgaattggtatccttcagagtaccatactacgtaggcccactaatcgataatcaatccataaaagataaacagaataaaaacaaattcgcatggatggtacgccaaaaacaaggtcaaattacgccatggaatttcgaagaaatggtggacacgactgaatctgcaaatcagttcatcaaacgtatgaccagaaaagacacgtaccttcttgcagaagacgttctccccaaatcatccctaatataccaaaaattcatgatcttagacgaactcaaccgaattaaaatagacggcaagaaattaacctccaaactaaaacacgatattttcgaaaaattgttcaagaaacagaaaagtataaatctagacaatctcaaaaattacctactagcagaaggaaacatacccggcctcatagaaggactttctgacggtataaacttcaataattcattttccacatacatagactaccgaaacatatttggagatgaaattgataatccaaacaaacaagcagacttcgagaaaatgatagaatggagcacagtcttcgaagaccgaaaaatattcaaaagaaaactgaaagaaataacatggcttacccctgaacaaataaaacaagtttcaagtaaaaggtactccggatgggggcgactaagcaagaaattacttacacaaatcaccgatgaaaacggagtaaacatattacaacgactatggaatgaaccagaaactttaacagaagtcctcgctaatccagtaattaaacgcaaaataagcgaagcaaattcattattcgtacaaatcaacaaagtagaaaacatattagacgacgcctatacttctccacaaaacaagaaagccattagacaagtaatccgtgttgtagatgatattatagcagcggcacatggcaagaaaccaagtcaaatagctatagagttcgccagaagttcacaaaacaaagcaaaagtccctgacacaagaaagaaacaactagataaaatatacaataaaatctcttcggaaatattagactcttctatcaaaaatgaactcaaaaatttaaaatcaaataaatatctaagcaaagataaattatttctttacttcaagcaaatgggacgagatgcatacaccggagataaattatcactagaccaattgcaaaattacgacatcgaccatatatttcctagatcgttcatcaaagacgactcattagacaatagggtactaactcaaaaaccaataaacgctaaaaagtccgattacggaataccagcactagaatttggcaacaaatatgttccagatctaggcatcaccgtcaaagaaatgtggaaattatggcaggaaaacggattaatatctaaaagcaaattaatcaacctatgtaccaaccccaaaaagataggctccaaaagagccagcggattcatcaacagacagctagtagaaacttcccaagtcataaagctagttgcgataatactccaagccgagttcccagacacagaaataattgaggtgaaagccctacagaatacaacattacgagaatcatttcatctatacaagaacagatctgtcaacgactaccaccatgcaattgatgcatacttaacaactattgttggtaactacctttatcaagtatacccaaaactaagaccttacttcgtttacggccaattcaagaaatttaaccaagagaaaaatatagatatcctgaaaagactcaaaaactttaacttcctacgacaattaatcttcaatacagatgataatatatacatctccggaacgaaagaaatagttttcaacaagaaagacatcatccataaattggaaacagcttatggctacaagtacatgaatatttcaagggaatgttatcaagaaacttcgtctctattcaatcagacactatatgcacacaactcaagtgtaaagaactctctaatacccaaaaagaaaggcttacccacagaaatatacggtggctattcagggaacaaagattcattctttgtcctagtaaaaatcgtaaagaaacgaaccaacttatatagaatagtaggcatcccaactcgcgaattggcaaaattaaacagctccaataactacaatcaagcactaaataaaattgttgaatcaaaactatgtctaaaagaaactgagagctttaaaatcctaataaaacgcctcctctatggaacactcattgtcgacaacggacagaaatttcgcataggatcttttaaagaaaaacacaacgtacaacaacttgtattacaactcaaatcaatgaaatacatcaaattttatatcgacggcggacaaaactacttcacagatgtagaaagaaagaaattagagaaacaagacagagacaagtgtttattatacgtcttcgacgacattatgaatgtggttaataaacgcttcacactattcgacatgtcaaaatatgagaaagatggtgattcactgagagaaaaattcaactgtctagattttaacgacaaagtctccattttatcggatttattaaaagcattccatgccaatagcgacagaacatccataacaaaacttaagatcacaaatctaggaagacaccaggccggcaaaaatggaataacactaacaacaaacgcacaaataatttatcagtccccaacaggactattcgagagacgcatcaaaataaaagatctatga

SEQ ID NO: 5561 - RNA, 4176 nt, synthetic construct
  misc_feature 1..4176: note = Cas9 variant
  source 1..4176: mol_type = other RNA
atgaaaaaaatcttagggctagacttaggtacaaatagtataggatgggcattagtcaatgaagcagaacatgaacatgaacaatcatcaatagttaagctaggggtaagagtaaacccactctccgtcgatgaaaaaacgaacttcgaaaaaggaagaccactatcaataaatgccgatcgcacctctaagagaagcgcacggagaaacttacaaagattcaaactcagacgcaaaaacttaataaatctcctgttaaaacaccacatcataagtaatgaaaccatcctaacagaagtagggaaaaatacgactcaccaaactctcaaactacgatcaaaagctacgcaagaaaaaatatcgctagaagaattcgcgagaatactattatcaataaacaaaaaaagaggatacaaaagttctagaaaggagaaaaacgaagatgaaggattcaccattgatggaatggcgatcgcaaaagagctatacgataaccaacttactccaggacaatacgtatataacatactccaagacggaaaaaattatatacccgacttttatagaagcgacctacaagctgaattcgacgacgtttggcaattccagaaaaaattttactcctccattctaaccgatgaattctacctgaaattaaaaggtcagggtaaagaaaataccaggaaactattccttgcaatacatcaagtatacacggcagagaataaaggaaaacgtgacgcagtcaaactacaatattacaaatggagatcagaagcagtaaaaaaacaactatccatcgaagaagtagcttacgtcttggtcgaaattaataacaatataaataaatcatccggttacctaggcgcaataagtgatcgaagtaaggcactctattttaataacgagacggtaggagaatacctctacggtcaattagttaaaaatagacataactcgttaagaaatcaagttttttatcgacaagactacttagacgaatttgaaaagatatgggaaacccaagcaaaattttatgatgaattaacaaacgaacttaaacaggaaattcgagacgtagttatattctatcaaagaaaactaaaatcacaaaaacacttaataagtgactgtttattcgagaaacaccataaagcaatccccaaatcctcgccactatttcaagaattcaaaatatggcaaaatctcaattacttagaattcgtgcatactcaatcaaaagaaaaaatattcttctccgaactagacgatgaaactcgacaatttgtcttcgccgaactaaacattcgagggacactaaaaattaaagaaataaaaaaattaatcggattagaaacaccagtatattggaagagtaacttcgacgaaatagaaggaaatagaacaaatcaagttctgtacaatgtatatcaaaacatagcagatgacttaggatatggattcgactggtcaaagaaacatgcgtttgaaatcaatgccgagttacaagcaatatttaaagacgtaggtatagacacagcaatattaaacttcgatgcttcaatagaagaaaatgattttgacaaacaaaaatcatatcaactctggcatttactatactcagcagaagatacagataaagctacagaagaagacaaacttatatacggaaacataaacacaaaactgaaaaagcaattacatcagaaatacggcttcgaggctaaatacggcaacttgctggcaaatatctcactacaacaagactatggtaacctttcagcaaaagctataaaaaaaatcctaccgtatttagaatctggaaactcattttatgaagcgtgcacaatcgttggatataatccatcgaatagcctgactaaagagcaacaacaaaatagaaaactcaaagacaaactagaattattaccaaaaaactctctacgaaacccagtcgtagaaaaaatactgaaccaaaaagtaaacctaatcaaccaactaattgatgaatacggaaaaccagacgaagtacgtatagaattagcacgtgaactaaaaaaaagcgcaaaacagagagccgacctatcgaaacacatcaacgacgccacactcaagaaccagaatatacgcaagacactgcaaaaagacttcggaatacaaaacccatcaaaaaacgatgttataagatataaactatacgatgaacttaaagataacggatataaaaccctatttacaaacaaatacataccaaaagaacaactattttctaaagacgttgatatagaacacataataccaaaggcaatactatttgacgattcattttcaaataaaacattagcatatcgaaacgttaatctcgccaaagcagacgcaaccgcatttgatttcatatcgagcaagcatctagacgacctagacaactataaggcacgcgtagaaacattattccagtcaaagagaataagcaaaggaaaatacaaaaaactcttaatgacacgccaaaatttaccagaagactttatagaacgggatctccgcaactcacaatacatcgcaaagaaggcaactgcaatgctaaaagaagtatttcgatcagttgtacctacatcaggaagaataacagacaaactaagggaagactgggacctagtcaatgtaatgaaagagttaaatcttccgaaataccgaacacttggattaacagaattcatagaacgaaagaatggtaacaaaattgaacaaatcatcgactggacgaaacgaaatgatcatagacaccatgctatggacgcgttaacagtagcgtttaccacacataatcatatacaatacctgaacaacctaaatgtaacccacggcctaaacggagtagacaccgatcacgaaaaaagcagactatacgcaatcaaacaagccatcactaaggtatatatcgtaggaaaaaccaaaaaaagaaagttcataccacccatggaaaatttccggagccacgccaaaaatcatctagaaggaatcttaatctctttcaaaaacaaaaataaagtcgtaaccaagaacaaaaacagaaccaaaaccaaaaccaaaggagtgttcaacgaaaaaatacaactgacaccacgcggacaattgcacaaagaaaccatctacggtcatgcaaaaaaggttatagtaacaaaagaaaaagtatcctcaaaattcacccacgaaaaaatattacaagtcacgaaacctgcctatcgagaagcgctactaaaacgactagcatcattcaaaaacgaccctaaaaaagctttcagcggaaaaaatgcgctaagtaagaacccgctatacttcgatatcacaagtggaaaaaaagtcccagacacggtgaaattgtcatatttcgaaaactcatacgtaataagaaaggaagtaaacagcgacaattttaaaaatgaaaagtcattacaaaaggtattagacgtaggaatcagaagaatcctggaaaaacgcttagctgactataacggaaacgctaaagaagccttttcaaacttggagaaaaatcccatctggaaagacaaagaaaaaggagtatgtataaaaaaggtaagaatagaagctttaaaaaacgccgaaccactacatgtcaaaaaagatcatttaggcaaaattattttagatgatgagaacaaatctacaccagtggacttcatatccacaggaaataaccaccatgttgcaatctatgaagacaaagacggaaaactacacgataaggtagttagtttctacgaagtagtttcaagagttaatcttggtctacctatcatcgataaatccttcaactcacacctcgattggaaatttcttttttcaatgaaacaaaacgaaatgttcgtattcccaagcgaagactttaacccaaaagaaatcgatataggaaatcccaaaaataatgaactcatttccaaatacttatttagagtacaaaagtttagcaaagtaacatatggaaatagtgcagtcagagactatgtgtttagacaccatttagaaaccgaactaatagataaaaaggaattaaaaggcataacatactaccaactaaaatcaataggtatgctagaaaaactagtcaaggtccgcataaatcatatcggcaagatagtccacataggtgaatactga

SEQ ID NO: 5562 - RNA, 4176 nt, synthetic construct
  misc_feature 1..4176: note = Cas9 variant
  source 1..4176: mol_type = other RNA
atgaaaacgatattaggtctggacttaggaacgaatagcatcggatgggctctagtcaaagaagcagaaaacgaaaatgaagtatccgatataataaagctcggagtacgtgttaaccccttaacagtcgacgaattaacaaatttcgaaggagggaaagcatatagcaacaatgcagaaagaacattaaaacgcggcgcgagacgaaacctacaacgatacaaattaagaagagaaaacctaatcgaaattttattaaagaatggtctaataaacaaagatacagcattaacagaagtaggaaaagaaacaacgcatcaaacactcaaactcaggagcaaatccgctaacgaaaaagtttcactagaggatctcgcaaaaatcttactaagcataaacaaaaagcgggggtataaatcatcgagaaaggttaacgcggaagacgacggagtagcaattgacggaatggaagtcgccaaactactgtacgacgaaaacatgacacccggagaatacgttttgaggctactggaaagtggaaagaaacatttaccagacttctacagaagtgatctacaagaagagttcaacctagtttggaagaaacaaagtgagttctatcccctaatattaacaaaagaactcttctttgaactacacgggaaaaataaaagtcaaacatgggcaatatgcaaagaaccacttggcatagtcggagtgaaattaaaaggctcggcaaaagaacaaaaatttgcgcgatacaggctacgaaaagaagctctaacacagcaaatagaactggaacacctagcaatagtattacaggacataaacaatgattctaataaaagttccggctacttaggggcgataagtgatcgcagcaaagaattatttttcaataaagaaactgtaggacaataccaatacaaacaactacaaaaagatccaaacacaagccttaaaaaccaagtcttctatcgccaagactacctagatgaatttgaagttatttggcgaaatcaagcaaaattctacccacaactaacaaacgaactaaaacaagaaatccgagacgtagtaatattttaccaaagaaaactaaaatcacagaaaaatctaatcagcttctgtcaattcgaatcaacccaacaaaattacgtggaaaaagaaacaggaaaaacaaaaatacgaacaataggcagaagagtaattcctaggtcctcacccttatttcaagaatttaaaatttggcaaagtttgaacaatctgaaattcgtaaattcagaatctaaccaaataatacaattcatcgaattagaagatgatgttaagaaagtagtattcgatgaactaaatttaagaggcgatctaaaacccaaccaagtcctcaaaatcttatccaaatacatgaaaataggaaaactaacacaatggaaatgcaacttagaagaaatagagggcaataggacaaatagtgcactctataatgtctttcaaatgatagcagaagaagaaggctacggatttaattggggtaagaaaagcgctcttgaaataaaatcggaattaaaggcaatattcagtagtataggcataaatgattcaatacttgatttcgatttttctaagaaacttgatcaacaactcagttaccaattatggcatttactctacagcgcagaagagggaaattctaaaattaccgaagaagacaaatttacatatggaaacacaggggtcgcattaaagaagaaactacatcttaaatttggattcaaaccagaatacagtacattaatatcgaacttaagatttacttcagactatggaaatttaagtagcaaagcaatatcaaaaattttaccattccttagagatggttcagattattcaaaagcctgtcaatatgcaggctacaaccactcgaactctctatctgccgacgaactggataatagggaacttaaaccaaaattagagcttctcaagaaaaattcactaagaaatccggtagtagagaaaatcctaaaccaaatggtaaatgttgtaaaccaagtaatagacaattacggaaaaccagacgaagttcggatagaactagctagggaactaaagaaaagcgctaaagaaagatcacaaatgacgaaaaatatatcggacgctacacgacgaaacgccgaaatcaagaaatatttgtcaaaagaatttgggatacctaacccaacaaaaggagacgtaatcagatacagattatgggaagaattagcatcaaacgggtacaaagatttattccgcgataaatatatccccaaagaaaaactcttttccaacgaaatagatatagaacacataatacctaaagcactactatttgatgacagcttcagtaataaaacactagcattcaaagttgataaccttaagaaagcagaccgaaccgcatttgacttcatgtcaactgatttttcaaaagatgttgacagctatatcggtagaatagaaacattacacaaagacggaaaaataagctcatcaaaatacaagaaattaatgatccccaaaagcaaattagtagatgggtttatagaaagagacctgagaaatacacaatacatagctaaacaagcccgtaaaatgttattggaagtttttaaaactgtcgttccaaccacagggaaaatcactgacaaactaagagaagactgggacctaatcaatgttatgaaagaactgaacttccccaaatataaagcattaggactcactaagaaaatagaaagatttgacgttgggtcagaaaagatcaaatcaataaacgttatagagggatggagcaagagaaatgatcacagacatcacgccatggatgcattagcagtagctttcacaacacataaccacatccaatatctaaattacttaaacgcacgcaaagatattcaccacgaaatgcacggaactataaaatcaatagaaaatcaaatcatcggtaaagacgtcatgggtaaaagacgtttcattcctccaataagcgatctaagaatgaaagcaaaattacagatagaaagtattttgatatcgtttaaaaacaaaaataaagtagtaacgtggtccgtcaacaaaacaaaattaaaaggtaaagataactacaacaaacgaagacagctaacaccacgagggcaactacataaagaaacagtgtatggcaaaataaagctgatcgatcccaaaccattaaaactaaacaataaattcactttagttagagccagcatgatagtggacaaagtccacagagagatagtacttcaacacttatccaaatacgataataacagcgaggttgcctttgattcaaagaccatcaaaatagacccaatcctgatagaaggaattggactaaaagaagtagtgtgctacgaagacgtctttaaaataagaaagaaaataagtggtgataatttcaaaaacgaaaaacacctagaaaaagtaatagacgaaaaagtaaaacaaatattaaaagaccgggtcataaagtttcagggcaattttaaggaagccttttcaaatctagaagaaaatcccatctggttaaataagagtaaagggatcgcagttaaaagtgtagctataaagggggtaaataatgcagaaagcctacacgaggggaaggatcatttcggcgaccaaatacttgacaaaaacaagaaacaaatacctgtagactttgtatccactggaaacaaccatcatgtcggaatatatgaggacaaagacggcaatctgcaagaacgcgttgtgagcttcttcgaggcagtaacaagagtcaacgaaggcctacccataatagacaaaacgtataactctgacataggatggaaatttaaattcacaatgaaacaaaatgaaatgttcgtattcccttcagatgattttgaccctaatgaatttgacctaacagacggtaaaaatgcagcaaaaatctcacccaacctataccgagtacagaaaatagcaaccaaaaactatatgttcagacaccacctagaaactgtagtcacaaacgaccttgagttcacatacaaatccatccgatctactggatggttaagaaatctagttaaagtaagaataaaccatttaggcgaaattgtatatgtaggtgaatactga

SEQ ID NO: 5563 - RNA, 4176 nt, synthetic construct
  misc_feature 1..4176: note = Cas9 variant
  source 1..4176: mol_type = other RNA
atgaaaaaaatactaggactagacctagggacgacctcaataggttgggccctcgtaaatgaaaaagaaaacaacgaagaactaagttctataattcgactaggagtacgggtgaacccactcactgttgatgaaaaaagcaactttgaaaaaggcaaagacattacaactaatgcagatagaacgaaatgtagatcagctagacgaaacttacaacgatttaaactacgaagggaagcactagccgactgtctaaaacgacacggtctaatgactgacgaaacccccttgtgcgaaacgaataactcaatcatatttaagacctatagtaacagagcaaaagcagtctgtgaaaaaatagctttagacgacttcgtgagagtcctcttcatgatcaataaaaaaagaggatacaaaagtagtcgaaaattaaacacagatgacgaaggtacattagtagatggtatggacgttgcaaaattattatacaacgaacaaattacaccaggtgaatatctactacgactcttcaaaaaaggaaaaaaaaccaggccagacttttatttaagtgacctaaaagccgaactagaaagaatatgggacttccaaagaacgttctatccagaaatattatgcaatgcactaaaagaagacctcaaagggaaatcacgaacccaatcctcagcaattttctatgcaaaatacaaggttagcacggctaaaatcgcaggtaaagacaaaagactacaagagctaacgtggagaacagacgcgctacgaaagcaactaaccatagacgaagtcgcatatgtcatatgcagtataaatggcgaagttaatggcagttctcaaaggctttcaatgatttcagatcggagtaaactactatactttaaccaccaaacaataggacaatatctaatgcaacgattagaagaaaatcccaacgcaggcttaaaaaacattatattttaccgacaagactatgaagatgaattcaacgatatttggaacagccaagcgacctatcataaagaactaacgccagagttaaaaaaagaagtaaaagacataatattctaccaaagaggccttaaaagttgcaaatggctgataaattattgtgaactagaacatgaagaaatagaagttaaaacacctgaaggcaaactgagaaaaataacaataggtagcaaaacatgtcctaaaagctcacctctattccaagaatttaaaatatggcaggttttaaataatttacaagttagtccactcaattcacgaagaaaagcaaaaagaaaaaaagacgaagaacccagcctattctcagacgaggatatgaacacagcatgtaggtacttaaacgaagaggaaaaactgacgctatttaaagaactatcaataaaaaaggagctaaagaaaaaagacgcattaaaactattgtttgaaaactataaagaattagatctaaattataaagttataagtggaaacgttactatggcaaacttatacagagcctttcaagacattatatctttaacaggcaacggagaatttgacttccaagcaatgccagcggaagaagctgaaaaaacagtagaggaaatattcgggggtctaggatataaaacagcttttttgcactttgatgccagcttacatgacaaagaatttgaacggcaaccggcataccgactgtggcacctcctctattcttacgctggagaccaatcaaaaacgggaatagaagcattagtaaaacgcatacaagaattatgtggatttgaaccagaatacgctagaattctcgcaaacatctcctttataccagactacggcaaccttagttctaaggccatgcgtaaaatcctaccctacatgcaagacggatacgagtattctgaagcatgcagcaaagctgggtacaggcattcagcaagtagcctgacaaaagaagaaattaacaaaaaaaattataaaactcatttagatgagattaagagaaacagcttaagaaaccctattgtcgaaaagatacttaaccaaatggtcaatgtagtaaactccgtaatagatacttattcaaacatcgatgaaatcagaatagaaatggcacgcgagttaaaaaaatcaaagccagaaagggaagacatgagcttcgctatatcgaaagccacaaaagagacagaaaggatcaaaggaatactagaacaagagtttaagatacaacatgtaactagaaacgacataattcgttaccgattatatgaagaactaaaacccaatggctacaaaacactatactcaaatacatacatcccaagagaagacctcttctctaaaaaattcgatatagaacacattataccaaaagcaagattatttgacgacagctactccaacaaaacattagaactacgagacataaatatagaaaaaggtaatcaaactgcctacgattttgttctcagtaaatacggagaagaaggactgtacaaatatgaacaacgcgtagaagaatttaaaaagaataacgaacaagctggcacaaaatgtagaaaattactgatgagagaagccgatataccttcagattttctcaatagggatttaaatgattcacagtatatcgcaaaaaaagcacatgaattattaagagaaattgttcctaccgtaactgcgacaacaggaagcataacaaatagactaagggaagactggaaactcgttaatgtcatgaaagagttaaactgggaaaaatacgataaattaggccttactgaagagtataaagacaaagatggaaacaccgtaagacatataaaagattggacaaaaagaaacgaccatcgacaccatgcaatggacgccctgacaatagcctttaccaaaccttcattcattcaatacttaaataatctcaatgccagaagtaacagaggtggctcaatatatggaattgaacaaaaagaacttgaaagagaaaataacaaattggtattcatcccaccgatagatccaaaaatattccgaaagcaagcgaaagaacatttatcgaacatattaatatcaattaaagctaaaaacaaggtagtaactaaaaacgttaacaagactaaaagtaaatctggaacaaatagaaaggtacagttaacaccccgcggccaattacatctagagaccgtttacggcaaaattagaacttacaaaactgaggaaattaaggttggaactaaactaacagaagagctaattgcaaaagtcgccgataaaaagattagagaagccctgatgcaacgcctatcagaatacggaggcaacataaaaaaagcatttcaaaatatatcaaaacatccaatatggttaaatggatcccataccaaacatgtaccagaaaaagtaaagatagtttttttcgaggacgtattcacaataagaaaagcaataacaccagacataaaaatagataaagttatagacagcaaaatcagacgcatattacaagaacgactcaacgaatttgggggggaagcttcaaaggccttttcaaatctagacgaaaatcccatatggttcaaccgagacaagggaatagctattaagtctgtaaaaataagaggaatagctaaaggcacagcaataagggtgaagaaagatatccacggaaaaaccattatcggcaacaacggatatccagttgctaatgattatgtaaacaccggcaacaatcaccatgtcgccatctttagggataaagatggaaatttgcaagagcacattgtaagtttttacgaagcaacagccagagcgattcaaaacctcccaatagtagaccgaaattacaatagcgaaaaagattggaaattcctattctcaatgaaacaaaacgaatactttgtatttccaaatccaaacacaggatttaacccatctgaaatcagtttaaaagacgaaaaaaactacgcattaatcagtcccaatcttttcagagtccaaaagctgagtcactactattacgtatttagacatcacctagaaacaaacgtggacacgaacctacaattaaaagatataacctggaagagaataacagcagtaaataacctaacaggcgcagttaaagtacggatagaccacctaggacgaattgttgatgtgggagaatacaagtga

SEQ ID NO: 5564 - RNA, 4176 nt, synthetic construct
  misc_feature 1..4176: note = Cas9 variant
  source 1..4176: mol_type = other RNA
atgaagaactaccatatcggattagatataggaaccagctcagtaggatttgctgctagagatgatgataataacctaatcagagtaaaaggtaaaaacgtaataggagcacgactcttttctgaaggacaaaccgcacaagaacgtagaatggcacgaacgtctaggagacgatataacagaagaaaatggcgattacgattattagatgagatatttcacgacgaaataatccacaaagacgcagagttcttcaatcgcttaaagcaatccttcctctcaccaaaagacgaaagaaaacaatacttcggcagcctgcttttcccagagactggtgactcagaatattatcataatggtaaccaaacaatataccatctgcgacatagacttataactcaagatgaaaaagcagatataagagaaatctacttagccctcagacacataataaagtacagaggcaacttcctcgatgacactccagttagcagcttcgaagcatcagatctaaaactagccagtttcgtacccacaataaacgatctattcgaaaccattgacgttaactatgaattttcaatggataacatcaatgaaatagaagacattttattaaacaataaacttcgaaactcagacaagtcaaagcaactcaccgacctcctaactgaaccaattgtgaatatagatgacaaaagtcttgaaaaacaatttaataaagagagaacagatatatccaaggaaatcgctaagtccgtggtagggtccaagatgaacgttaataaactacttagttttgaaagctccgaaggatcaaaaatagctttcagtttttcggatgcatcctcagaggacaaaatgatggaactatcagatatcctcgacgatagccgcatgaatatattaaacatccttaaagtaatctactcaagagtccgcctgaaccaaataataccaagtggaatgggactatcggaatcaatggtagcagcgtacgactctcataaacaacaattaaaagaccttaagacactacttaacgttctacctttcaatgaacgctacgcagtaaaaatcgcctacgccgcttacataggaaatatcgacaaacaaaaattcactaaaagcgaaattaaggcaatcgacaaattgaaagagaaaagcgcaataatgaacgtactagactttaaatccggccatataactaacgaagaactatcaaacgtcataaaagccgtaattgttgataaatacctaaacgatgaagatttcgaataccacggaatagtagagaaaataaaccaagatattagcaatggaagctacctactgaaacaacgcaacaaccaaaatggaaacattccccaccaactccatcaaatggaattagaccaaattatagaaaatcaatcaaagtactaccactttcttggagaactcaacccaaactctaacagaaatcacatagcaaaatacaaaatttcagaacttgtagccttcagggtaccatactacgtaggaccactcattacgccagaagaacaagagaaaacctccggagccagcttcgcatggatgaaaagaaagaaagacggtgcaataactccttggaacttcgaagaaaaagtcgacaaagaagaaaccgcgtccagattcataaaaagactgaccgttaaagacacatatttactgaacgaagatgtcttacctgataatagcctactatatgaaaaattcaaagtgctaaacgaactaaacgtcgtaaaagcaaacaataagcgtctcacagtagaagagaaacaaggagcatttgacaatttattcaagaaaatgaaaacagtaacagcaaaaagattaaagaactacctagtatcaaatcacaaccacatcaacagtgtagaaataacaggactctcagatggagacaaatttaacaatagcttatcaacatacatagacttcaagaaaatcttcggagacaaaatcgacaacccaggcctactagatgatttcgaggacataatagagtggtcaacagtctttgaagacagaaaaatctttgaagaaaaagtgagaaaagatatatcatggataagtgaaagcgaaataaagtcagtagttagtaaacgatattctggctggggtcgattaagcaagaaactattaaactgcataacaaacaatgagggacgaaacatcatcgacgaattatgggaggaatcagaaacatttatggaagcagtatcaaaaccagaagtaaaagaacaaatagacggaatcaattccgacttcataaagaatacagatatagaatcagtcctcgctgacgcatacacatcccctcaaaacaagaaagcaatcagggaaactcacaaacttgtaaaagacatacaaaaagcgatgggtggccaagccccggcaagtatatctatcgaatttacacgtaatccacaagacaaaggacaactaacacgaagccgacactccgaagtatcaagaaaatacaaagagatcagcaaagaaatatcgaaaactctaaacgatgaactaaaaagtaagaaaaattccatggatgtggacaaatactatctctacttcatgcaaatgggcatagatctgtatgatggttcatcaatagacatcgatgatttgaataactatcaaattgaccacataataccccaaagtttttacaaagacgattcgttcgacaatagagtactaactcattatagcaacaaccaaaagaaaggaaataacaccccactcaacggcctaaacataaacgataaaacaagggccatttggaatcacttgcgagacctcggcttaataaccaaaaagaaatacaatggcctcacactaaaaggtatggaccaattaagcaaatatacaaaacatggttttatcagaagacagctagtagaaaccagtcaagtaataaagctagtcgcaaacatactatccgatgagttctcaacagatgatactaaaattatagaagtcaaagctaaaatgaactcacaaatacgacaagtatttaatctctataaagtaagagaattgaacgactaccatcatgcggtagatgcctatctaaccacgtttatcggaggatacctatacaaccgataccccaacttaagaaatatgttcgtatacggcgacttcaaaaagttttcagccgatgtagacaatctaaagacttttaactttttacacgaaattacaaatccatcagacaaatttgaagatcgaatattcgacgaaaaatcaggagaactaatactagacagaaaacacgcaatcgaaactattaagaaaatatatcaatacaaatatatgttaatcactagagaagtatccacgaaaaatggacaattaagtgatcaaaccgtttactcagcaaaaagaattaataatgtaaaagcccccattcccgtaaagaaagactttaacccagaactatacggattccgaaccggaaacgtagatcaccacatggtgattgtcaaatatccaaagaaagatagctacgattataaagtggtgggaataccacttagattcgtacaaaaactcaaagaaacgaaagataataaagattacgaaaatctattaaatcaaattgtgcaaatgaaactgaacagaaagaaacaggactttatagtagtagtggacaacgtaatgtacggacaacttattcaggacgggggacagaaattcaccctaggttcaagtacttacagatataacgcaaaacaacttgtaatcgacaatggatatctaaaactaatagccgacgaaagatataaaaatagcctaacagatgaagaaaaatcaaaccaatacataacattatataatgaaatcctaaaggtggtaaatggacgattcgacgtatttgatgtaaactcttttcgaaagaaattaaataacggagtagataaattcataaaacttaacacagtcgataaacgaataatcataatgaaaatactatccggactccactgtggaccatcaatcgtccccttaaaagaattaggtcttacaacgcctctaggccaactacaatcaacctcaggaatatctctctcggaaaacactataattatttaccaatcaccatcaggcttattcgaaagaaaagttagactcggcgatctgtga

SEQ ID NO: 5565 - RNA, 4176 nt, synthetic construct
  misc_feature 1..4176: note = Cas9 variant
  source 1..4176: mol_type = other RNA
atgaaaaactaccacataggactcgacataggaacctcatcagttggcttcgcagcacgagatgatgacaacaacctaataagggtaaaaggcaaaaacgtaatcggtgcccgattattttcagaaggtaagaccgcacaggaaagaaggatatctagaacctcccgcagacgttacaacagacgaaaatggcgactacgattactagatgaaatcttccacgatgccatcgtacacaaggacgcagagttcttcaaccgattaaaacaatcatcactatctccaaaagacgaacgcaaacaatattttggatctctactcttcccggaagtcggagatggggactatttccgagatggtaaccaaaccatctatcacttacgacaccgcctaatgacacaagatgaaaaagcagacataagggaagtgtacctcgccttaagacacattataaaatacagaggtaatttcctagatgataccccagtatcatcgttcgaagcatccgatcttaaactagctagttttgtaccaactttaaatgatctatttgaaacaataaacgtaaactacgaattatccatcgacaacgtaaatcaaatagaaaatattctattaaacaataagttacgcaactcagataagtctaaacaactcaccgacttaatagccgaaccagttacaaacatagatgacaagtctttaaagaaacaatttgataaagaaagaaaagatatatcaaaagaaatagcaaaagcagtcgtcggatcaaaaatgaacgttaacaaattactcagcttcgaatcaagtgatgggagtaaaatatcattttccttcagcgatgcatcatctgaagataaaatgctcgaactttctgacattttagatgattcaagaatgaacattttgaacgtactaaaagtgatttactcacgagtgagacttaatcaaattataccctcaggaatgggacttagtgaatcgatgatagcagcctatgaccttcataaacaacaactaaaggacctaaaaacccttttagacgtcgtaccattcaacgaaaagtatgcagtcaaaatagcatacgcggcttatataggaaacatagataagcaaagatttacaaaagcagaagtaaagactatagataaattaagagataagaaaagcattacatcagtattagattttaaaagcggacacataaccaacgaagaactaaacaatgtgattaaagaagtaatcgttgataaatacttaaacgacgaaaccttcgaataccatgatattgtagagaaaataaatcaagatatatctaatggcaactacctactaaaacaaagaaataaccaaaatggaaacatacctcatcaactccaccaaatggaacttgatcaaattatagaaaaacaatctaaatactacccattccttggaaaactgaaccctaacagcaaacgaagccatattgccaaatacaaaatatctgaactcgtagccttccgtgtaccctattatgtaggacctttaattactccagaggaacaagagaaaacttcaggtgcctcatttgcttggatgaaacgcaaagaagacggagcaattactccatggaatttcgagaaaatggtcgataaggaaagcacagcgtccagatttataaaaagacttacagtaaaagatacttatctcctaaatgaagacgttttgcctgacaactcactactatatgaaaagttcaaagtattaaacgaactaaacgtagtcaaagcgaataataagagattaactgtagaagaaaaacaaggcgcctttgacaacctattcaaacaaatgaagacagtaacggctaaaagactaaagaactatcttgtttcgaatcataaccatattaattcagtaaaaatcacaggtctttctgacggagaaaaattcaacaacagtttgagtgtatatatcgattttaagaagatattcggcgacaaaatagacgattccaaattatttgacgactttgaaaacatcatagaatggtcaacagtattcgaagatagagacattttcgaagaaaaagttcgcaaagatatcagttggataagcgaaagtgaaataaacgcagtcgtgtcgaaaagatattcaggatggggacgactaagtaagaaactactaaacggaatcacgaacgatgaaggaagaaatatcatcgacgaattatgggaagaaagcgaaacctttatggaagcagtttcaaaaccagaagtcaaagagaaaatagatgaaataaattcaaatttcatcaaaaataccgatatagaatccgttctagcagatgcttacaccagtccccaaaataagaaagcgataagagaaacatataaattagttaaagacatccagaaagcaatgggcggacaagctccctcttcaatatcaatcgagttcactagaaatcctcaggacaaaggcgaactaaccagatccaggcacagcgaaattgcaaagaaatacaaagaattatcgaaagaagttagcaagaaattaaatgatgaactaaaatcaaagaaaaactctatggacgtggacaaatactatttatactttatgcaaatgggcatagatttatacgatggtacttccatagatatcgatgatcttaacaattaccaaatcgaccacatagtaccacaatcattttacaaagacgactcatttgacaatcgcgtactaacacactacagcaacaaccaaaagaaaggaaacaatactcctcttaacggacttaacattgattctaacacaagggaagtatggaaccatctcatcggcctaggattaattacaaaaaggaaatacaacaacctcacactaaaaggaatggaccaactttcaaaatatacaaaacatggcttcatcagacgtcagctagtagagacaagccaagtcattaaattagtagctaacatcctatccgatgagtatagcaaagatgatactaaaatcattgaagtaaaagctaaactcaactcacaaatacgacaagtattcaatctctacaaaatcagagaactaaacgattaccaccacgcactcgacgcatacctaactacattcataggaggatacttatacaatagatacccaaacctaagaaacatgtttgtatatggagatttcaagaaattctcagcgaaaatagataacctagaaacctttaacttcctacacgatatcaccaatcccagtgataaattcgaagacagaataatagatgagaaaagtggtgaagtaatcctagataggagacacgcgatagaaaccatcaagaaaatataccaatataactatatgttaataaccagagaagtatcaactaaaaacgggcaactttccgatcaaactgtctattccgctaggagaattaacaaagtcaattcaccaataccagtaaagaaagattccaacccagaattatacggttttcgtaccggcaacgtagaccaccacatggttatagttaaatacctcaacaaagacaaatatgattacaaaattataggaataccactacgatttgtacaagtactcaaaaattctaacgacaacacagaatataaaaacatcctaaataaaattgtccaaagcaaactaaaaggaaaatcgactgactttcgagttatcctagacaacgttatgtacggacaactaatacaagacggcgggcagaagtttaccctaggatcatctacctacaaatataacgccaaacaattagtaataaatatggatgatattcgaatactcgtagacaacagatacttcaactctctatcagatgatgacgctagtggagagttcataaaaatttataatgaaatcttaaaagtaatcaatgcccgcttcgaccttttcgacatcaataaattccgagaaaaactaaataatggcaaagaatactttgaaaatctatccatagacgagaaaaaccaagtactcctaaaaatgctaagtggtctacattgcggatccgcaaatgtacccataaaagaactagggctaactacaccactaggaaaattacaaatacctagcggaatagtactatcagaagatgcaatagtcatatatcaatcacccagtggcttatttgaacgaaaaatcagactaaaagacatttga

SEQ ID NO: 5566 - RNA, 4176 nt, synthetic construct
  misc_feature 1..4176: note = Cas9 variant
  source 1..4176: mol_type = other RNA
atgaacttacgtaattacccaggagaatactcgataggcttagacatgggcactgggagcgtaggatggagcgtagtagatgaaaaaggcaatttattgcattttaaaaagaaacctacatgggggagcagactttttgactccgtaatgccagctagtgaagcacgcgtacatcgaggacaaagacggcgctatgaaagaagaagatggagattggatttattacaaggcctattcaaaaatgaaatgaacaaagttgatccagagttctttatgcgtttaaaccaatcaagaactatagaaggagatccaatctttacaaaatcatttaccaaagcagactactacgacaggtttccgacaatatatcatttacgagcctatttgatggaaagcaacgagccagctgacttacggttaatttacctagcaatgcacaacatcatcaaacatagaggtaatttccttcgcgaagaggagaaaagtctcagtgccaaacacgcagacagtaagaaagctgtaacacaatttgtagacgctctaaaagaatggtgtttcagtagggggtatgaatttggaaaagatccagcaaaatctattgaaaaatgcttgtctgatagcaaatcatccagatcacaactagcaagtgaaattgccaaagccctagctgtgtcgaccgacgcggctgcagcagataagaaattagcagataatttagctaaagccatggtaggtttgcaatgtgagttcaaatatgtattcggagagttcgattgcgaaagtacaaagttagcactttcagacgacgaaaaactagaacttttaagggccgcatgtcctgatgacagcgtcgaactactcgacgcactatgtgcagtatattcagcatacgtattacaaggtctactaagttatgcacctggccaaacaatatctcataatatgatcgcaaaatacgacttatataaaactgatctgaaaactttaagagcattagtgagggaatatgcacctggagcatacgatgagttctttagaggagcaacttaccacgacgcaaaccccgacgattctagtaaagattatagttacgcagatgcggaaggatacacagcttacaatttacataaactgagctatgatgactttgcaaaggcagtaaagaaactattaggtggtacagatgctgtcaccgatgaaagatatttaaacatgatggaaagatttgaaaaacagcaatttcttcgaagactaaaaaccagtgacaacggtgccatctactaccaattacacttagaagaattaactgcaataatcaaaaatcaaggacgattttattctttcctaaaagaatatgaaggaaaatttgagagcttagttagctttcgaataccatattatgtaggaccacttacaagtgtcaatgcagcccaagattcccataatcataatagattccaatggtccgaaagaaaaccaggaatggaaagagaagtaattaccccatggaattgggatactataatagataaaaataaaagtgcagagaattttataatgcgtatgactggagattgtacatatttagcaggcgaaaaagtattaccaaaacaatcactattatacgaagaattttgcgtattaaatgaactgaatggagtaaggtggtcagatgacggagatgactggcaacgatttgatgctgcccaaagagaaggtatagtacgagagttatttcacaaatacaggagggtcacatacaaaatgttagaagattggttagtaagagaaggcgatgcaaaccacccgatagtaaaaggaggtcaaggggaaacaggattagaaagcaaaatgggtagctacctattctttgcgaaaggaatttttggactaggagagttaagtccggctgaatatcctgcaatagagaaaatgataaaatggaatacactttttgaagatagatcaatattaaaagaaaaattagaggacgagtttggagaaagaggtaatggcatgttggatgcatcacagatcaaagcaatatgtaagaaaagattcactggttggggaagactcagtgagcaatttcttacgggactgaaagtagaaagtcccgccggtcgagcggtaagtataatggatgtactacgtgaagggaacccatgttctgaaagaagacagggtgagactgtggttatgatggaagcacttcgcgacgaaggactgggcttccaaaagaaaatagacgaacataaccgtaattattacggccaacatggaaaagatttaggagtgaatgagctacctggaagccctgcgattcgcagatcactcaatcaagcaatccgaatcgttgaagaaatagcatcgatagccgggcatgctcctgctaatatcttcattgaggtaactcggggagaagatgctggaaagaaagggaaacgaactgtgaaaagatgggataaaattggagaagcactaaagaaattaaaagaggaaggagtggcagtagaagtaatggacgacttcaaagaacaaaaagctataaacgcgaatttggatgaaagactcagcttgtacttaatgcaaaatggaaaatgtctatattcaggaaaagcaataaacctagaaaaactacttgcaggatcaggagaatacgaagtagaccatataattcctagagcgtatatcaaagatgatagcattgaaaataaagctcttgtactgagagaagaaaatcagcacaaaactgatcaattattaatagacaaaagtatcagatggaaaatgagagaaacatggagtcagctacatgacgctggactaataggagataagaaatatcataacttactacggagtaacataaacgagaaccaacttagaggatttattgcgagacaattagtagagacttctcaaatggtaaaacttgcgcaagcactacttgaagcacgttttgccaatgaagaaacaagaatagtaccggttaaagcgtcaatgagccacaatctacgcgaagcggcagaccttgcgaaatgccgagaagctaacgacttccaccacgcacatgacgccttcttagcatccaggataggtttattcgtacaaatgagacatccaggaatatacgaaaacccaatagggtacagccacgtaataaagaaatatgttcaagaacaatctgaagtcttcaagaaaactcacagaatgcctgggagtgccggattcgttataaacagttttatgtcatcaggcttcgacaaagataccggagaagtattcaaagactcatgggatgctgaagcggaggtagatggtatcagaaaagcattgaactatagacaatgctatatatcacgaatgccacaacaagacacaggtgcattctggaatgcaacggtctactctccaagagacccgaaaatggggccaaaattagccctttctacaaaacagggactcgacccaaaattatatggcggttttagttcacaacaatttgcttatttctttatatatgaagccaaaaagaaaggaaaaccaacattccgattttcacaagtgccagtatggttagcagcacgaattgaggcaaacccgctagcgcttgaagaatacgcaagaggactagcaaaaggagagggccttgaatttgtatcaatacagagaccaaaaatctataagaaacaactcatagaagtaaacggggataaactcataataacaggagcgaaagaggtcagaagtggagcagagctagcgttcaaccaagatgaaatatcagcaatatcaatgtgttcaaaattaagagcagcagaagcgggtctagacggcgcattctcagaggaagtaagtgcaatatggaatcgcataagcaacgcaccagtgcaaagttgtgggcgtttactaagacaactaacactacccaaataccagtccaactttgactcaagttccaacgaagaaaaagcggcagtagtattgggtttaatagccctattaaatggaaacaatcgaatagtcgacctatcaggggttggaggaagtagccatgctggagctatgatgatgagttatcctaaactattagacgaccctaaagtgccatttttcataattgatcaaagtgtcacaggcatgtttgaaagaaaaactcgcgttggactatga

SEQ ID NO: 5567 - RNA, 4176 nt, synthetic construct
  misc_feature 1..4176: note = Cas9 variant
  source 1..4176: mol_type = other RNA
atgaagaaaatactaggactcgatttaggcactacaagcataggctgggctctagtcaacgaaaaagaaaataacgaagaacaatccagtatcatacgattgggagtaagagttaacccattgacagtcgatgaaaaatcgaatttcgaaaaaggcaaagatattacaacaaacgcagacagaacaaaatgcagatcagcaagacgtaacctccaaagatttaaactgagaagggaagccttagctgactgcctgaaaagacatggattaatgacagatgaaacacccctgtgcgaaacaaataactcaataatatttaaaacatattcaaaccgagcgaaagccgtttgtgagaaaattgctttagacgacttcgtaagagtattattcatgataaacaagaaacgtggatacaaatcatcaagaaaacttaataccgacgatgaaggaactctagtagacggtatggacgtagcgaaactattatacaatgaacaaatcacaccaggagaatacttactaagattatttaagaaagggaagaaaacaaggcctgatttttatctaagtgatctcaaagcagaacttgaaaggatatgggactttcaacggacattttacccagaaatcctatgcgatgcattaaaagaagacctcaaaggtaaaagtcgcacgcaatcatccgccatattttatgctaaatataaagtaagtacagcaaaaattgctggcaaagacaaaagactgcaagaactcacttggaggacagacgccctgagaaaacaattaacaattgacgaagtagcctatgtaatatgttctattaatggagaaataaacggcagcagccaacgcttaagtatgatttctgatcgctcaaaactattatacttcaatcaccaaacaataggacaatatctaatgcaaagacttgaggagaacccaaatgcaggtcttaaaaatataatattttaccggcaagattatgaagacgaatttaatgatatatggaatagccaagcaacataccataaagagcttacacccgaattgaagaaagaactaaaagacatcatcttttaccaacggggattaaaaagctgcaaatggcttatcaattattgcgaactggaacacgaagagatagaagtaaaaacacccgaaggtaaattaagaaaaataactatagggagcaaaacatgcccaaaatctagtcccttgtttcaggagttcaaaatatggcaagtacttaacaacctacaagttagcccattgaactcacgtagaaaagcaaaaaggaagaaagacgaggaaccgtcactattctctgatgaagatatgaacacagcatgtcgctacttaaacgaagaagaaaaacttacactatttaaagaattaagtataaagaaagaactcaaaaagaaagacgcactaaaattactgttcgaaaactataaggaactagacctcaattacaaagtaataagtggcaatgtaaccatggcctccctatacagagcctttcaagacattataagcctaacaggcaatggagaatttgatttccaagccatgcccgcagaagaagccgagaaaacagtagaagaaatatttggtgggttaggatacaagacagcctttttacacttcgatgcaagcctacacggaaaagagttcgaaagacaaccagcatatagattatggcacttactatactcatatgcgggtgaccaaagtaaaactggaatagaagccctagtgaaaagaatacaagaattgtgtggcttcgaaccagaatacgcacgtatactagcaaacatctcattcataccggactacggaaacctttccagtaaagccatgagaaaaattctcccttatatgcaagatggatacgaatactcggaagcatgctccaaagctggatatagacatagcgctagttcactaacaaaagaagaaatcaacaagaaaacatataaaactcatctagatgagataaaaagaaactccctcagaaatccaatagtagagaaaatacttaaccagatggtaaatgtagtaaacagcgtcatagacacatacgggtcaatagacgaaattcgaattgaaatggctagagaactcaagaaatcgaaacccgaacgcgaagacatgtcattcgcgataaacaaagctacaaaagaaacggaacgaatcaaaggaatactagaacaagagttcaaaattcaacacgtcacccgtaacgacataatacgttatagactttatgaagaactaaaacctaatggatataaaacactttactctaacacatatataccgagagaagatttattcagcaagaaattcgacattgaacacataataccaaaagctaggctatttgacgacagctactcgaacaaaaccctggaattaagagatataaacattgaaaaaggaaatcaaacagcctacgatttcgtactaagcaaatatggcgaagaaggactatataaatacgagcaaagagtagaagaatttaagaaaaataacgagcaagcaggatccaaatgtcgcaaattactaatgagagaagcagacattccctccgacttcctcaacagagacctaaacgacagtcaatatatagcaaagaaagcacacgaactcctaagggaaatagtaccaacagtaacagcaactacaggtagcattacaaaccgattaagggaagactggaaacttgttaatgttatgaaagaactcaattgggaaaaatacgataaattaggcctaacagaagaatacaaagacaaagatggaaatactgtacgacacataaaagactggactaaaagaaatgaccatcgacatcacgcaatggatgcattaacaatagcattcacaaaaccgagctttatacaatacttaaataatttaaatgccagatcaaacaaaggagggtctatctatggaatagaacaaaaagaactagaaagagaaaacaacaaattggtatttattccacctatagatccaaaaatattcagaaaacaagctaaagaacacctatcaaatatcctgatctcaataaaagctaaaaacaaagttgtaacgaaaaacgtaaataaaacaaaaagtaaatcaggaacaaaccgcaaagtacagctaacacctcgaggtcaactccatctagagacagtatatggcaaaataagaacatataaaacagaagaaatcaaagtaggaacaaaactgaccgaggaattaatagcaaaagttgcagacaagaaaatcagagaagcgctaatgcagcgcctctctgaatatggtggtaacattaaaaaggctttccaaaatatatcaaaacatccgatatggctaaactcatcacacacaaaacatgtaccagaaaaagtaaaaatagtcttcttcgaagatgtattcaccattcgaaaagcaataacccctgacattaaaatagacaaagtaattaattccaaaataagaaacatcttgcaggaacgactcaatgagtttggcggagaagcagcgaaagcattcagcaacttagaccaaaatccaatatggtttaacaaagataaaggaatagccataaaatccgttaaaatcagaggtatagcaaatggaacagcaataagagttaagaaagatatacatggaaacactataataggaaacaatggatacccaatcccaaatgattacgtcaatacaggaaacaatcatcatgtagccatcttccgagacagggacggcaacctgcaagaacacatcgtctccttttacgaagcaacagcccgagcaatccaaaaccttcctatagtcgaccgcaattacaactcagagaaagactgggagttcctattttccatgaaacaaaatgaatattttgttttcccaaacccaaacaccggattcaatccattagaaatagacttgcgaaacgaagaaaattacgcattaatcagccccaatttattccgagtacaaaaattgtcccattactattacgtatttagacatcacctagaaaccaatgtagatacaaatttacaattaaaagacataacatggaaacgcataaaagcaattaataatctcaccggcgtagttaaagttcgaatcgaccacttaggcagaatcgtagacgtaggtgaatataaatga

SEQ ID NO: 5568 - RNA, 4176 nt, synthetic construct
  misc_feature 1..4176: note = Cas9 variant
  source 1..4176: mol_type = other RNA
atgaaaaaacgaatagacgattatatactgggactagatataggtactaactcatgcgggtgggctgtcacagacaaaaaaaataacctactcaaacttagaggtaaaacagccatcggtagccacctcttcgaagaaggacacaccgcagccgatcgaagagggttccggacaacccgtagaagattaaaacgacgtaaatggcgactaagactactagaagaaatatttgcagaacctatggccgaagtcgatccgggatttttcgtgagattgcaccaatcatgggtaagtcctctagacaaatccagaaaaaaataccaagccattgtattcccaactgctaaagaagaccaagaatactaccaaaaatatccaactatttatcacctacgagacgccttgatgactcaagacagacaattcgatcttcgggaaatttttcttgcaatccaccatatagttaaatacaggggaaactttctccaggatacggcagtcaaagattttgaagcatccaagatagaagtaggtcccatcctaacaaatataaacaatgcattcgcagacaaaatagtagaaggtcaggacctaattgaattaaacgtcgcaaatgctgccgaaatagaggcagtaatcaggggaaaagatgcagacaaaacactctataaaatggataaagtcaaaaaaattgctaaactactaacagatagcacagcaaaagagcaaaaaaacgtagctaaacaaatagcaaacgccatcatgggctataagacccaactcgaaactatattaggaaaagaaatcgataaaaacgacaaagcgcaatgggaattcaaactctcagacgcagatgataagttagacgccttactacctgacttagacgaaagtgaccaaacagtagtcgcagaaatcgaaaaactttttagcgcgataacactttctaccatagtagatgaaaacaaatctctaagccaaagtatggtagaaaaatataacaaacaccatcaagactacaaactgctaaaggcgtatatcgagagtttaccagaccgtgcacaagcaaaaaaattactcctagcgtatgatctttatgtaaacaatagacatggacatctcctagaagccaaaacagagtttaaacaagatagcactttaacaaaggaggacttttacaaaactgttaaggacaacttagacgacagtgaattagcacataaaatagcacaggaaattgcagcggataattttatgccaaaacaaagaactaacagcaatggagtaataccattccaactacaccaaatcgaactcgataaaataatagctaatcaaagcaaatactaccccttcttagctgctgaaaacccagtagaagaccatcgcaaacaagcgccctacaaactagatgaactagtacgattcagagtcccgtattatgtaggcccaatgataactgcagacgaacaagaaaaaacaagcggaaaatctttcgcatggatggttcgaaaagagcaaggacaaataaccccctggaatttcgaacaaaaagtagaccgacaagaatcggccaacaaattcataaaacgaatgacaatcaaagatacctatcttctcggtgaggacgtactccccgctaacagtttactatatcagcgatttgaggtactaaacgaattgaataacataagggtcaacggatcccgcatttcagtagacttaaaacagcagattttcaacgacttatttgaagagaaaaaaaccgttaccgaaaaagccttaatatcctacttaaagcaaaatctccatctacccacagttgaaataaaaggactcgcggacccaacaaaattcaactctagcttagcatcatattaccaccttaaaaacttacacgtttttgataaagaattagcagacccacaataccagaaagaattcgaaaaaataattgagtacagcagtattttcgaagacaaaaaaatatttcaagataaattacatgcagaattcaaatggctaacaccagcacaattcaaagctatcagtacttggcgactacaaggctggggacgactctcaagaaaattacttgtagaacttcacgatactaatggacaaaacatcatcgaacaactatgggattcacaaaaaaattttatgcagattgtaaccgaacctgacttcaaagaagcaattgctaaagaaaatcaaaatatcacacaggaaaatggcgtcgaagaaatcttagccgacgcttacacctcccctgctaataaaaaagcaatacgacaagttgtaaaagtagtagcagacgtcgtcaaagcagcttccggtaaggctccggcacaattcgccattgaattcacccgtgatccggataaaaacccacaattgagccacatacggggaaccaaattattaaaggcatatcaagaaaccgccggtgaacttgtagaccagaacctcacaaatagcctaaaagaagctatgacaagtagaaaactcctgaaagacaaatactttttatatttcatgcaaacgggtcgggatgcatacaccggaaaaaaaataaacatagacgaagtatcaacaaactatcaaatagaccacatattaccacagagttttatcaaggacgatagcttcgataatcgtgtcttaacagcaacaccgctcaacgcagaaaaaagcgatgacgttccctacaaacgatttgcgaataattatgtttcagatctaaaaatgacagtaggagaaatgtggaaacattggcaaaaagctggaattataaataaacacaaactcggtaatttacttcttgacccagatagactatcaaaattccaaaaatccggattcatcaaccgacaattagttgaaacatcacagatcgtaaaactagtatcggtaatacttcagaataaatatccagacgccgaaatcataacagttaaagctggtgataactctgcacttaggcagcgactagatttatacaaatctcgagacgtaaatgattatcaccacgcaatagacgcctatttgtccatagtatgtggtaattttttatatcaagtatatccaaaataccgaccctatttcgtatatggccaattcaaaaaattctcccaggatccagacctccaaaaagatctaataaaacactttaaaggcttcaccttcatgtggccactattacaaaaagataacagtgaacgaaaagcactagaagaaataaaagaaaataactcagaccgaatagttttctataaacacccagacatattcgacaagttaaggaaagcttataattataaatacatgctagtgtcaagagaaacgagcactgaaagtagcagcatgtttaacatgacgatataccctagaggagaaagagatagaaaaaaaacaagaaaattaatacccaaagggaacggtctagacccaaaaatttacggaggctattcaggtaacacagatgcatatatggtcatcgttaaaatagaaaaggccaaagagtcaatatacaaagtcataggaattcctatgagagcattagcgggacttaaacaagcaaaaaatcaaggaaactataaggaagaactacacaaagtagtcgaaccacaaataatgctagataaaaatgggaaaccaaaaaggggcgtggaaggattcagagtagtaaaagaccacgtaccattcaaacaagtagtcctagacggagacaaaaagtttatgctgtattctgcgaaatatgaaactaatgctaaacaattaacgttatcccaagaaacaatgcgcattgttacagacaatctaaaaaaatcagaggaccaagataaactactagttaaagcctatgacgaaatcttacagaaagtcgaccagtacctaccgctattcgatgttaataaatttagaaatagtcttcatctcggcagagctaaattcttagatctcgccgtaaatgataaaaagattacactatcaaatatattaaacggactgcacgataatcttgtagtaccaaatctaaaaaatataggaattaaaacaccctttggtttaatgcaaagtccaagtggcatcacattatcatctaatgcaatattaatctttcaaagtcctaccggactattcgaaaaacgtgtaagaatcgccgacctatga

SEQ ID NO: 5569 - RNA, 4176 nt, synthetic construct
  misc_feature 1..4176: note = Cas9 variant
  source 1..4176: mol_type = other RNA
atggagaacaaacaatattacattggactggatgtaggaactaactcagtaggatgggccgtaacagacacatcatacaatctactccgagcaaaaggaaaagacatgtggggggcaagattgttcgatgaggcgaaaactgcagtcgaaagaagaaccaaacgaaccagccgtagaaggtcagaaagggaaaaggcaagaaaagcaatgttaaaagaactattcgcggacgaaattaacaaagtagatccaaattttttcataagattagaagaaagtaaattttttctagatgacagaagtgaaaataaccgccaacgatacacgcttttcaatgatgcaaagttcacagacaaagactactacgagaagtacaagacaattttccacttaagatcagccctaataaattctgacgaaaaattcgacgtacgtctcgtatttttagcaatcctaaatctattctcacaccgtggtcacttcttaaacgcaagtttaaagggagacggtgagattcaaggagtagatatcttctacaatgatttatacgaagtatgtgaagagtttgaaatagatttgccacagatatcaaacattgacaattttgaaaaaatcttgtcccaaaaaggaaaatctagaacgaagatattagaagaattaagcgaagaactttcgataagcaaaaaagaaaaaataaaatactccctactaaaactgatatgtggtatgaaaatcaaagtggtagatatctacgcagacgaggacatacaagaagatgataaaaaaaaagatctcgggtttagagagagcgattacgaaaagagttccctagaagtaaaggagataataggcgatgaccacttcgaattgatagaaagagcaaaagcagtacacgatataggactactagcaaacatcatcggaaactcaaaatacttatgtgaagcaagggtcgaagcctacgacaaccaccacaaagatctccaaaaaatcaaagaacttttaaaaaaatatgacatcaaggcctacaccgacatgtttagaaaaatgacagacaaaaactactccgcatatgttggctctgtaaattctaacatagctaaagaaagaagaagtgtagacaatagaaaaattgaagacttatatgaatatataaaaaaaatcgccctaaagaatatatcagacgataacgaggacaaaatagaaatcttaaaaaaaatagagacaggcgaattcctaaaaaaacagctgacagcaagcaacggcgtaatacccaatcaactacaaagtcgtgaattaagagcaatattaaaaaaggcagaaaactacctaccattcctcaaagaaaagggcgaaaaaaacttgacggtatcagaaatgattatacaactattcgaattccaaataccatactacgtaggaccattagacaagaatccaaaaaaagataaaaatgctaacagttgggcggtaataccatcaggtggaagaatcttaccatggaactttgaagataaagtagacgtaaaaggatccagaaaagaattcattgaaaaaatggtcagaaaatgcacatatctaagcgaagaacacaccttacctaagcaatcacttttgtatgaaaaatttatggtactaaacgaaataaataatataaaaatagatggtgaaaaaattagtgtagaggccaaacaaaaaatatataacgacctcttcatgaaaggaaaaaaagtgtctcagaaagcgataaagcaggagttaatatctctgaatataatgtcaaaagatagcgttctctctggtatagacactgtgtgtaatgcatacctaagtagcatagccaaattccgcggagtgtttgacgaaaatgtaaacaaccaaagtacaatcgacatgatcgaagacataatatttctaaaaacagtatattcagacgagaaaagattcgtcaaagaagaaatagtcgaaaaatacggagatgaaatagataaggataaaataaaacgaattttaggcttcaaattttcaaattggggaaacatcagtaaatcatttttagaactagagggagcagatgtagggactggagaaatacgatcgataatacagagtttatgggaaacaaatttcaatttaatggaattactctcatcaagatttacctatatggacgaactagaaaaaagagtaaaaaaactcgaaaaacctttaagcgaatggacgatcgaagacttagacgatatgtacttaagctcacctgtgaaaagaatgatttggcagagcatgaaaatcgtagacgaaattcaaacagtcattggatacgcaccaaagcgcatattcgtagaaatgaccagatcagaaggtgaaaaagttagaacaaaatcaagaaaagatagattgaaagaattatacagcgcaatcaaagaagattccaagcaatgggtaaaagaattagatgcaaaagacgaaagttacttcagaagtaaaaaaatgtatttgtactatctacagaaaggaagatgcatgtacagcggagaggtaatagaattagataaattaatggacgataacctttatgatatagaccatatatatccaagaagtttcgtgaaagacgattcactagacaatctagtactagtaaaaaaagagatcaataatagaaaacaaaatgatcctataacgccacaaatacaagccagctgtcaaggcttttggaaggtattacacgaacaaggcttcattagtaatgaaaaatactctcgactaacacgaaagacacaggagttttccgacgaagaaaagttatcatttataaacagacaaatagtagaaacaggacaggcaaccaaatgcatggctcagatacttcaaaaaagtatgggagaagacgtcgacgtagtattctcaaaagctaggctcgtctcagaatttcgacacaaattcgaattattcaaatctcgcctcataaacgatttccaccacgcaaatgacgcttatctaaacatagttgtaggaaattcgtattttgtcaaattcacaagaaacccagctaattttataaaagacgcaagaaagaatcctgacaaccctgcctataaataccatatggacagattcttcgaaagagatgtaaaatcaaaatcagaagttgcatggattggacaaagtgaaggaaacgcaggaacgattgcaatagtaaaaaaaacaatgagtaaaaattccccgctaataacaaaaaaagtggaagaggggcacggcagcataacaaaagaaacaattgtaggtgtaaaagaaatcaaatttggcagaaacaaagtagaaaaagccgataaaacgccaaaaaaagccaatctacaagcatacagaccaataaaaacgagcgatgaaagactctgtaatatattgagatacggaggaagaactagtatatccatatcgggatattgtctcgtagaatatgtaaaaaaacggaaaaccattcgttcactagaagctattccagtatacttgggcagaaaagattcgctatctgaagaaaagctattgaattactttagatataacctcaatgacgggggcaaagatagcgtctccgacatacgactatgcctaccattcatatccacaaatagcttagtcaaaatagacggatatctatactacttaggaggcaaaaacgatgatagaatccaactgtataatgcttaccaactaaaaatgaagaaagaagaagtagaatatattagaaaaatagaaaaggcagtcagcatgtccaaattcgatgaaatagacagggaaaaaaatcctgtcctaacagaagagaaaaacatagaattatacaataaaatacaagacaaatttgaaaacaccgtattctcaaaaagaatgagtttagtgaaatacaataaaaaagatttatcattcggagactttctaaaaaacaagaagtcgaaattcgaggaaatagatttagagaaacaatgtaaagtactatataatataatctttaatttatcaaacctaaaagaagtagacttatcagatataggaggtagtaagtcaacaggcaaatgtagatgcaagaagaatataaccaactataaagaattcaaactgatacaacaatcaatcacgggactatattcttgtgaaaaagatctaatgacgatatga

SEQ ID NO: 5570 - RNA, 4176 nt, synthetic construct
  misc_feature 1..4176: note = Cas9 variant
  source 1..4176: mol_type = other RNA
atgaaacgcaacaacgactattatataggactagatatggggacaaactcagtaggatgggcaacaacaaatccccaaggcagactactaagattcaacaagaaagatatgtggggatcacgactattcgaagaagctaaaacagcggcaaaaaccagaacattcagaacctctagaagaagatacgacagggttcgacaaagaattgaatttttgcaagacattttcgcacctataatagcgaagaaagattttgaatttttcatgagattgaaagaatcaaaatttcacctagaagataaaaagacagatggaaaatttgcactatttaatgatgcagacttcactgatgttgaatactttgacaggtatccaacgatataccacctacgtgcagcgctaattaaacctaaccatataacagatcccagactcctatatctggcaatacatcacattatcaaaaacaggggccactttttatttgcgggtacagacatggaatccataagatcattccaaatagtctatacgcaactctccgaacatttgaaatcaattaatctagacttcgaactaccagtagatgcacaagacaaatttgcagctattttgctaaacgaaaaattaaacaaacgggacaaaaagaaacaactaaaagaactatgccctcataaagataaaagacttgaatacgcctttaacgcaatcataggaggaaaaaccaaactgaaagacatattcggggtagaagaatatgacgaaggcactaagaaagcagttgattttgaaaaagccgactacgacgaagacaaagatgaaatagaatcagtaataaaagaaaacatacacgtgctcaatgcacttaaagcagtatacgactggactatattaaccaacatcctaggagattatgcatacataagcgaatcccaagtcgccttatatgaagcccacaagaaagatttaagaatattgaaatctctaatcaagaaatacgcaaaaagccaatacgcagatgccttccgacacgaaaatgttaaaggaaactacgcaaactatgtcggatcaacaaattatgataacaaacaaccagttatcgacaacccatcggtaacgcaagaagacataaacaaatacttcgcggatatcctattaagcattactccagacgaatccgacagagaatcatatcaatacatcacagagagattacacaaaggcgaagcattaccaaaattgcgaacaaaagctaacagtgtattaccacaccaaatacacaaaatagaactagagaaaatacttgcaaacgcggccaaaaactttccattcttgcaagaaaaagactcctctggatacaccgccgcacagaaaatagttaaaataatgatgttccgaattgaatactacgtaggaccgctaaacacatatcatcatgtagatcaaggaggacacgcctggatggtccgaaaagctgaaggaaaaattacaccttggaattttgacgaaaaagtagacaaagaggcttcagccgaaaaattcataagaaatatgacgaataaatgcacctatcttataggaaaagatgttattccaaaacaatcacttctatattcgcgatacaaagtactaaatgaattaaacaacctaaaagttaacggagccccaatatcagtagcgcttaaacagaaaatatacgaagaactttttaagaaacaagtaaacgttactttcaaccaattaaaaacatttttaaaaacgcaaggagaagatgccgatgaaataatattatcaggcgtagatgaagctgcacacaaattcactaacaatttacaaacttaccacaaattcagagcgattctcagagataaaatagagttcgaaccccaacgttcaatggtagaagacatcataagatggaagtgtctaatgggcgacgacatcactatgtggaaacataaaattgaaaaagaatacggtgatcaactcagcgaagaacaactcaagaaaataacaagattaaactttaacggatggtcacgcttatcgcaagaatttctaacagacgtacctggagtagacatagaaagtggagaggtatactcagggataatggacgctttatggcgaaccaatgaaaatatcatgcaactcctaagcagtcgcttcacattcgcagcagaagtaaagaaacaaaatcaaggtaccggaagaattgagaaaataacatatgacgaagtcatgaaagacacctatttatcccctgcagtaaaaagatcggtttggcaagccatcaccctcgtagaagagatcagaaaaatcagaaaagcggacccgaaaagaatattcgtagaaatgactagacagccagatgccaagaaagaacgtaaactttcacgcagaacacaactattaaatgcatatagagccataggcaatgatatcgcagaatacgaaaaagaacacgtaagcacattaatcacccaattagaatcgaagaaagatgaagatctccgaaggaagaaactatacctatactttacgcaaatgggaagatgcatgtatactggggaaagaatagacttatcaagtttattacgagatactaattccaacatttatgacatcgaccatatataccccaggtcacttaccaaagacgactccttagataacaccgtattatgtaagaaagaaataaatcttaagaaaggaaacaaatatatacacagggtattcactgacaaagagctcaagaaacaatatggttattggaaagcattgaaagagaagaaattaatctccgaacgtaaattcagtagattaatgagaacaacagacctgacagctgacgaattagcaggatttatttcacgacaattagtagaaacaagtcaaatggtaaaagcaaccgcagatattttagagaaaatttacccgaatgtaactatcgtttatgttaaagctagaacggtttcagatttcagacacgactacgaactaccaaaagtccgagcacttaatgattgccaccacgcacatgacgcatatttaaatatcgtagtcggaaatgtctattatgaaaaatttaccaaatcaccatttagattcatagcgaatcaaaaagggaaaggagacatcaaatacaatttatacagactattcgataaagatgtaaaagtaggagatagaattatctggaacgcaaaagaagacctagcaagagttaaagcaacattagagagagacacagtaaatgtggtgcgtatgccagtcgaacagagaggccaattctttgatgcaacaatacagaagaaaggaacgacgaaaaacatgctagttctaccacttaaaggaagcgacgaacgacttcaagatacctcaaaatatggatattatgtccggcccagtggaatgtcgttcatggtagtacaacacgaagttaaaggaaaatcacgagtcacaatagaacctgctttattagtatataaaaacaaacttaaaagtgaagacgattacgcaaaatactgcgaagacgttctcaaattacaaaaaccaaaagttctgttcaaaaacataaaatttggatcgaagatactattcgacggctacccattcctactgaaaggaagaacggaaaacagaataataatggcagacgcccaaagtttatttcttggtaatcaagaactcaaaatactaaagagagtaacaaaaatatccgacgatatagaccataaagttgaatcacgaataaaaataacagacgaagaatggacaaccttatggaaaagtgtagttgagcagatagttactggtaaatttcgaaatagactaggcaccttaaacggtatactgcagggtagaaaaataaaattatccaaagatgaagaggccagactgaacgaactagatagtaaggatcaagaaacattcctcagtcagatactattagaaaggtttttacaatttagcacagaagagaaaactagactcctattacaagttatatcattctcaggaaacacaacaggagtggatctacgactaataggtggcagttctggaacaggtacaataaaaactaacaaaaacatcacagaccacagcgttatcctcattaacgaatcacccacaggattattcaccaacagaacggttttaaaccaaccttga

SEQ ID NO: 5571 - RNA, 4176 nt, synthetic construct
  misc_feature 1..4176: note = Cas9 variant
  source 1..4176: mol_type = other RNA
atgaaacggaacaatgattattacattggtctagatatgggaacaaatagtgtcggatgggctaccacaaatccacaaggacgcctcttacgcttcaacaagaaagacatgtggggatcacgattatttgaagaagcgaaaacggctgcaaaaacaagaacattcagaacatcaagacgaagatacgacagagtgcgacaacgaatagagttcttacaggatatttttgcgccaataattgcaaagaaagatttcgagttctttatgcgactgaaagaatcgaaattccacctagaagacaagaaaactgatggcaaattcgcacttttcaatgatgccgatttcacagatgtagaatatttcgataggtatccaacaatttaccacttaagagcagctcttataaaacctaaccatatcaccgaccctagactattatatttagctattcatcacatcattaaaaaccgaggacatttcctctttgccggaactgatatggaatccatacgcagcttccaaatcgtatatacacaattatctgaacacctaaaaagtataaacttggattttgaattaccagtagacgcacaagataaatttgcagccatcctattaaatgaaaaactcaataaaagagataagaagaaacaattaaaagaactatgcccacacaaagacaaacgtttggaatatgcgttcaacgcaataatagggggtaaaacaaaacttaaagatatttttggggtagaagaatatgacgaaggaacaaagaaagcagtagactttgaaaaagctgattacgatgaggataaagacgaaattgaaagcgtaatcaaagaaaacatacatgtattgaatgctcttaaagcggtatacgattggacgatattaacaaacatcttaggcgactatgcctatatttcagaaagccaagtagcactatacgaggcacacaagaaagacctcaggatcctaaaatcattaataaagaaatacgcaaaaagtcaatatgcagacgccttcagacatgaaaacgtcaaagggaattatgccaattatgtcggatctacaaactacgataacaaacaaccagtgatagacaatccctcagtcacccaggaagacatcaacaaatatttcgcagacatcttactttccataacgcctgacgaatcagacagagaatcttaccagtatataacagaaagattacataaaggagaagccctaccaaaattaagaacaaaagcaaactcggtattaccacaccaaatacacaaaatagaactagagaaaatcttagcaaacgccgccaaaaacttcccctttttacaagaaaaagactccagcggatataccgcagctcagaaaatagtcaaaataatgatgtttcgaattgaatactacgtcggacccctaaatacttaccaccacgtcgatcaaggtggccacgcttggatggtaaggaaagcagaagggaaaatcacaccatggaattttgatgaaaaagttgataaagaagccagtgcagaaaaatttataagaaatatgaccaataaatgtacgtacctgattggaaaagatgtaataccaaaacaatcactactatatagcagatacaaagtcctaaacgaattaaacaatctaaaagtaaatggagttcctatatctgtagcattaaaacagaaaatatatgaggaactatttaagaaacaagttaatgtcacattcaatcaactcaaaactttccttaaaacacaaggtgaagatgcagatgaaataatactcagcggagttgatgaagctgcccacaaatttaccaataacctacaaacataccataaattcagagcaatccttagggataaaatcgaatttgaaccacaacgatccatggttgaagatataattcgatggaaatgcctaatgggagatgacataactatgtggaaacataaaattgaaaaagaatacggagatcaactctctgaagaacaacttaagaagatcacacgactcaacttcaacggttggtcaagattaagtcaagaatttctaacagacgtgcccggagtggacatagaaagcggagaagtatatagtggcataatggacgccctatggcgcacaaacgaaaatataatgcaattactaagcagtagattcacattcgcagccgaagtaaagaaacagaaccagggcacaggaagaattgagaaaatcacatacgacgaagtcatgaaagatacctatctatcaccggccgtaaagcgatctgtgtggcaagcgataaccctagtcgaagaaataagaaaaataagaaaggcggaccccaaacgaatattcgtagaaatgacaagacaaccagacgccaaaaaggaacgaaaattatctcgacgtacacaattattaaatgcgtaccgagctatcggaaacgacatagctgaatatgaaaaggaacacgtgtcaacactaataacacaattagaatcaaagaaagatgaagatctaagaaggaagaaactctatttatacttcacacaaatgggaaggtgcatgtacacgggggaacgaatagacttgtcatctcttttacgagatacaaactcaaacatatacgatatagaccacatatatccgaggagtctaacaaaagatgacagcctagacaatactgtactctgcaagaaagagataaatctaaagaaaggaaataaatacatccaccgagtttttacagataaagaactaaagaaacagtatgggtattggaaagcactaaaagaaaagaaacttattagtgaacgcaaattttcacgcctcatgagaacaacggatctaacagcagacgaactcgctggctttatttcaagacaactggtagaaacatcacaaatggtaaaagcaacagctgatattctagagaaaatttaccccaacgtaacaatcgtctacgtaaaagcacgaaccgtctcagacttccgacatgattatgaactaccaaaagttagagctctcaacgactgtcatcatgcccatgacgcctacctaaacatcgtagtcggcaatgtgtactacgaaaaatttacaaaatctccattcaggtttatagctaaccaaaaaggaaaaggtgacataaaatataacctctatcgactattcgacaaagacgtgaaagtaggagacagaataatatggaatgcaaaagaagatttagcacgagtaaaagccacattagaacgagacacagttaacgttgtaagaatgccagtcgaacaacgcgggcaatttttcgatgcaactatacaaaagaaaggtacaactaaaaacatgctagtactgcctttaaaaggaagcgacgaaagactacaagatacatctaaatacggttactacgtacgaccaagtggtatgtctttcatggttgtccaacacgaagtaaaaggaaaatcccgagtaaccatagaaccagcattacttgtatacaaaaacaaactgaaatcagaagatgattatgcaaaatactgcgaggacgtattaaaactacaaaaaccaaaagtattatttaaaaacataaaatttggctcaaaaatattatttgacggatatccatttctccttaaaggtagaactgaaaaccgaataatcatggccgacgctcaaagtctctttctaggtaaccaagaactcaaaatacttaaacgggtaacaaaaataagtgatgacatagaccacaaagttgaatcacgcataaaaataactgacgaagaatggacaacgttatggaaaagtgtagtagagcaaattgtaactggaaaatttagaaatagactaggaaccctaaatgggatacttcaagggcgtaaaataaaactgagcaaagacgaagaagcaagactaaacgaattagatagcaaagaccaagagactttcttaagccaaatattactagaaagatttttacaatttagtacagaagagaaaactagattattattacaggttatctcattttccggcaacaccacaggtgtagacttaagactaataggagggtcgtcaggaactggcaccatcaaaacaaataaaaacataactgaccattccgtaatccttataaatgaaagtcccaccggattatttacaaatagaacagtgctaaatcaaccatga

SEQ ID NO: 5572 - RNA, 4179 nt, synthetic construct
  misc_feature 1..4179: note = Cas9 variant
  source 1..4179: mol_type = other RNA
atgaaaagcatactcggacttgatctaggcacaaccagtatcggatgggcacttgtaaaagaatcggaaaacgacaacgagaaaagtgaaatagtgaaactgggtgtacgattagttcctctaacaactgacgaacgtacagatttcgaaaaaggaaaatcaattacgaccaacgctgatcgaacaagtaaaagatcaatgagaagaaatctacaacgatacaaacttcgaagagaagcgctagtaagcgaactaaagaaagaacactggatagatgaaggctatcgtttctcggaagatggcccaggatcaacgttttccactctgcgtttacgagcaaaagcagctgaagaggagatatcactacaagatctagctaaagtactcctacaaataaataagaaacgaggatataaaagctcgaggaaattaaatagcgccgaagacggacaagcaatagacggtatgtcagtggcaaaggtattatatgataggggccttactcccggtgaatacgtctatcagcgaatgttagatggacagtatgcaattccggaattttacaaaagcgacttacaagctgaatttgacaaaatatggaacttacagaaatcatactacccagaattaacagccgagctctatgacaaattaaccgataaaaacaagtctcaaacatgggcaatatgccgtgatgaactcggagtacaaggatttaaatcttcatttaccgggaaagaaagattaaaagaagcatattttaatagacaacaggcttctaaacaaaaagtagatttagaagttttaacctgtgttctccaagacataaacggacaaaaagcgagtctttctggtttattatctgcaataagtgacagatcaaaagaactgtatttcaacaggatgacagtagggcaaatgttagtgagacaaatacaagaagatccaaatcgctcacttcgaaatacagtgttttatcgtcaagactacattgacgagtttgagaaaatatggtcagttcaaagtagatttcatcccgaactaactcaagaacgtaaaaagaaattaaaagacattataatattttaccaacgcccattgaaatcgcaaaaaggtctaattagcctctgtgaatttgaatcccgtgaggtagatatatcagtggacggcgtaataaagaaaaagaaaataggacctcgagtatgtcccagaagcagtcctttatttcaagagttcaaagtatatcagaccgtgaacaacattttagtcaacggtgaaccacttgatgataatgatagagaaaaattagtgggagaactagcgttcagagagaaaatgaaaggacaagatgtgctgaaactattatataaaacaagtaaagggatgagaatcaactttgaagaagtagaaggcaacagaacaatggcaacaattctaaaagcctgtgagaaaatagtagaaggactagggtacgacacccgagacttaagcaaaataacagcctcagaaaaagtaagccgaatagaagaaattttcgccaaagaaggatttaaatctgactttctccatttcgatagttcgctgccctcaccagagttcgaaagccaagcatcgtactcactctggcatctgttatacagttacgaaaacgacaaatcagtatcaggaaatgaatctttagtagagaaaattaagaaattatgctcaatggacgaagctagcgctaaaatattgtcgggatgtacatttctttcagattatgggtcattatcagcacgcgccatgagaaaaatactaccttatatgaaagatgggctagaatactctgctgcatgtgcaatggctggatacaggcattcaaaaagatccttaacaaaagaagaattagattcacgagtttacgtagatcggctcgaattactccctaaaaatagtttacgtaatccagtagtagagaaaatactcaatcaaatgataaatgtcgtaaattcagttgtagatacatatggaaaacccgacgaaataagaatagaaatggctcgagaactaaagaaatccgctagcgaaagagaaaaagcacaaaaagatatagctgcagcgagcaaagtaaacgaatcaattgtagcaaccttaaaaggttcaccatttttcatagacagtccctcaagaaatgacattataagatataggttatgggaagaattaaaaccaaacggatacaaaaccctatattccgggacttatatacccaaagaaagattattcagcaaagatttcgatatagaacatataatcccacaagcccttctatttgacgactccttcgcaaacaaaactatcgaaagtcggcaatgcaatattgagaaaagcaaccgaacggcaatggattatgtaaaaagtaaatatgacagtttcggggtacaagcatatatagacagggtaaaaggtttaacaggagtatcaaaaacaaagattacaagattattaatggaatccaaagatataccagaagactttataaatagagaattaagagactcacaatacattgcgcgaaaagcacgcgaaattctagaatcaatggtcaagttcgtagtccctactaccggaagtgtgacagctcgcttacgagaagattggcaacttgtgaatgtcatgagagaattaaactgggacaaatatgaaaaattaggcctaacatcttttcgcgaagatagggatggaagagaaattccagttattgaagactggactaagagaaatgatcataggcatcacgccatggatgcgttaacaattgcttttactagaaggcaattcattcaatacttgaaccacctaaatgcaaagatagatacagttgataaaactgatatagatttaagagattataatctagaagatatatcctttgacggattgagagatggagacaaattcgggatagttaaagccctacagaaaaagtatctatataaagatgacaaacaaaaatacagattcgtaccacctatgcccttagacgaatttagaatcgaagctaaacgccaaatcgaagacgtattagtcagtttcaaagctaaaaataaagtatgtactaaaaatgttaatacaacaaaagttcgaggtggtcaacaaagaaaaatacaactaactcctagaggaccgttacacgaagacaccatatatgggaaaagactacaatatgtaacaaaagaagaaaaggtaggcgggagttttgacgaagcaaagatagctagtgtctgcaaaaagtcatatagagaagctcttatgagaaggctcatggaatgcggaggagacccgaagaaagcattcacagggaaaaatagccttgagaaaaacccggtctgggttgatgagttccactcaggagaagttcccctcagagtaagaacagtttcaatggctagcgtatatactgtaagaaaaagtgtcggtcaatctttaaatattgaaaaagtattagacaaacacattaaggaaattcttcgggctcgactagaagaatatggaggaaacgcctcaaaggcattttcgaatttagacgaaaaccccatatggctaaataaagaaaaaggaatagcagttaaaagagtaacaatcgattcaggcaaaaatcccatccccctgagatccaaactagacaaagatggacaaatcatatacggcgaaggacaaaatccacaagaatctgattttgttgtacctggtggcaaccatcacgctgcaatatacagaacgccatcaggaaaactacaagacgtggtagtgtcattctacgaagcagtaagtaggaaaaacctaggattagaagtaatagatcgaaattttaagaaagacgaaggttgggagtttctatttactttaaaacaaaatgagtactttgtattcccaaatccagcaaccggattctcaccagaagattacgatttgaccgacccagcaaacaacgcaatcatatcacctaatctttaccgggtgcagacggtaagcgtaggtgattatagatttagacaccatctagaaacaacggtagaagataatgaaaaactaagagatatagcttggaaaagaataggcccatctggcttagtaggagctgtcaaagtaaggatagacaatttgggacgaatattagccgtaggagaatatgattga

SEQ ID NO: 5573 - RNA, 4179 nt, synthetic construct
  misc_feature 1..4179: note = Cas9 variant
  source 1..4179: mol_type = other RNA
atggaaaacaaaaactactcaattggactagacataggaactaattcagttggatgggctgtcattacagacgattataaagtaccttctaagaaaatgaaagtattcggaaatacagacaaacattttataaagaaaaatcttataggagcactattatttgacgaaggtgcaacagcagaagaccgaagattaaaaagaaccgctagaagaaggtacacacgccgtaaaaatagactacgataccttcaagaaatattcagcgaagaaataagtaaacttgacagctcgttcttccatcggcttgacgattcgttcctcgtcccaaaagacaaaagaggctcaaaataccctatattcgcaacattagaggaagaaaaagagtatcacaagaaatttcctaccatatatcacttaagaaaacacctagcagattccaaagagaaaaccgacctaagactcatatacctagcgctagcacatatgataaaatacagagggcactttctatatgaagaatccttcgatatcaaaaataatgatatacagaaaatatttaacgagttcataagcatatacgacaacacctttgaaggttcatcgttatctggtcaaaatgcacaagttgaagccatcttcaccgacaaaattagcaaatcagctaaaagagaaagggtattaaaacttttctcagatgaaaaatcaacgtcattatttagcgaatttttaaaactaatagttggcaaccaagcagactttaagaaacactttgatctcgaagaaaaagccccattacaatttagcaaagacacatacgatgaagatctcgaaaacctccttggacaaataggcgatggattcacagacttatttctagttgctaagaaattatacgacgccatattgctcagtggaatacttacagtaactgaccccagcaccaaagccccacttagtgcttcaatgatagaaaggtacgaatcccaccaaaaagacctagcagctctcaaacaattcatcaaaaacaacttaccaaaaagatacaatgaagtatttagtgaccaatcaaaagatgggtacgctgggtacatagatggaaaaaccacacaagaggctttttacaaatacatcaaaaacttacttagtaaatttgaaggagcagactatttcctagataaaatagaacgagaagatttcctcagaaaacaacgaaccttcgacaacgggtcaataccgcatcaaatacacttacaagaaatgaacgccatactaagaagacaaggagaacattacccatttttaaaagaaaacagagagaaaatagagaaaattttgaccttcagaataccctactatgtaggaccactcgctagaggcaatagagacttcgcttggctaacaagaaatagcgaccaagctataagaccgtggaattttgaagaaattgtcgataaagcatcctcagccgaagaatttataaataaaatgacaaactatgacctatacctaccagaagaaaaagtactaccaaaacatagtttgttatatgaaaccttcgctgtatataacgaattaaccaaagtaaaatttattgcagaaggtctacgggactaccaattcttagacagtggacaaaagaaacaaatagtaaatcaactctttaaagaaaaacgaaaagtgaccgaaaaagacataatccattatctacacaatgtcgacggttatgatggaattgaattaaaaggaatagaaaaacaatttaatgccagcctaagtacatatcatgacctactgaaaattataaaagataaagaatttatggacgatcccaaaaacgaagaaatacttgaaaacatagttcacacgctaaccatattcgaagacagagaaatgatcaaacaaagactagcacaatatgattcaatattcgatgaaaaagtaatcaaagctctaacaagaagacactataccggctggggaaaactatcggcaaaattaataaacggtatatgtgacaaacaaactggagatacaatcttagattacttaattgacgatggaaaaataaatagaaacttcatgcagctcataaatgacgacggtctcagctttaaagaaatcatccaaaaagcccaagtggtaggcaaaaccgacgacgtcaaacaggtagtacaagaactaccaggatcaccagcaatcaagaaaggaatattacaatctataaaaatagtagacgaattagtaaaagtaatgggttacgcaccagaatctatcgtaattgaaatggcacgagaaaaccaaactacggcccgtggcaagaaaaactcacagcaaagatataaacgtattgaagactcactgaaaaacttagcaccaggcctagactcaaacatcctaaaagaaaatcctactgacaacatacaactacaaaacgatcgactgtttttatattatttacaaaacggcaaagatatgtacacgggtaaacccttggatatagatcaactgtcaagttacgacatcgatcacatcataccacaagcattcattaaagacgactcaattgacaatcgagtactaacaagttctaaggacaacagaggcaaatcagacaatgtaccgtctctagaagtcgtacaaaagagaaaagccttttggcaacaactgctagacagtaaactgatcagcgaacgcaaattcaataatttaacaaaagccgaacgtggcggcctagatgaaagagataaagtcggttttatccggcgtcagctagtcgaaactagacaaatcaccaaacacgtcgcccaaatattagatgcaagttttaacaccgaagtaaatgaaaagaaccagaaaatacgtactgttaaaataatcaccctgaaatcaaacctggtaagcaattttcgcaaagaatttgaactttacaaagtcagagaaataaatgactatcatcacgcacacgacgcatatctaaatgcagtagtcgcaaaagccatcttaaagaaatatccaaaacttgaaccagagttcgtatacggggactaccaaaaatacgacctaaaaagatatataagtagattcaaaccatctaaagagatagaaaaagcaactgaaaaatatttcttctactctaacttattaaacttcttcaaagaagaagtacattacgcagatggaataatagtaaaaagagagaatatagaatacagcaaagatactggagaaatagcttggaacaaagaaaaggattttgcaaccatcaagaaagtattatcatacccacaagtaaatatagtcaagaaaacggaaatccaaacacacggcctcgacagaggtaaaccaaaaggtctcttcaactcaaacccatccccaaaacccagtgaggattcaaaggaaaatctagttccaatcaagcagggcttggaccctcgcaagtacggaggctatgctggtatctcaaactcttacgcagttctagtaaaagccatagtagaaaaaggcgccaagaaacaacagaaaaccatcctagagttccaaggaatttcaatattagacaaaatcaatttcgaaaacaataaagagaactatctcctaaagaaacgatacatagaaatactaagcacaatcacattaccgaaatacagcttatttgagttccctgatggaacccgaagaaggttagcctcaatactatcaacaaataataaacgaggagagatccacaaaggaaatgagctagtcttacccggcaaatacaccacattactataccatgctaaaaacataaacaagaaactcgaacctgaacatctcgaatacgtagaaaagcatagaaatgattttgcaaagctattagaatgcgtcttaaatttcaacgacaaatacgtaggagccctcaaaaacggggaaagaataagacaagcattcaccgactgggaaaccgttgacatagaaaaactatgcttctcgttcattgggcccgaaaattcaaagaacgcaggattatttgaactcacatcccaagggagcgcctcagatttcgaatttcttggtgtaaagattcctagatatcgagactatgccccatcatcgctattaaaagccacactaattcatcaatcgataaccggattatatgaaactagaatcgacttatcaaaattaggtgaagattga

SEQ ID NO: 5574 - RNA, 4179 nt, synthetic construct
  misc_feature 1..4179: note = Cas9 variant
  source 1..4179: mol_type = other RNA
atgaacaataataactattcaattggattagatataggaacgaactctgtaggatgggctgtaataacagacgattacaaagtcccatctaagaaaatgaaagtactaggcaacaccgataaacacttcatcaagaaaaatctaataggggcactgctgtttgatgaaggtgcaactgcggaagatagacgattcaaaagaaccgccagaagaagatacaccagaaggaaaaaccgactaagatacctacaagaaatattttcagaagaaatgagtaaagtggattctagcttctttcatcgcttagacgactcattcctagtccccgaagataaaaggggatctaaatacccaatatttgctaccctagcagaagaaaaagaatatcataagaaattcccaacaatataccacctgaggaaacatctagccgactcaaaagagaaaactgacctaagactaatatatttagccttagcccacatgataaaatacagaggacacttcttatacgaagaatctttcgatatcaaaaataacgatatacagaaaatattttccgagttcatttctatatacgataatactttcgaaggatcatcactatccggtcaaaatgcacaagtagaagctatttttacagataaaataagcaaatcagcaaaacgcgaaagaatactaaaactatttgcttatgaaaaatcaactgatctcttctctgagttcttaaaattaatcgtaggcaatcaagcagacttcaagaaacactttgatttagaagaaaaagcccctctacaattctcgaaagatacatacgatgaagatctcgaaaacttgttaggccaaatcggagacgatttcgccgacttattcctagttgctaagaaactctacgatgcaattctactgagcggcatactaacagtaactgattctagcactaaagccccgctcagcgcctcaatgatagaacgttatgaaaatcaccaaaaagacctagcagcactaaaacaattcatccaaaataacctacaagaaaaatacgatgaagtcttctcagaccaatcaaaagatggatacgcaagatatataaatggaaaaacaacacaagaggctttctacaaatacattaaaaacctattaagtaaattcgagggttctgattactttttagacaaaatagagcgagaagacttcctacgaaaacaacgaactttcgacaacggatcaataccgcatcaaatccacctacaagaaatgaacgccataatacggcgccagggcgaacactatccatttcttaaagaatacaaagaaaagatcgaaactatattaacatttagaataccatactacgtaggacctctagccagaggtaatcgaaacttcgcgtggctaactcgtaactccgaccaagcaatcaggccctggaacttcgaagaaatcgttgaccaagcatcatcagccgaagagttcataaacaaaatgacaaattacgatctttacctcccagaagaaaaagttttacctaaacactcacttttatatgaaacttttgcagtatataatgaactaaccaaagtcaaatttatctctgaaggactcagagactaccaattcctggatagcgggcaaaagaaacaaatagtcaatcaactgttcaaagagaaaagaaaagtaacagaaaaagacatcatccaatacttgcataacgtagatggatacgacggaatcgaactcaaaggtatagaaaaacaattcaacgcatccctaagcacctaccacgatttacttaaaataattaaagacaaagaatttatggacgaccctaaaaacgaagaaatacttgaaaatatcgtacacacactaacgattttcgaagacagagaaatgataaaacaacgattagctcaatatgcatccatttttgataagaaagtaatcaaagcacttaccagaagacactataccggatggggaaaactatcagcgaaacttatcaacggaatctgtgataagaaaacaggtaaaacgatactagattacctcatagacgatggctatagtaaccgaaacttcatgcaactaattaacgacgacggacttagtttcaaagacataatacaaaaagcacaagtagtaggaaaaacaaatgatgtcaaacaagtagtacaggaacttccaggcagtccagcaattaagaaaggaatcctacaatcgatcaaattagtcgatgaactcgtaaaagttatgggccatgcacccgaatcaattgtaatagaaatcgcccgggaaaaccaaaccacagcacgaggtaagaaaaattcacaacaacgatacaaaagaatagaagacgctctcaaaaatctagcaccaggactcgactcaaacattctaaaagaacacccaacagataacatacaactacagaacgatagactatttctctattatttacaaaatgggaaagatatgtacacaggagaagcacttgacataaatcagctatcatcatatgacatagaccacatagtacctcaggcttttattaaagacgattccctcgacaacagagttctaaccagctcaaaagacaatcgtggaaaaagtgacaatgtaccgtccttagaagtagtacagaaaagaaaagcattctggcaacaacttttagacagtaaacttatctcagaacacaaattcaataacttaacaaaagctgaaagaggaggcttagacgaaagagataaagtaggattcataagacgccagctagtagaaactagacaaatcacaaaacacgttgctcaaatactagatgccagattcaatacagaagtcaacgaaaaagacaagaaaaatcgaacagtaaaaataatcactctaaaaagcaatttagttagtaatttcaggaaggaatttaaactctataaagttagggaaatcaatgattatcatcacgcacatgatgcatacctaaatgccgtcgtcgcgaaagctatacttaaaaagtacccaaaactagaacccggatttgtatatggagattaccaaaaatatgacataaaaagatacatatccagatcaaaagacccgaaagaagtagaaaaggcaacagaaaaatatttcttctattcaaatttgctaaacttctttaaagaagaagtccactatgctgatggaacaatcgtaaaaagagaaaatatcgaatattcaaaagatacaggagaaatcgcgtggaacaaagaaaaagatttcgcaacaattaagaaagtactaagcctcccccaagtaaatatagtcaagaaaaccgagatacaaacacatggacttgatcggggtaaaccacgcggcctatttaactcgaacccatcacctaagccttcagaagatcgaaaagaaaatctggtcccaatcaagcaaggactagatccaagaaaatacggaggttacgctggaatatcgaactcttacgccgtactcgtaaaggcaattatagaaaagggagccaagaaacaacagaaaacagttctcgagttccaaggaataagcatactcgataaaataaactttgaaaagaacaaagaaaattaccttctagaaaaaggctacattaaaattctctcaacaataaccctcccaaaatactctttattcgagttcccagatgggacacggagaagactcgcgtctatactatctaccaacaacaagagaggagaaatacacaaaggaaacgaattagtaataccagaaaaatacacaacattactataccacgccaaaaacataaataaaacactagaacctgaacacttagaatacgtagaaaaacacagaaacgactttgcaaaactcctagaatacgttttaaacttcaacgacaaatacgtcggagcacttaaaaacggagaaagaatccgccaggcttttattgactgggaaacagtagacatagaaaagttatgtttctcattcataggcccacgaaattcgaaaaatgcaggactattcgaactaacctcacagggatcagcaagcgactttgaatttctcggcgtaaaaattcccagatacagggactacacaccttcgtccttactgaatgcaacattgattcaccaatcaataactggactctatgaaaccagaatagatctatcaaaattgggagaagactga

SEQ ID NO: 5575 - RNA, 4179 nt, synthetic construct
  misc_feature 1..4179: note = Cas9 variant
  source 1..4179: mol_type = other RNA
atgaaaaactaccacataggactagatataggaaccagttccgtaggcttcgccgcaagagatgacgaaaacaatttaatacgagtaaaaggaaagaacgtaataggcgctagattattcgcagaaggaaaaacagcccaagaacgaagaatggctaggacctcaagaagacgatataacagacggaagtggagactaagattgttaaatgacatttttcacgacgaaatagtgcataaagataaagatttctttaataggctaaagcaaagtagtattagtccaaaagacgaccgaaagaaatactttggttctctcctatttccagagctaagtgactcggagttctatcataacggaaaccaaactatctatcatttaagacaccgattaatgacgtccaatgaaaaagccgatataagagaaatctatttagcactacgacatatagtaaaatatagaggcaactttttggatgacacgcccgtcagctcttttgaagcctcagacttaaaacttggttcattcattcctacattgaatgatctattcgaaacaatagacgtaaattacgtgtttaattccgaaaacacaaaccaaatcgaaagcatcctactcaataacgatctccgcaacagcgataaatccaaacagctagtagatttattataccgtaacgtttccgatgtagacgacaaatccttagaaaaacaatttaacaaattcagaaaagacatttcaaaagaaatagcaaaatcatttgtaggatccaaattcaacgtaaacaaattgcttgcttatgaaacagacgatggaagcaaaatctccctatctttctctgacgcctcttctgatgataaaatgctagaattagcagacaacctcgatgacgaacgaattaatatactcaacgcactaaaggtcatctattcaagagttcgtcttaaccaaataatacccaacggcatgggactctcagaatcaatgatagcaagctatgaactccacaagaaacaactaaatgacttaaagaaattgttaaacgtactacctttccatgaaaaatatgcagtaaaagtagcatacgcagcatatatcggaaacatggatgcacagaaattcactcaagcagaactgagtacaatcgaatcactaaaagaaaaagacagtatcaagaaagtcatagactgcaaaacaggtcatataacgaatgaaagtctcatatccgttattaaccaaatagtagttaatccatatttagaaaactccgactttgagctaatagatattgtaaagaaaatagatcaagatatcaaaaatggcgaatatctattaaaacagcgaaataaccaaaacggcaatatcccacaccaattacaccaaatggaaatggatcaaatcatagaaaaacaaagcaaatactacccattccttggcgaactaaaccccaacgaaaaccgacgtcacatcgcaaaatacaaaatttcggaactcgtagcgtttagagttccctattacgtaggaccattgataaccccagaagaacaagcaaaaacatccggggctagcttcgcttggatgaaaaggaaagaagacggagaaattaccccttggaacttcgaccaaaaagtagacagagaagcaacagcctcaagattcataaaaagactaacagtcaaggacacttatctgttcaatgaagatgttttaccagataattcactcctataccaacaattcaaagtactaaatgagttaaacgtagtaaaagtcaacaacaaaaggttatcgcaagccgaaaaacaaggagcattcaacgacctcttcaaagtcaccaaaacagtcaccgcaaaaagacttaaaaattatctcgtatccaactttaaccatctagacacaatagaaattacaggactatcagacggcgaaaaatttaataatggactaacaagctatgtagattttcagaaaatatttggcgataaaataaataacctcgaattaatggacgactttgaatcattaattgaatggtcaaccgtgttcgaagaccgacatatttttgaagaaaaggttagaaacgaaataaactggattagtgaaagcgaattaaaacaattagtagcaaaaaggtattcgggatggggacgactctcaagtaaattactggttggcataaataacgatgaaggtcgcaatataatagaacaattatttgaaacaagcgaaacatttatggaggccatatcaagacctgaagttaagaaacaaatagatgaaataaactccgattttatcaaaaacacagatatcgaaagcgtattagcagacgcatatacctctccacaaaacaagaaagcaattagggaaacgtacaaaatcgtaaaagatatacaaaaagcaatgggcgggaaagcccctgaatcaatatcaatagagttcacccgaaacccagaagacaaaggtgaacttactcgtagtagacactcagaaatctctagaaaatacaaagaattatcaaaagaaatcagcaaagaactaaatgatgagttaaaatctaagaaaaacagcatggacatagataaatattacttatatttcatgcaaatggggaaagacctatatgatggaaaatcaatagatatcgatgatctaaataactaccaaatagaccacatagtaccacagtctttttataaagacgattcatttgacaacagagtgttaacttattatacaaacaaccagaagaaaggcaataacacacccctaaatggcctaaacatatcaaatgaaaccagaaaattatggagccacctccatgacttaggtctgataagcaaacgaaaatatctaaacctcactatgcaaggtttagactcattatcaaaatacacaaaacacggttttattagacggcagctagttgaaacctcccaagtaataaaactggtagctaatatcctaagcgacgagttctcagccgacaacaccaaaataattgaagttaaagcaaaaatgaatagccaaatgagacatagtttcaacctctacaaaatccgagaactaaacgattaccatcacgctctagatgcatacttaacaacatttataggaggctatctatataatagataccccaaactccgaggtatgttcgtatacggtgatttcaagaaattcgacgtaaatgacgccaataacgtaaaaaccctgaactttttacacgatattactaatccaagtgataaattcgtaaaccaaatctacgacgaacaatcaggagaattaattctagatagaaaacacgcgatcgaaacaataaagaaaatataccaatacaaatttatgctaataacacgtgaagtaagtaccaaagacgacaaactaagtgaccaaacagtatattcggcaaaaagaataaacaacgttgcaagcccgataccagttaagaaagattcaaatccagaactatatggatttagaacaggcaacgtagaccaccacatggttatagttaaatacccaaagaaagattcttttgtatacaaagttgttggcatacccatcagattcatgcaagaattacgaagctctaaaaaccaaagtgaatatgaaaacacactaaaccaaatagtacaagcaaaattaaacagaaagaaatttgacttccgagtagtggttgacaatgttatgtacggccaattaattcaagatggaggccaaaaatttacccttggtagctccacatatagatacaacgctaaacaactcgtccttgatatggattcactcaggatattaagcgacgaaaaatacagaaactcattaactgacgatgagaaaaattcagaatttattaacatatatcaacaagtactcaatgtagtaaacgaaaaattcgacgttttcgacgtcaggggcacacgagataaactgacaaaaggattagacaaattcctaaacatcacatcgaatgacaaagagattgtactcttaaaaatactatcaggtctacactgcaatgccgcccgagtaaaaataaacgaaatagggataaatacttcatttggcgagctacaaaccactcacggaattgttctatcagaaaactcctatataatataccaatctccctcaggactattcgaacgtaaagtcagactaaaagatctatga

SEQ ID NO: 5576 - RNA, 4179 nt, synthetic construct
  misc_feature 1..4179: note = Cas9 variant
  source 1..4179: mol_type = other RNA
atggcaaataaaacttggtacctaggtttagatataggaagcgcaagcgtaggctgggcagcaacggacacgggatataaaataatacgtaaaaacaagaagcgattatggggagttagactgttcgaagaagctaaaaccgccgaagatcgaaggggataccggtcaagtagaagaagattagcacgcagaaaatggagattaaacttgctagaagagttatttacaagcgaggtaaaaaaagtagacgaaaattttttcttaagattaaaagaatcgcaataccattacgaagataaaacgcacaaggtgccatacgccattttcaatgacaaagactatacagacaaagattactataaagactacccaacaatataccatctaagatcaaaactaatgactgaagaaaatccagacataagaaaggttttcctagcaatccatcatatcatcaaaaaccgcggacacttcttactacaaggacaatcatttaaagatggcaacctaaataatctcataaaagaactcttagaattggatatattacatgtcgggtttgaagtaacagaagaagtcgtagacaaaatagcagatataagtttggagaaaaagacatcgaaagataaacttaacgacatcaaagaactatatcctaaagaaaaacaacttttagaagttttcaggctcatattcggaggcaaaacaagtctagataaactatttgctatagacgaatataaagaactggacgcagctataaagagtgtaagtttcaaagaaaaaatttatgaagaagttagacacgattatgagcaagtcctatcaaattatatagagcttctcgacttggcaaaactagtttacgatagtataattctttcagacataaagaaagagggtaaaacactaagcgaaagcaaagtcgaattattcgaaaaacatagagacgacctcttgaaactaaaaaatttagtaaaaaacgactcaaaactatcagaagacaaaaaagttgaactttacgcactaatatttaaagaagataaagacaaaggtacaaactacgttaactatataagaaagagcgaagaaggaaaagggtgcaactacgaagattttaaaaagtttcttgtaaaagaattagcaaaactagaagaaagttccgtaaaaactgaaataataaaggacctcgaactggaacaatttctcccgctacaaaggaccaaagacaatagtgtcgtaccatatcaaatccataaagaggagcttgtgaaaatattagacaatgcagctagatatcatagtttccttaacgaaaaagacgaaagtggctataatgtaagagaaaaagttatacaattattagaatttcgtattccctactatgtggggccattgaatagtagcaaaaaagcaaaagagggaggattcgcatggagtgtacgaaatacgggttacgaaaacacaccagttacaccatggaactacagtaaagttatcgacgaaagtgcgtcagcagaaaaattcatcaccaacctaacgaacaaatgcacatacttaaaaggagaggacgttctgccaaaaagtagtctattatactcagaattcgcattactgaatgaactgaacgctttaaaatatgacggtaaccgaatctctcttgaagcaaggaacaccatcatagaaaaattatttaaacagcaaggaaagaaagtgactaaaacctcaattaaaaatttactaaaagccgaaggatatatagatggaaaaggcgaaataacaggcattgacattacagtcaagaacgacttaaagtcatatagagactttaaaaaaatattaggaaataaattcaattccgaacacgtagaaaacataatattatggatcacactatatggagaaagtcgaaaactgataaaggccaaaatcgaatcagtatacggagaagtatactcaaaagatgagataactaaaatgagcagattggtctataaagactggggcagattcagccgtaaacttctaaccgaattggtctcgaaaaaattatacaatgaagaaactggagaatgcctgaacatcataggagcaatgagacaaaacaacatactgttcatggaactcttagcagacagatttgactacagtaaacaaatagtcgaatttaataaagaattacaagaagacgtgaccgaaattgcaccagaaatattggatgacctctacgttagcccagccgtaaaaaggtcaatctggcaaacagtaaggatagtcgaagaactcaaaaaaataataggatgcgctcccgccaaaattttcgtcgagaccacacgcagcaaccaagagaaaaaaaaaccaacagacagtagaaagaaacaactggaactcgcatacaaagccgtaaagaaagatgtcaaagagttagaaaaagaaattggcacaataaatttcgatgtactaaacgatagactaagttcagttgaaccaagtaaactaaaagcaaaaaagctctacctatactacactcagctaggaagatgtatgtatagcgaagagcctattaatatttctgaattattcgacaataataaatatgacatagaccatatctacccccagtccaaaatcaaagatgactcattcaccaatacggtacttgttaaacgcgaatcaaacgctgctaaaactgacaggtaccctctaggctctgacatccaaacaccctctaacaggaggttctggaagttcttaaaggaaaaaggactgatatcggatgagaaatacaataggttggtgcgaactgaagaattctctgatgaagaactttcaggtttcatagcacgtcaactcgtcgaaacctcacaatcagttaaagccgtagcttcaatactaggagaactaaacccagaaacttctatctgctatagtaaagcagaaaacgtaagtagctttagacaaaacttcggtaaaataaaaaagggtgaccgcgatagcaaaaacaacgatcaactaataaaagtcagagaaatcaatgattaccatcatgcaaaagatgcatacctcaatgtagtagtaggaaatgtatatgatacaaaattcaccagaaacgtttttaactttataaaagataaaaaagacggacgcaaatattcactaaataaagttttttatgaaaacgttagtgactccaaaaccgttgcatgggaaatggataaaaccatacaccaagtagaaaaagtaatgaataataacaacataatggtaacgagaagaacctcagaacagaaaggaggcctatttgacgcaaccgtatacaaagcaaaagtagcggcgaaagcaaaagatggcgtatactatccattaaaaacctcaaacagcgtagtcaaagacgttgcgaaatatggaggatacacgtcaataggaatcgcatattacagtatcttcgaatacacgatcgtcaataaaaaaggagaagagaaaataacaagaataatcccaattccaatatatataagccaaaatatcaaagatagtactgctctaattgaatttggaaaaagccaaattttttgtcgagcatacgaaaagataaaagactttaaattactgtaccgtaaattgtgcataggttctaaaataaacataaacaactaccaatactacataggaggaaaaagcgatgaaagattctattacgactcagcaattcaagttacgttagacaaaaaaagcgagaaatatttgaaaatcttatctaaataccaaaactggaaaaaagaaaacaaagacggagaactatgggaaaacatcacaaaagaaaacaatatagaactatataacaaacttgtggaaaaaatgaatagcgaaatattcacaaaaaaaaaaagcaacaaatacaatgaacttaacagtgaggaaattagaaacaactttataaaaatatccgtagaagagcaagctaaagtacttctcgaaatattaaacctactaacaaataagaaatccatatttgacctcaaatcaattgacataaaagcagcacgtgggaagatttcttttaaccttacctcactcatccaattctccatcatagaacaaagtataacggggttctacgaaaaagaaatcaccataattggagacaaaggaaacgacatggagaataataacagttga

SEQ ID NO: 5577 - RNA, 4179 nt, synthetic construct
  misc_feature 1..4179: note = Cas9 variant
  source 1..4179: mol_type = other RNA
atgaacaacaacaactattcaataggattggacatcggaaccaatagcgtgggatgggccgtcataactgatgactataaagtaccatcaaaaaaaatgaaagtactaggtaacacagacaaacatttcataaaaaaaaatctaataggcgccttactattcgatgaaggaaccacagcggaagaccgcagactaaaaagaacagcgcgaagacgatataccaggcgtaaaaacagattacgatacctacaagaaatattctcaccagagataagtaaagtggactcatcattcttccacagactcgacgactcttttctagtgccagaagataaaagaggatccaagtatccaatttttgcaacacttgcagaagaaaaagaataccataaaaacttcccaacaatatatcatttaagaaaacaactagccgactctaaagaaaaagcagatttaagactaatctatttagcactcgcccatatgatcaaatatagagggcattttctatatgaagaaagctttgatatcaaaaataacgacatacaaaaaatatttaacgaattcatctcaatttatgataatacttttgaaggctcatctctcagtgggcaaaacgcccaagttgaagccatctttacagacaaaataagcaagtcagcaaagagagaaagagttttaaaattattcccagacgaaaagtcaacaggactattttcagaattccttaaactcatagtcggaaaccaagcagaatttaaaaaacacttcgacttagaagaaaaagcccctctacaattctccaaagacacttacgacgacgacttagaaaatctactaggacaaattggagatggctttgcagagctatttgtagcagctaaaaaattatacgacgcaatactactaagcggaattttaacggtaacagacccaagtactaaagccccactctctgcgagtatgatagaaagatacgaaaaccaccaaaaagacctcgcggctttaaagcaatttatacaaaacaatctacaagaaaagtatgacgaagtcttctcagatcaatccaaagatggatacgccggatatattaatggcaagacaacacaggaggccttttacaaatacatcaagaatttactaagtaaattcgaaggatcggactattttctagataaaatagaaagagaagatttccttaaaaagcaacgaaccttcgataatggttcaattccacatcaaatacatcttcaagaaatgaatgcaataatccgcagacaaggtgaacactatccattcctacaggaaaataaagaaaagataaaaaaaatattaacattccgaattccctactatgtaggtccattggcaagaggaaatggagacttcgcatggcttactagaaacagtgatcaagccatccggccctggaacttcgaggaaattgtagatcaggcatccagtgccgaagacttcataaacaagatgacaaactatgacctttacttacccgaagaaaaagtactaccaaagcacagcttactttacgaaaccttcgctgtatataatgaactaacgaaagtaaaatttatagcagaaggcttaagagactaccaattcctcgattctggacaaaaaaaacaaatagtcaatcaactatttaaagaaaaacgaaaagttacggaaaaagacataactcaatatctacataacgtagatggttatgacggaatagaactaaaaggtatagaaaaacaatttaacgcatctttaagtacatatcacgatttactcaagataattaaggacaaagcattcatggacgatgctgaaaacgaagctacacttgaaaatataatacacacacttacaatttttgaagacagggaaatgataaaacaaagactagcacaatacgactcactgttcgatgaaaaagtaatcaaagctctaataaggcgccactacacaggatggggtaaattatccgcaaaacttatcaacggcatttgcgataaaaaaacgggaaaaacaatccttgattacttaatagacgatggatattctaatcgcaacttcatgcaactcataaacgatgacggactgtcattcaaagatataatccaaaaagcccaagtagtaggaagaaccaatgacgttaagcaaatagttcacgagttacccggatctccagcaataaagaaaggcatccttcaatcaataaaaatagtcgacgaattagtaaaaataatgggtcatactcccgaatcaatagtaatcgaaatggcacgagaaaaccagaccactgcgagaggcaaaaaaaattcccaacaaagatacaaacgcattgaagatgcattaaaaaacctagccccgggactcgacagcaacattttaaaagaatacccaactgataacatccaattacaaaatgacagattattcttatattacctacaaaacggcaaagacatgtacactggagagcctttagacatcaaccagcttagtagttacgatatcgaccatatagtacctcaggcctttatcaaagacgatagtctagacaatagggtcctaaccagctcaaaagacaatcgaggaaaatccgataacgttcctagtcttgaagttgtccaaaaaagaaaagccttttggcaacaacttctggacagtaaattgattagcgaaagaaaattcaacaatctaaccaaagcagaaagaggcggcctagacgaacgagacaaggtcggctttattcgtagacaattggtggaaacaagacagataacaaagcacgtagcacaaatattagacgccagatttaacaccgaagttacagaaaaagacaaaaaaaatcgcaatgtaaagattataacgctaaaaagcaacctagtcagtaatttcagaaaagaattcaaattatacaaagtacgagaaatcaacgactaccaccatgcacacgacgcatatctaaacgcagtagtagcaaaagcaatattgaaaaaataccctaaattagaaccagaatttgtatacggtgactaccaaaaatacgacctaaaacgatatatttctaggtcaaaagatcccaaagatgttgaaaaggctacagaaaaatactttttctatagcaaccttctaaatttcttcaaagaagaagttcattatgcggacggaacaattgtaaagcgagaaaacattgaatacagtaaagatacaggtgaaatagcatggaataaagagaaagatttcgcaactattaaaaaagtgctatcacttccacaagttaatattgtaaaaaaaacagaaatacaaacacatggacttgatagaggtaaaccacgcggcctctttaattccaatccaagcccaaaaccgagcgaggatagcaaagaaaatctagtaccaataaaacaaggcttagaccctcggaaatacggcgggtatgcaggcatcagcaacagctacgcagtcttagtaaaggcaataatagaaaaaggcgccaagaaacaacaaaaaacggtattagaattccaaggtatctctattctagataaaatcaatttcgaaaagaacaaagaaaactacctactagaaaaaggttacataaaaattctatcaaccataactctacctaaatactcactatttgaattcccagatgggacaagaagacgactagcaagcatcctgagcaccaataacaaaagaggagaaattcataagggtaacgaactcgtcataagcgaaaagtatacaactctcttataccacgccaaaaatattaataaaactttggagcccgaacaccttgaatacgtcgagaaacataggaacgattttgccaagttacttgaaagcgtattagatttcaacgacaaatatgtaggagcattaaaaaacggagaaaggattcgacaagcatttatcgactgggaaacagtagacatagaaaaattatgcttcagcttcatcggtccgagaaactccaaaaacgcaggattattcgaactcacatcacaaggaagtgcatcagacttcgaattcctaggagtaaaaattccacgttatagagactatacaccatcatctctcttaaacgcaacattaatacatcaaagcatcacaggactctacgaaacaagaatagacttatcaaaacttggtgaagattga

SEQ ID NO: 5578 - RNA, 4179 nt, synthetic construct
  misc_feature 1..4179: note = Cas9 variant
  source 1..4179: mol_type = other RNA
atgaataacaacaactattcgattggcttggacataggaactaattcagtaggatgggcagtaataacagatgattataaagtacccagcaagaaaatgaaagtactaggtaatacagacaaacatttcatcaagaaaaacctaataggtgcattattatttgatgaaggagcgacagcagaagatagacgttttaaaagaacagcacgcagaaggtatactaggcggaaaaatagacttcgttatttacaagagatattctctgaggaaatgagcaaagtagacagtagtttctttcatagattagacgactcattcctagttcccgaagacaaaagagggtcaaaataccctatatttgccacgttagccgaagaaaaagaataccataaaaagttcccgactatatatcacctaagaaaacatcttgcagattccaaagagaaaacagacctaagattaatatatttagcgttagctcatatgattaaataccgaggacatttcctatacgaagaatctttcgatatcaaaaacaacgatattcagaaaatattctcagagttcatcagcatctacgataacacattcgaaggcagttcactgagcggacaaaacgcacaagtagaagcaatcttcacagataaaatatcgaaaagcgctaaacgagaacgcatcctaaaactgttcgcatacgaaaaatcaaccgatctattctcagaatttctaaaactcatagtaggcaaccaagccgacttcaagaaacattttgatttagaagaaaaagcaccattacaattttcaaaagatacctatgacgaagatttagaaaatctactcggacaaataggggatgactttgcagatctttttctggttgccaagaaactttatgacgccatcctgctatcagggatacttaccgtaacagattcatcaaccaaagcaccactgtcagcttctatgatcgaacgctacgaaaaccaccaaaaagacctagcagcattaaaacaattcatacaaaataatctacaagaaaaatacgacgaagtattctctgaccaatccaaagatggttacgcaaggtacataaatggcaaaaccacccaagaggctttttacaaatacatcaaaaacctcttatcaaaatttgaaggcagtgactattttctggacaaaattgaacgagaagactttctaagaaaacaaaggacatttgataacggatccataccgcatcaaatacacttgcaagaaatgaatgccataatacgacgccaaggcgaacattacccatttctaaaagaatataaagagaaaatagaaaccattctcacctttagaataccctactacgtaggaccgcttgccagagggaacagaaactttgcatggctcacccgtaacagcgaccaagcgataagaccatggaacttcgaggaaattgtagaccaagcatcatccgccgaggagttcataaacaaaatgaccaactacgatctatacttaccagaagaaaaagttcttcctaaacattcactgctatacgaaacattcgcagtatacaacgagttaacaaaggtcaaattcatctccgaaggactacgtgattatcaatttctcgacagtgggcaaaagaaacaaatagtcaaccagctatttaaagaaaaacgaaaagtaacagaaaaagacattatacaatatctccacaacgttgacggttatgatggtatcgaactaaaaggaatagaaaaacaattcaacgcgagtctttcaacataccatgatctattaaaaataataaaagataaagagtttatggacgatcccaaaaacgaagaaatactcgaaaatatagtacataccttaaccatctttgaagatagagaaatgataaaacaacgacttgcacaatatgcatctatattcgacaagaaagtgatcaaagcgctaacgagaagacattatactggttgggggaaactttcagctaaacttataaatggaatatgtgataagaaaacaggcaaaacaatactagactacctcatagacgacggatacagtaacagaaacttcatgcaactcataaatgacgacggcttatcattcaaagacataatacaaaaagcacaagttgtcggcaaaacaaacgacgtaaaacaagtagtacaagaactaccaggcagccctgcaatcaagaaaggaatactacaatccatcaaattagtggacgagctagtaaaagtcatgggacatgcgcccgaatctatagtcatagagattgctagggaaaaccaaactaccgcccgagggaaaaagaatagccaacaacgatataaacgtatcgaagatgcgctcaaaaacttggcaccaggattggattcgaacattttaaaagagcaccccacagacaatatacaactccaaaatgatcgactattcttatactacttacaaaacggaaaggatatgtatacaggagaagccctagatatcaatcaactctcatcttatgacatagatcatatagtgccacaggctttcataaaggacgacagtttagacaaccgagtactcacatcaagtaaagacaatcgaggaaaaagcgacaacgtgccaagtctcgaagtagtacaaaaacgaaaagcgttctggcaacaattattagactccaaactcatatcggaacataaatttaacaacctcacaaaagcagaaagaggaggactagacgaaagagacaaagtaggcttcatacggcggcagctagtagaaacacgacaaattactaaacacgtggcacaaattctcgacgccagatttaacacagaagtaaatgagaaagacaaaaagaatagaactgtaaaaataataaccttaaaatcaaaccttgtatccaacttccgcaaagaatttaagctatacaaggtccgcgagataaacgattatcaccacgcacatgacgcttatttaaacgcagttgtagctaaagcaatactcaagaaataccctaaactagaaccagaatttgtctacggagactatcaaaaatacgacattaaaaggtatatatctagaagcaaagaccctaaagaagtagaaaaagccactgaaaagtacttcttttattcaaatctactaaacttcttcaaagaagaagttcattacgcagacggaacaatagtaaaacgtgaaaacatagaatattcgaaagacacaggcgaaatagcctggaataaagaaaaagattttgcaacaatcaagaaagtcctcagcctaccacaagtaaacattgtcaagaaaacagaaatacaaacacacggacttgacagaggcaaaccccgaggactctttaactccaatccaagccccaaaccttccgaagataggaaagaaaatctagtaccaataaaacaaggacttgatccccgaaaatacggcggatatgcaggtatatcaaattcttatgctgtcctagttaaagcaattatcgaaaaaggagccaagaaacaacagaaaacagtacttgagttccagggtatatcaatactagacaaaataaactttgagaaaaacaaagaaaattacctactagagaaagggtatataaaaatactctctactataactctacccaaatactccttattcgagttccccgatggtactcgccggcgcttagcctcaatattatcaactaacaataaacgaggagaaatacataaaggaaacgaacttgtaataccagaaaaatacacaactctattgtaccacgctaaaaacataaataaaacactagaaccagaacacttggaatacgttgaaaaacaccgaaatgatttcgcaaaattattagagtacgtcctcaatttcaatgataaatacgtcggtgcactcaaaaacggagaaagaatcagacaagccttcatagactgggaaacagtagatatagaaaaactatgcttctcatttatcggcccaaggaacagtaaaaacgcaggactctttgaacttacttcacagggttctgcgtccgattttgaatttctcggggtcaaaatcccaagatatcgtgactacacaccatcaagcctcctaaatgcaacactaatacatcaatcaataactggactttatgagactagaatagacctttcaaaattaggtgaagactga

SEQ ID NO: 5579 - RNA, 4182 nt, synthetic construct
  misc_feature 1..4182: note = Cas9 variant
  source 1..4182: mol_type = other RNA
atgaaaagagttactgaagattatatccttggattagacattggaactaactcctgtggatgggcagtgaccgataagaaaaacaatctattaaaattaagaggaaaaaccgcaataggtagccacttatttgaagaaggtcatacggcagcggatcgcagaggtttccgtaccaccaggagacgccttaaaagaaggaaatggagattaagactactagaagaaatatttgccgagcctatggcaaaagtagatccaggattcttcgttcgattgcaccaaagctgggtctcaccactagataaaagccgtaagaaataccacgctatcgtcttcccaacggccaaagaagataaagcattctaccaaaaatatccgacaatataccacctaagagacgccttaatgacacaagatagacaatttgacttaagagaaatattcctcgcaatacatcatatagtcaaattcagaggaaatttccttcaagacacaccagtgaaagatttcgaagccagtaaaatcgaagttggaccaatactttcaaaaatcaacggtgcatttgctgagaaaatagttgaagatcaagacccaattgaactaaacgtagcaaacgcagcagaaatcgaagcagtaattagaggaaaagacgcggacaaaaccctctataaaatggataaagtcaagaaaatagcaaaattactcaccgacagtacagcaaaagaagagaaaaacgtcgccaaacaaatcgcaaatgcagtaatgggatataaaacacaatttgaaacaattttgggcaaagaaatagataaatctgataaagcacaatgggagttcaaattaacggacggagatgcagacgataaattagaagcattattaccagatcttgacgaaaatgaccaaacgataattgcagaaatcaagaaattattttccgccattacacttagtactatagttgatgaaaacaaatcccttagccaaagcatggtggcaaaatacaataaacaccaccaagactacaaattactaaaagcctacatagacacactacaagaccgctctattgccaagaaactactacttgcttatgacctctacgtaaataaccgccacggtcgactactagaagccaaaactgagttcaaacaagatggtacactcaccaaagaagatttctacaaaactgtaaaagataacctagacgatagtgaacttgcacgaaaaatcgcacagaaaattgcagcagacaattttatgccaaaacaaagaacaaatagcaatggagtaataccatttcaattacatcaaatagaacttgacaaaattatagccaatcagtcaaaatactatccatttctagcagctgaaaatcctgttgaagaccacagaaaacaagctccatataaactagacgaattagtacgatttagagtaccatattatgtcggtcccatgattacaccagatgaacaagagaaaacgagcggaaaatcctttgcatggatggttcgcaaagaagacggtcaaataacaccttggaactttgaacaaaaagtggatagacaagaaagtgctaacaaattcataaaacgaatgactatcaaagacacataccttcttggagaagatgtactaccagctaactctctactttaccaaaggttcgaagtattaaatgaactaaataacatacgaataaacgggtcacgaatctcaattgacctgaaacaacaaatatttaacgacttatttgaagagaagaaaacggtaacagaaaaatctctcacgagctatcttaaacaaaatctacatttaccaacagttgaaataaaaggtctagcagatccaacaaaattcaactcatcgcttgcaagttattatcatcttaaaagtttacatgtatttgacaaagaacttgcagacccccagtaccaaaaagattttgagaaaataatcgaatactcctcaatatttgaagataagaaaatatatcaagataaactccatgcagaatttaaatggctaactccagaacaattcaaagcaatttcaacatggcgattacaaggctggggacgactttcttgtagactactggtagaattgcatgacaccaatgggcaaaacattatggaacaactatgggattcccagaaaaatttcatgcaaatagtcacagaaccagactttaaagatgcgatagccaaagaaaaccaaaacgtaacacaagttaacggagtagaagaaatattagcagatgcatacaccagccccgcaaataagaaagccataagacaagttgttaaagtcgtagcagatgtcgttaaagcagcaggaggcaagaaaccggcccaatttgcgatagaatttaccagagatcctgacaaaaacccgcaattatcacacattagaggtacaaaattactaaaagcctaccaagaaacagctggtgagctagtggaccaaaaactaacggactctttaaaagaagctatgacctccagaaagctcctaaaagacaagtacttcctatatttcatgcagacagggcgtgatgcatacacaggcaagaaaataaatatagatgaagtcacaactaattatcaaatagatcacatactaccccagagcttcattaaagacgacagctttgacaatagagtactaacagctaccccattaaatgctgaaaaatcagatgatgtaccatataaacgatttgcgaacaactatgtttcagatcttaaaatgacggtcggagaaatgtggaaacactggcaaaaagcaggaataataaacaaacacaaacttgggaacctcttattagaccctgatcgtctcaacaaattccagaaaagtggattcataaacagacaacttgtcgaaacctcccaaatcgtaaagctagtaagtgtcatactacaaaacaaatatcccgacgccgaaataataaccgtaaaagctggagacaactccgctctgcgacaacgactgaatttatataaaagcagagacgtaaatgactatcaccacgcaatcgacgcctacctttccatcatttgtggcaatttcctatatcaagtctatccaaaatatagaccatattttgtgtatggaaaatataagaaatttagtcaagatccagatttacaaaaagacctaataaaacacttcaaaggatttacatttatgtggccattactacaaaaggataactctgagagaaaagccccagaagaaatcaaagaaaacaactcagaacgaatagtattctataaacatccggatatattcgacaaactaaggaaagcatacaattacaagtacatgttagtcagcagagaaactacaactgaatcaagtagtatgtttaagatgacaatcttcccccgtggagaaagggaccgtaagaaaactagaaaattaataccaaaagggaatggcttagacccaaaaatctatggtggatactcaggaaatacggacgcttacatggttatagtaaaaatagacaaagctaaagaatctatatataaagtcatcggcgtccctatgagagcactaacaagactcaatcaagccaagaaacaaggaaattatcaagaagaactacaccaagtactagaaccacagattatgttagataagaacggaaaaccaaaacgaggtgtaaaaggattccgcgttataaaagaccatgtaccctttaaacaagtagttctagacggagataagaaattcatgttgtattcagcccagtacaaaacaaacgctaaacaactcgcactatcacaagaaaccatgagaatagtgacagataacctcaagaaaggtgaagatcaagataaactgcttgtcaaagcatatgacgaaattcttcaaaaagtggactgttatttaagcctgtttgatacctccaactttagaaacggactccatttaggacgaaataaattcatagatcttgaagtaaatgacaagaaaatcacactcagcaacatcttgaacggcctacatgacaacatggtacttggaaatctaaagaatatcggaatagggacccccttaggccaaatgcaagaaaaatccgggataactctatcacccgaagcagtactcattttccaaagcccgaccggacttttcgaaaaacgagtaaaaatagcagacctctga

SEQ ID NO: 5580 - RNA, 4188 nt, synthetic construct
  misc_feature 1..4188: note = Cas9 variant
  source 1..4188: mol_type = other RNA
atgaaaaaagaaattaaggactactttttaggtttagacgtgggcacaggaagtgtgggatgggcagtaacagacactgactacaaattactcaaagcaaaccgaaaagacctatggggaatgaggtgtttcgagaccgctgaaaccgcggaagtaagaagactacatcgcggcgcgagacgtagaatcgaaagaagaaaaaaaagaataaaactattacaagaactgttctcgcaagaaattgcaaaaatcgacgagggcttcttccagagaatgaaagaatccccattttacgccgaagacaaaaccatattacaagaaaacgccttatttaacgacaaagacttcacagacaaaacttaccataaagcctacccaacaataaaccatcttataaaagcgtggattgagaataaagttaaaccagacccaaggctcctttatctagcttgccacaatatcatcaaaaaaagaggccacttcctcttcgaaggagactttgacagtgaaaaccaattcgatacatccatacaagcattattcgaataccttagagaagatatggaagtagatatagacgccgactcacaaaaagttaaagaaattttaaaagactcaagcctaaaaaattcagaaaaacaatcaagactcaacaagatcctaggattaaaaccgagtgacaaacaaaaaaaagccataaccaatctaataagcggtaacaaaattaatttcgcagacttgtacgacaacccagacctaaaagatgccgagaaaaacagcatctcgtttagcaaagacgacttcgacgcgttatcggatgacctagccagtatactaggtgattcctttgaactattacttaaagccaaagcagtgtacaactgttcagtactatctaaagtaataggtgatgaacaatacttatccttcgcaaaagtaaaaatctacgaaaaacacaagacagacctaacaaaattaaaagctgtaataaagaaacattttcctaacaactataaaaaagtgttcggatataatcaagacaatgaatccaaaaacaactattcaggctacgtaggagtgtgtaaaacaaaaaataaaaaactggtcattaataacagtgtaaatcaagaagatttttataaatttctaaaaccaatacttagcgcaaaatcagaaattaaagaagttaacgacatcctagcggaaatagagactggaaattttttaccaaaacaaatatcaaaaagtaacgctgaaataccctaccaattacgtaaaatggaattagagaagatactgtccaatgcagaaaagcacttctcattcctcaaacaaaaggacgaaaaaggtttgtcacactcagaaaaaataataatgcttttaacattcaaaataccatactacatcggaccaataaacgacaatcacaaaaaatcattccctgatagatgttgggtagttaaaaaagaaaaatcaccctcaggaaaaacgaccccatggaacttttttgaccacatagacaaagagaaaacagcggaagaatttatcacttccagaaccaacttctgtacatacctaatcggagaatcagtccttcctaaaaattctcttctatactctgaatacacagttcttaacgaaataaacaaccttcagattatcatagacggaaaaaacatatgtgacacaaaattaaaacaaaaaatctacgaggacctattcaaaaaatacaagaaaataacccaaaaacaaataagcacgttcatcaaacacgaaggtatatgcaataaaacagatgaagtcataattttaggtatcgacaaggaatgcacctctagccttaaatcttacatcgaattaaaaaatattttcggaaaacaagtagatgaaattagcaccaaaaacatgttagaagaaatcattcgatgggcaaccatatatgatgaaggagaaggaaaaacgattttaaaaacaaaaataaaagccgaatatggtaagtactgttctgacgaacagatcaaaaaaatcctaaacctcaaattcagcggttggggcagactatcacgcaaattcctagaaactgtaactagcgaaatgccaggcttcagcgaaccagttaatatcattacggcaatgcgggaaacccaaaataacctaatggaattattaagcagcgaattcaaatttactgaaaacataaaaaaaatcaactcaggtttcgaggatgcagagaaacagttcagctacgatggcctagttaaacctctatttctgtcgccatctgtaaaaaaaatgttgtggcaaacattaaaactagtaaaagaaataagccatattacccaggctcctccaaaaaagatatttatcgaaatggccaaaggagcagaactcgagcccgcaagaacaaaaacgagactcaagatacttcaagacctttactcaagctgtaaaaacgacgccgacgcattctcctccgaaatacaatacctaagcggaaaaatcgaaaacgaagacaacttacgattaaggagtgataaactatatttatattacacacaattaggtaagtgtatgtactgtggaaagcctatagagataggacacgtatttgacacatccaactatgacatcgaccacatatatccacaaagcaaaatcaaagacgacagtatatcgaacagggtactagtttgcagtagttgcaacaaaaacaaagaagataaatatcctctcaaatcggaaatacaaagtaagcaaagaggattctggaattttttacagagaaacaacttcatttcgttggaaaagttaaatcgcctcaccagaactacgccaatcagcgacgacgaaacagcgaagtttatagcgcgacaattagttgaaacaagacaagccacgaaagtggctgcaaaagtactagaaaaaatgttcccagaaacaaagatcgtgtattccaaagcagaaaccgtaagcatgtttagaaacaaattcgacataattaaatgcagagaaataaatgactttcaccatgcccacgatgcttacctcaacatagtggtaggaaacgtctataacacaaaattcacaaataatccgtggaatttcattaaagaaaaaagagacaacccaaaaatcgctgacacatataactactacaaagtatttgactacgacgtaaagcggaacaacataacagcatgggaaaaaggaaaaaccattattacagtcaaagacatgttgaagcgaaatacacctatatacacacggcaggcagcatgcaaaaaaggaggactcttcgaccaaacgataatgaaaaaaggactaggccaacatccattgaagaaggaaggcccattttcaaatataagtaaatacggaggctacaataaagttagtgcagcctattacacactaatagaatatgaagaaaagggaaacaaaatacgttcattagaaactatacctctctatctagtaaaagatatacaaaaagaccaagacgtactaaaaagctacctaacagacttactaggaaaaaaagaattcaaaatcctagtccccaaaataaaaataaacagcctgttaaaaataaacggattcccatgccacatcacagggaaaacgaatgattcattcttactgcgacccgccgtacaattctgctgtagcaacgatgaagtcttatactttaaaaaaataattcgattcagtgagatcagatcacaacgtgaaaaaattggcaaaacaatatctccgtacgaagatctcagcttcagatcatatataaaagaaaacctatgcaaaaagacaaaaaacgatgaaatcggagaaaaggaattctatgatctcttacaaaaaaagaatttagagatatatgacatgttgttgacaaaacataaagatacaatatataaaaaaagaccaaactcagcaacaatagacatcttagtcaaaggaaaggaaaagtttaaaagcctaataattgaaaaccaattcgaagtcatactagaaatattaaaactctttagtgcaacacgcaacgtgagtgagctacagcatataggaggatcaaagtactccggggtcgccaaaatagggaacaaaatatcttcattagacaactgcatccttatatatcaatctatcaccggaatctttgaaaaaagaatagatttactaaaagtatga

SEQ ID NO: 5581 - RNA, 4188 nt, synthetic construct
  misc_feature 1..4188: note = Cas9 variant
  source 1..4188: mol_type = other RNA
atgaagaaagaaatcaaagattattttctaggactagatgtaggaaccggaagcgtaggatgggcagtcaccgacactgactataaactactaaaggccaaccgaaaagacttatggggcatgagatgttttgaaacagctgaaacagctgaagttaggcgactacaccgaggagcaagaagacgtatagaacgaagaaaaaaaagaatcaaactattacaagaactcttctcacaagaaatagcaaagatagacgaaggtttttttcagcgaatgaaagaatcgccattctatgcagaagacaaaaccatactacaagaaaacacgcttttcaatgacaaagacttcaccgataaaacctatcacaaagcatacccaacaataaaccacctcatcaaagcctggatagaaaataaagttaagccagacccacgacttctatacttagcatgtcacaatatcattaaaaaaaggggtcactttttattcgaaggagattttgacagcgaaaaccagtttgacactagtatccaagctctatttgaatacttaagggaggacatggaagtagatatagacgcagattcacaaaaagttaaagagatcttaaaagactcaagtctgaaaaactcagaaaaacaatcacgattgaacaaaatactaggcctaaaaccttctgataaacaaaaaaaagccataacaaatctcataagtggcaataagataaacttcgctgatttatacgacaacccagatttaaaagatgcagaaaaaaatagcatcagctttagcaaagacgactttgacgcactaagcgacgacttagcatcaatcctcggagactcattcgaactcctactaaaggcaaaagctgtatacaattgttcagtcctatcaaaagtcataggggatgaacaatacctttcgttcgcaaaagttaagatatatgaaaaacacaagactgatctcactaaactaaagaatgtgataaaaaaacacttcccaaaagactataagaaagtatttggttacaacaaaaatgaaaaaaacaataacaactactccggatacgttggagtatgtaaaaccaaatcgaagaaactcatcataaataacagcgtaaatcaagaagacttttacaaatttctgaaaaccatactatctgcaaaatctgaaattaaagaagtaaacgatatactaacggaaatagaaactggtactttcctcccaaaacaaatcagtaaatcaaacgctgaaataccatatcaactccgaaaaatggaattagaaaaaatattaagcaacgcggaaaaacactttagcttcctcaaacaaaaggatgaaaaaggactctcacattcagagaagataatcatgttactcaccttcaaaatcccatattacataggccccattaatgataaccacaaaaaatccttccccgaccggtgttgggttataaaaaaagaaaagtcaccttctggaaaaacaacaccatggaacttcttcgaccacatcgacaaagataaaacagcagaagccttcataacaagcagaacaaatttttgtacatacctggtaggagaatcagtattaccaaaatcatccttactatacagcgaatacacagtcttaaatgaaataaacaacttacaaataataattgacggcaaaaatatctgcgacataaaactgaaacaaaaaatctacgaagaactctttaaaaaatataaaaaaataacacaaaaacaaataagtacattcatcaaacatgaaggaatatgtaacaaaacagatgaagtaattatactgggaatagacaaagaatgcacatccagtcttaaatcatatatagaactaaaaaatatatttggtaaacaagtagatgaaattagcacaaaaaacatgctcgaggaaataatacgatgggcaacgatatacgatgaaggggaaggtaaaacaatcttaaaaacaaaaataaaagcagagtacggaaaatattgcagtgacgagcaaataaaaaaaatactgaatctaaaattctcaggttggggaagactaagtagaaaatttctcgaaacagttacaagtgaaatgcctggttttagcgaacctgttaatattatcacggcaatgagagaaacacaaaacaacctaatggaacttctatccagcgaattcaaattcactgaaaacataaaaaaaattaattcaggatttgaagatgcagaaaaacaatttagctataacggactagtaaaaccattatttttgtcaccaagcgttaaaaaaatgttatggcaaacactaaagttagtaaaagaaataagccacattacccaagcccctcctaagaagatattcatagaaatggccaaaggagcagagctcgaacctgcccgaacaaaaacacgcttgaaaatactccaagatctatacaataactgcaaaaacgatgctgatgccttcagtagtgaaattaaagatctatcaggcaaaatagaaaatgaagacaacctcagactcaggagtgataaactatacctctactacacgcaacttggaaaatgtatgtattgcggaaaacctatagaaataggccacgtgttcgatacttccaattacgacattgatcacatctacccacaatctaagataaaagacgattccatatcaaatagagttttagtctgttcttcatgcaataagaacaaggaggataaatatccccttaaatctgaaatacaatcaaaacagagaggattctggaactttttacaaagaaacaatttcatatccctagaaaaacttaaccgcttaacaagaacaacacccatatcagatgatgaaactgcaaaattcattgccagacaactagtggaaacaagacaagctacgaaagtggccgcaaaagtactcgaaaaaatgttcccggagactaaaatagtctatagcaaagccgaaacagtatccatgttcagaaacaaattcgacatcataaaatgcagagaaattaatgatttccaccacgctcacgacgcctacctcaacatagtcgtaggcaatgtttataacacaaaattcaccaataacccatggaattttattaaagaaaaacgagataaccctaaaatagcggacacctataattattacaaagtatttgactacgatgtcaaaagaaacaatataacagcatgggaaaaaggcaaaacaataatcacagtgaaggatatgctaaagcgaaatacgcctatttacactagacaagccgcttgcaaaaaaggcggattattcgaccaaaccataatgaaaaaaggacttggacaacatcctctcaaaaaagaaggggcattttcaaacatatccaaatatggaggttataacaaagtgtctgcagcctactacactctaatagaatacgaagaaaaaggtaataaaattagatcactcgaaactatccccctatatctagtcaaagatatccaaaaagatcaagatgtactcaaaagctatttaacggatctactcggtaaaaaagagataaaaatactagttcccaaaataaaaataaactccctcctaaaaataaacggcttcccgtgtcacatcactggaaagaccggcgactctttcgtgttacggcctgcagttcaattctgttgcagtaatgacgaagtactatacttcaaaaaaatcatccgttttaatgaaataagatcacaacgtgaaaaaatgggaaagactatctcaccttatgaagacctatcatttagatcatatataaaagaaaatttatgtaagaaaacaaaagcagacgaaataggagaaaaagaattctacgacttactccaaaaaaaaaaccttgaaatttacgacatgttacttacgaaacacaaagacacaatttataataaacgacccaacagcaccacattaggaatgctaaccaaaggacggtatgaatttatcaatttaaaaccaaaagaccaaatcattgtcatgctagaaatcttaaaattgttctgtacaactcgagaagccatagacttaggactaataaaaggtaaaccagcagccggagtcgccacccttggaaaaaaaatatcgaaccccgataattgcatcctcatatatcaatccattaccggtatcttcgaaaaaagaatcgatctactcaaagtttga

SEQ ID NO: 5582 - RNA, 4188 nt, synthetic construct
  misc_feature 1..4188: note = Cas9 variant
  source 1..4188: mol_type = other RNA
atgggagatacagttaaaaactaccacatcggacttgatataggaacatccagcgtaggatttgcagcgagagacgatgacaataatttaatacgtgtaaaagggaaaaacgtaatcggaacaagactattctccgaggggcaaacagcacaagaaagaagaatggcccgagcatccagaagaagatacaacagaagaaaatggagattaaggttattagacgaaatcttccatgacgaaataatccacaaagacgcagaatttttcaacagactaaaacaatctagtctgtcaccaaaagacgaaagaaaacaatacttcggctcattactattcccagaagtaggtgactccgaatactatcacgacggaaatcaaacaatttaccatttacgtcatagactaatgactcaagacgaaaaagcagacatccgcgaaatatatttggcactacgacatataatcaaataccgtggaaacttcctagacgataccccagtaagctcgtttgaagcgtcagacttaaaacttgcatctttcgtacccaccctcaatgatctattcgaaacaatcgatgtaaattatgagttttctatggataatataaatgaaatcgaagatatcctactgaacaataaactaagaaattctgacaaaagtaaacaattaccggatttattaacagaaccaatagtaaacatcgacgacaaaagtctagaaaaacaatttaacaaagaaagaaccgatatatctaaagaaatagccaaatccgtagtagggagcaaaatgaacgtaaataaactactttcttttgaaagcagcggcggctacaaaatagcctttagttttagtgatgcctcctcagaagataagatgatggaattatccgacgtcctcgatgattcccgcatgaacatactaaacatacttaaagtaatatactcacgtgtaagactcaaccaaataataccatcaggaatgggattatctgagagtatggtagcagcatatgatctccacaaacaacaacttaaagatttgaaaaagttactcaacgtgcttccattcaacgaaagatatgcagtcaaaatagcctacgcggcgtacataggcaacatagacaaacaaaaattcaccaaatcagaagtcaaaacaatagacaaactcaaggagaaaagtgctatcatgaatgtactagacttcaaaagcggccacatcacaaacgaagaattatcaaacgtaattaaagtagtaatcgttgataaatatctaaacgatgaaaattttgaataccattcaatagtggagaaaataaaccaagatatatccaacggatcatacctactaaagcaacgaaacaaccaaaatgggaacattccccatcaattacaccaaatggaactggaccaaataatcgaaaaccaatcaaaatattatcctttcttgggagaactaaatccaaactcaaaccgaaaccatatcgcaaaatacaagatatcggagctagttgcatttagagtgccttactatgtaggaccattaataacgccagaagaacaagagaaaacatcaggagcaagtttcgcctggatgaagcggaaagaagacggagcaataacaccgtggaacttcgaagaaaaagtagacaaagaagaaactgcaagcagattcatcaaacgattaacagtgaaagacacatacttactgaacgaagatgtcctaccagacaatagccttctttacgaaaaattcaaagtattgaatgaattaaatgtcgtgaaagcaaacaacaaaaggctcaccgtagaagaaaaacaaggcgccttcgataatcttttcaagaaaatgaaaaccgtcactgccaaaaagctaaagaattacttagtgtccaaccataatcacattaattcagtagaaataactggcctatcggatgtagataaattcaacaacagcttaagtacatatattgactttaagaaaatctttgacgataaaatcgataatccagacttgctggacgacttcgaagatattatcgaatggtcaacagtctttgaagatagaaaaatcttcgaagaaaaagtccgaaaagacatatcatggatatccgaatctgaaatcaaagcagtggtttccaaaagatattccgggtggggaagattaagcaagaaattattaaatggaataacaaataatgaaggtcgaaatattatcgatgaattatgggaagaatcggaaacatttatggaagctgtctctaaacccgaagtaaaggaacagatagacggaataaatagcgattttatcaaaaataccgatatagaatccgtgttagcagatgcatacactagcccacagaacaagaaagcaataagagaaacacataaattagtaaaagacatacaaaaagccatgggcggacaagcaccggcctcaataagcatagagttcacacggaacccacaagataaagggcaactaacgagatccaggcattcagaagtctcgcgaaaatataaagaaatttcaaaagaagtatcaaaaacactaaatgacgagcttaaatccaagaaaaatagcatggatgtagacaaatactacctttactttatgcaaatgggaatcgatttgtatgatggctcaagtatagatatcgatgatctgaacaactaccagatagaccatataataccccaatcattctacaaagatgactcgtttgacaatagagtactaacgcactactcgaacaatcaaaagaaaggaaataacacaccgctaaacggattaaatatagatgacaaaacaagagcaatatggaaccacctacgggatctaggcttaatcacaaagaagaaatacaatggactaaccttaaaaggaatggatcaactatcaaaatacaccaaacacggtttcataaggaggcaacttgtagaaacatctcaagtaataaaactcgtagcaaacatattatcggacgaattttcaacagatgatacaaaaataatagaggtgaaagcaaaaatgaactcacaaatacggcaagtattcaatctctataaagtcagagaactcaacgattaccatcacgcagttgacgcctatctaacgacatttataggcggatacctttacaacagatatccaaatctccgaaatatgttcgtttacggagactttaagaaatttagtgcagacgtagataatctaaaaacatttaatttcttacacgatattacgaatccttcagataaatttgaagatagaatattcgatgagaaaagcggtgaactcattctagaccgaaaacacgcgatagaaaccatcaagaaaatttatcaatacaaatacatgctgatcacaagggaagtttctaccaaaaacggacaattaagtgaccaaacagtatactctgcaaaaagaataaacaacgtcaaagcacccatacccgtaaagaaagacagtaatcctgaattatatggttttagaacaggtaacgtagatcatcatatggtaatagtaaaatacccaaagaaagactcatacgattataaagtagtaggaataccactacgatttgtgcaaaaacttaaagaaacgaaagataacaaagactacgaaaacctattaaaccaaatagtacaaatgaaattaaatcgaaagaaacaggactttattgttgtagtagataacgtaatgtacggtcaactaatacaggacggcggagaaaaatacaccctcggcagctcaacatataaatataatgcaaaacagctagttataaacatggataaaactcggattcttgaagataaccgttacttaaacagcttagatgaaggagaagtatcagagaaattagtaaacatatataatgacataatgaaagttgtcaattcacgatttgatctctttgacattaataaatttagagaaaaactgaacgacggcttaaataaattcaaaaatataagtaacgaacaaaaagaagagacattattaaaaatcctttccggtttacactgtggctcagcaaacgttcccatcaaagaactaggacttacaacacccctaggaaaactccaactcccaagtggaatagtcttatcagaagaggcagtcgtaatctaccaatctcctagtggtctattcgaaaacaaagtcagactcaaagatctgtga

SEQ ID NO: 5583 - RNA, 4188 nt, synthetic construct
  misc_feature 1..4188: note = Cas9 variant
  source 1..4188: mol_type = other RNA
atgaaaaaagaaataaaagattacttcctaggactagatgtaggaaccggatcagtaggatgggcagtaacagacacggattacaaactattaaaagcaaacaggaaagacttatggggaatgcgctgcttcgaaacagccgaaactgcagaggtgagaagattacacagaggggcaagaagacgaatagaacgtcgaaaaaaaagaatcaagctattacaagaattattttcccaagaaatcgcaaaaactgacgaaggtttttttcaacgcatgaaagaaagcccattttacgccgaagacaaaacaatattacaagaaaacactttattcaatgataaagatttcgcggataaaacataccacaaagcatatccaactattaatcacctaataaaagcatggattgaaaacaaggtcaaacccgatccgcgtttactatatcttgcctgtcacaatattataaaaaaacggggacacttcttattcgaaggtgacttcgatagtgaaaatcaattcgacacttcaattcaagcacttttcgaatatttaagagaagacatggaagtagatatcgatgcggacagtcaaaaggtcaaggaaatactaaaggatagttcactaaaaaactcggaaaagcaatctagattaaataaaattcttggattaaaaccatctgataaacagaaaaaagcaataacaaacctcataagcggcaataaaatcaattttgcagacctttatgataaccctgaccttaaagacgccgaaaagaactcaatctcattctctaaagatgatttcgacgctctttcagacgacctagcatcaattctaggcgactcttttgaattactgctaaaggccaaagcggtttacaactgtagcgttttatccaaagtaataggtgatgaacaatatctatcatttgcaaaagtaaaaatctatgaaaagcacaaaactgaccttacgaaattaaaaaatgtcataaaaaaacacttcccaaaagactacaaaaaagtattcggctataataaaaacgaaaaaaataataacaactattccgggtacgtcggcgtatgcaaaacaaaatctaaaaaattaataataaacaactctgtgaatcaagaggatttctataagttcctaaaaacaattttatcagcgaaaagtgaaataaaagaagttaatgatatattaacagaaatagaaacgggtacatttctaccaaaacaaatatcgaaatctaatgccgaaatcccataccaactccgaaaaatggaactggaaaaaattctctcaaacgccgaaaaacacttctcattcttaaaacaaaaagacgaaaaaggactctcgcattcagagaagataatcatgcttttaaccttcaaaatcccctattacattggcccaataaacgataaccacaaaaaatttttccctgatagatgttgggttgtaaaaaaagaaaaaagcccctcaggaaaaacaacaccctggaactttttcgatcacatagacaaagagaagacagcggaagccttcatcacttcaagaaccaatttttgcacttacctcgtaggcgaaagcgtattaccgaaaagttcattattatactctgaatacactgtgctcaatgaaatcaataatttacaaataataattgacggaaagaacatatgcgacataaagttaaagcaaaaaatctacgaagatttatttaaaaagtataaaaaaatcacccaaaaacaaatatctacgttcattaaacacgagggaatttgcaataagactgacgaggtaataatattaggaatagacaaagaatgcacaagctcactaaagtcatatatagaactaaaaaacatattcggcaaacaagtggatgaaatttcaacaaaaaacatgttagaagaaataatccgctgggctaccatatatgacgagggagaaggcaaaacaatattaaaaacaaaaataaaagcagaatatgggaaatactgtagtgacgaacaaattaaaaaaattttaaatttaaaattcagcggatggggcagattatcaagaaaatttctagaaaccgtcacttcagaaatgcccggcttcagcgagcctgtaaacatcattacagccatgcgagaaacacaaaacaatctaatggagctcctctcatctgagttcaccttcacagaaaatataaagaaaatcaactccggattcgaggacgcagagaaacaattctcttatgatggacttgtaaaaccgctattcttatccccatcagtcaaaaaaatgctctggcaaaccctgaagctagttaaagaaataagtcatataacccaggcaccaccaaaaaagatatttatagaaatggcaaaaggagctgagctagaaccagcacgaacaaaaacacggctgaaaatccttcaagacctgtacaataattgtaaaaatgatgcggacgctttttcatccgaaataaaggatctctcaggtaagatagaaaacgaagacaacctcagactacgcagcgataagttgtacctctactacacacaacttggaaaatgcatgtattgcggaaaaccaatagaaataggacacgtttttgacacaagcaactacgacattgaccacatttatcctcaaagcaaaataaaagatgactcaataagcaatagagtgctcgtgtgttcatcttgcaataaaaataaagaagataaatatcctctcaagtcagaaatacagtccaagcaaagaggcttctggaactttcttcagagaaacaactttatttccttagaaaaattaaaccgcttaacaagagcaaccccaatctcagatgatgaaactgctaagtttatagccaggcaactagtagagacccgccaagcaacaaaagtggccgccaaagttttagaaaaaatgttccctgaaacaaaaatagtatattccaaagcagaaaccgtatcaatgttcagaaacaaatttgacatcgtaaaatgccgtgaaattaatgactttcaccatgcacacgatgcgtacctaaacatagtcgtaggcaatgtatacaacacaaaattcaccaacaatccatggaattttataaaggaaaaaagagacaaccctaaaattgctgatacctacaactattataaagtcttcgactacgacgtaaaacgtaataacattactgcttgggaaaaaggaaaaacgataataacggtaaaagacatgctaaagcgaaatacaccaatatacacaagacaagcagcatgcaaaaaaggagaattattcaaccagaccataatgaaaaaaggattagggcaacacccacttaaaaaagaaggacccttctctaacatctctaaatacggaggatacaataaagtatcagccgcttactatacattaatagaatatgaagaaaaaggcaacaagattagatccctagaaacgataccactttatcttgtcaaagacattcaaaaagaccaggacgtattaaaaagctatttaacagatttactcggtaaaaaagaattcaaaattctagtacctaaaataaaaataaactctctattaaaaatcaatggcttcccctgccacataacaggtaaaaccaacgattcattcttacttaggccagcggtacagttctgctgcagcaacaacgaagtcttgtatttcaagaaaattattagattcagcgaaataaggtcacaacgagaaaaaatcggtaaaacaatttccccatacgaagacttgtcatttaggagctacatcaaagaaaacctatggaagaaaacaaaaaatgacgaaataggcgagaaagagttctatgaccttctccaaaagaaaaacctagaaatatacgatatgctattaacgaaacataaggacactatatataagaaacggccaaatagcgcaaccattgacatattggtcaaaggaaaagaaaaatttaaatcccttataatcgaaaatcaatttgaagttatcttagaaatactaaaattattctcagcaacacgaaatgtatcagaccttcaacacattggagggtccaaatattccggtgtagcaaaaatcggaaacaaaatctcatcacttgacaattgtatcctaatatatcagtcaataacaggaatatttgaaaaaagaattgacttgttaaaagtgtga

SEQ ID NO: 5584 - RNA, 4188 nt, synthetic construct
  misc_feature 1..4188: note = Cas9 variant
  source 1..4188: mol_type = other RNA
atgaacgctaatagagagatggcatactacataggaatagacatgggcacggggtcagtgggaatggcaatcacagacgaaaattacaatcttcttaaagtaaaaggacaagactattggttcgtaagagaattcgaaacagcgaatacgcaaataaaaagaaggatgcacaggatatcaaagagacgacttcgccgacatcaagtaagagtagcattaattagaagttatttcgctgaagaaatattaaaaaatgaccctttattttttattcgacaagataacagtatatactacctagaagataaagactccgtcttaaaaacaaaagattgtctctttgcagactataactatcacgataaaaactattataaagactaccctacaatattccacttaagacaagccttcattaaggatacagtaaaagacgacgaaaaccatacgagatacgcaagactactatatctcgccattattaacatgttcgaacaccgaggacactttctgcttaactcagtatcagaagacatcaacaaagaaatggtcaaagatgcaggagaaggttttacattatacttacaagaaagaattaaagaaataaaaccagtaagttacagcgatattttagacgttctagtggaaaaaaatatcagccgtagtgagaaaaaagaacgaattgtggaactgttcggaattaaaaaatcatgcaaaaacggaatggagatcataaaatgcctatgtggcttagaagcaaacgtagcgataatgttcaacttggacgatatagaaaataaactaacgatcgtcgtaagcaaagatgactatgaggataaactagcagaagtccaaccactagtagatgaagaaagtttcgaattactctcaagaataaaacaactttacgactacagtcaattacaatcaatattaaaaggttacaaagaaaaagaggacggtgaagataaatatttgagtgacgtacgcgttgaattatacgaaaagcacaaagctgaccttaaactgcttaagaaagtatacaaaagagatctggataagaaagggaaaatatgtgagggtaaaaatatccaaagatctagcaaatataactttatgttcagaagcgggaaagacggtacatacagtgcctatactaacagtctaaactcattctgcagcaaaactatagaaaataaatacaggcgaaatatgaaaaatagagatagagctagcctatatgatacaattaaaaaagacttaagtggaatagaaaatgacgacgtaaaaaaaatactccgcgatatagaaacagaaaaattccttccaaaacaaattacaggagaaaatggcgtaatcccaaaccagattcacgctaaagaactaaaagcaatactaaaaaacgccgaaaaacatttaccatttttaacggaaaaggacgactccggtctaacagtatcagaaagaattatatcattgtttcgatactgtataccctactacataggacctgtaggaaaagattcgagaacagggtgggcctccatcaaagaagaaggacaaatatttccctggaatatagaacaaaaaattgacgtagacaaaacgagcgaagaatttataacaagactcattaaaacttgtacttacttaagcaacgaaaaagtagtaccaaaacagagcctagtatacgaacgatactgcgtactaaacgaaataaacaacataaaaatacgtggaaaacgaatagacccacagttgaaacaagaaatttttaaagaactctacataggatcaaaatgcggaaaaaaagtaacacgaaaaaacctctgccaatatctagttaataaaggtgccatagaagaagactcagaaatttcaggtatagacaaagacctaaatacatacatgagctcatacggaaagatgtatcaaattttcggcgacaaaattaaacgagatgacataaaggaggtggccgaagaaataatatactatggaactatatatggtggcgcgaaagaaatgtttaaaaaaaaaattgaacaatatgtatctgaagacatcctagacgaagcacaaatgaacagaatacttggtttcaaatttaaagactgggctagattatcaaaaaaatttctctaccttgagggttatgataaaggaaatcaaaatcaactgacgacattaatgcaagcactatgggactacaacctaaatacaatggaattaatgaactcgccaatgtttacatttaaggaaactcttgaaaaacaaaaaaataagatggaaaaagtattatgcgactttgaatatgaagatctcgacgagtactatttctcagccccagtaaaaaggatggtttggcaaacgatagcgtgcttaaaggaagtagtgcaaatcatggggcacaacccaaaaagaatattcatagaaatgccaagagctgacgaggagaaaggagaacaaggccgcaaagcaagccgaaaaaacagattactaagcctgtatgaagaaatagaagacgaacgaccatggaaaaaagaaatagagaacgccgccgagtcaggccgactgaatagtaaacgtatgtacctgtattatttacaaatgggaaaagacgcatatactggagaagacatagacattgaagacctatttgataatagcaaatacgatattgatcatatttacccaaggagcctcacagatgacaatagtctcgaaaataatctcgtgctggtaagcgcaacgatcaaccaggacgtaaaaaagaatgattacccaatcccatacgacaaaatcagaggaaactcaaaggtaagagaattatggcggtttttacatgaaaaaaaattcatgaatgacgaaaaatataatagactaatgtccgatgtcccacttacgcaagaacaactagcaggctacatagctcgtcaattagtagaaacagcacaaggtactaaaggaattgctgatataattaaatcagtaattccggacgcagatataatatactcaaaagcaaaaaatgtaagcgactttagaaaaagatatggaatgcttaaatcaaggcttaccaacgactttcatcacgcgaaggacgcctacttaaacgtagtggtaggaaacgtttatttcacaaaattcacgcaaaacccaaggaaatacatcaaagacgaaaatgacatagagaataaaaaatataactataacttatcgaaaatgtatgacaaagatgtcatacgaaacggaaaagtagcttggatagcccaaaacggcaaaaaagctgggacaatacaaacaatcaaaaaagtcatggacaggaataccccaataataaccagacaagcattcgaacaaagaggcgaattatacgacctacaacccatcagcaaacataaagccaagaaagaaaactacgtaccaataaaagccacaaacgaaaagatgaaagacgtaacaaaatacggcggattcacatcactaaatccagcctattttgtttttgtagaatacgggagtgccaaaaaacgacaaagatgtttcgcagtagtacatagttactgggcgagctctatcaaaaacaacgaagatttagtaacacacctaaaagacagaggatatgagaaccccatcgtgatagcagataaaataaaaaaaaattctcttattaaatataacggctattttctatacatagtaggtatggatgcaagaaaacaagttgaatttagtaatgccactagcatgtgcctcaacaataacttcatacagtatatacaaaaaatagaaaaagctaatacactcatagctgaagcaaaaaaaagacgaccatacatagatgaaagcataacggcagaacgcaatatcgccctctacaacgagttgaaaaaaaaacatctagactcaattttcaaaaaccatcccaaaggtattgggagtgttttagaatcaggagaaggagcgtttgtccaactatctctagaacaacagataggaatactgtatagtattatacaattctcctccttcaaaaagggaacattctccctaacgctcatagggggacccaaagaagttggcaggataagaatctccgggaacatgcctaaagcacgagaattaaaactgatacactattcaataaccggcatgtacaagaaagagataaatctattggactga

SEQ ID NO: 5585 - RNA, 4188 nt, synthetic construct
  misc_feature 1..4188: note = Cas9 variant
  source 1..4188: mol_type = other RNA
atggaaacacaagcttctaatcaactaataagttcacatctaaaaggctacccaataaaagactatttcgtaggtcttgatataggtacatcatcagtcggctgggctgtcacaaacaaagcctacgaacttcttaagttccgatcacacaaaatgtggggtagtagactctttgatgaaggtgaaagtgctgttgccagaagaggattccgctccatgagacgtagactagaacgacggaaattaagactaaaactcctcgaagaactattcgccgacgccatggcacaggtagaccctacattctttatgcgtctaagagaaagcaaatatcattatgaagacaaaacaacaggccactcatctaaacacatactattcatagacaaaaactacacagatcaagactactataaagagtatccaactatataccacctgagagtcgccctgatgaaatcgggcactgatgatatccgtaaactatttttggccgtacaccacatattaaagtaccgaggaaacttcttatacgaaggagctaccttcgatagtaacgcatccaccttagacgacgtactcaaacaagcactagaaaacatcacattcaactgcttcgatagcagcgcagcaataggctccatcggtcaaatcttaatggaattaggaaaaactaaatcagacaaagccaaagctatagaaagactggtagacacatacataataacagatgaagttgatacaagtggaaaaacacagaaagaacaggtaaaagaagataagaaaagactaaaatcgttcgcaaatctagttctaggtttaagtgcaagcctcaccgacctttttggatctgtagaagacctagacgaagacctaaaaaaacttcagattataggagatacctacgatgaaagaagagatgaccttgccaaagtctggggcgacgagatacatataattgatgattgtaaatctgtatatgatgcaatcattctcatgtcaatcaaagaaccaggattaacaatttccgaaagtaaagtaaaagcattcaaaaaacacaaagatgacctagctattttgaaaagtttattaaaatcagaccgaagtatatacaacacaatgtttaaagttgatgaaaaaggtttacacaattacgtacattatattaaacaaggtagaaccgaagagacaagttgcaatagagaggatttctacaaatacacgaaaaaagtcgtcgaaggacttcctgactcaaaagacaaagaatatatcctatccgaaatagagctacaaaccctgctccccctccaaagaattaaagacaatggcgtaataccgtaccagttacatctcgaagaactaaaagtgatattggcaaaatgtggaccaaagtttccttttctaaacgaagttgctgatggcttttctgtagcagaaaaattaataaaaatgttagaattccgaataccatactacgtaggtccactcaatacacatcacaacgttgacaatggaggatttgcttgggcagtaagaaaggctagcggaagagtaacaccgtggaatttcgatgataaaatagatcgcgaaaaatcagccgctgcgtttattaaaaacctaacaaataaatgcacatatctactaggtgaagacgtactacctaaatccagccttttgtattctgaatttatgttgttaaacgaactcaataatgtgagaatagatggaaaacctctcgaaaaagctgtaaaagaacatttaattgaagcagtcttcaaacaagaccataaaaaaatgacaaagaatcggatagaacaattcttaaaagataacaattacataccggaaaagcataaacctgaaataaccggcctagacggagaaataaaaaatgacttagcttcctatagagatatggttcgcattctaggaaacaacttcgatttaagcatggcagaagaaataataaccgatatcacaatttttggagagagtaagaaaatgctgcgagaaacactaagaaataaattttcatcaaggctagatgatgaagctataaaaaaactatcgaaattaagatatagagactggggacgtttatctagaaaactactaaatgtcatagaagggtgtgacaaagcaggggatgggacgccagaaactataataatattaatgcgcaacttttcatataatttaatggaactattaggagataaattctccttcatggaacgaattcaggaaataaatgccaagttaatagaaggccaaatagtaaatccacatgatataatagatgatctcgcactctctccagcagtaaaaagagctgtatggcaagcattaagaatcgtagacgaaatcgtacacataaaaaaaaccttacctgcgcgaatttttgtagaggtaacacgatcaaacaaggctgaaaaaaaaaaaaaagattctagacaaaaacgtttgagcgatctttacgcagcaataaaaaaagacgatgcactactaagtggactaactaatgaagaatttggtgggctaaaatctggcctagcaaaatacgatgatgcagctctaagatcaaaaaaactctatttatactacactcaaatgggacgctgtgcatacacaggtgaagtcattgatcttagtcaactgaacacagataactatgacattgatcatatatacccccgctccttaacaaaagatgactcatttgataatctagtactgtgcaaaagaacagcaaatgctcagaaatcagatacctatccgatatcaaaagaaattcaaaaagctcaaaaagcgttttggatctttttaaaacagcaaggactaatctcagaaagaaaatatgaaagactaaccagaataactcccctaacagccgacgaccttagtggatttattgcacgccaattagtagaaacaaaccaatccgtcaaggctgccacaactttgctcagaagattgtatccaggagtcgacgtggtatttgtaaaagcagaaaacgtcacagattttcgacatgataacgacttcatcaaagtcagatctctaaatcaccatcatcacgcaaaagatgcatatctaaacatagttgtaggcaacgtatatcacgagagatttaccagaaacttccgagcatttttcaaaaaaaacggagcgaaccgaacttataatctcgctaagatgtttaattacgatgttaagtgcactaatgccaaagatggcaaagcatgggctgttaaaacctcaatggacacagttaaaaaaatgatggatagtaatgacgttagagtgaccaagcgtgtttatgaacaaaaaggccaactttcagatattaaccttactaaagcatctaaagttaaagccgatatctatttacccattaaagccaacgatccaataatgtcacaaaatatgaaatacggaggatattccgatattaagaatgcatactacactataattgaatactcagacaaaaaaaataacagcatcaaagctttcatccccatccctatcttcatagcaacaaaaaccctaaccaaacaggcattactcgaatacataaaaacagtacttccaaaagctaacaatttaagaataatatataaaaaagtctataatgaccaactactaaaaatagacggctttaattattatctaggaggtcgatccaacgacagattctgtatcgacaacgccatacaacttattgtacccttagaaatacaattctacattaaactagttgaaaaattcacagcaataatatcagaaaataaaaacattgcccttaaagcctcatctgtcaagtctagaaatcctataaataaccaagtcgaaaatataacactcgaatacactcaaaaactgtttgactatttggtcagtaaatttaacgaactaatatatctaaaaatgagaggcaacaaattgacagatgtaaataatataggaagaaaacagtttatcaaattatcacttgaagaaagatgtaaagcgttagcagagttacttaatatattcaccaacatgaataagaaactatccttaagtactattaatgtcagtgctagccgtaaggtagtaaatttcaagattagctcacttgacgaattcaaaatagtaaacgagagcattacaggtttatatagccatgagataaccatagtctga

SEQ ID NO: 5586 - RNA, 4188 nt, synthetic construct
  misc_feature 1..4188: note = Cas9 variant
  source 1..4188: mol_type = other RNA
atgaatcttagaaatacaacagacgaatacaatataggccttgatatgggaacgaacagtgtggggtgggctgtaacagataaagtaggtgctattgctcattttaaaggcatgcctacattaggttcaagattattcgatgcagctcaaacagcagcagaagcaagagctcacagaggccaaagaagaagatatgttagaagacgctggagacttgatctactacaatctctatttcaagacgaaatcgacaaagtagactctgagttctttatcaggttacgacaaagtcggttacacgtcgaagacagggaagatggacacgctgattacaaatggcccatcttcaatgacagcgacttcacggaagtagattattataaaagattcccaacaatataccacctaagaaaatggttgatagaaactgatcaaaaagccgatataagactaatatatttagcggtacataacatagtcaaacatagaggtaatttcttacgagaaaataacaaaaatttaagctcgcgaaacgccgatcccgccgaagccgtaggtcatctaagattagctttgaataattggtgtctagaaagaggatacgaatgtgcctggaaatctggaggtaacgacaatgcaatcttgaatgtactaatagacggagagaaaagaagatctgatcaggttagggaaatagccaaacttacgggaattgactgtggtgatgcaaaacagagtagacaatgtaatgaagcgattgctaaagcaatagtagggctgaaagcagaaatgaaaaacatatttggagagttccctgctgagaaaacattaatctatctatcctctgatgacgatgttgaagtagtaagagacgcgtgccctgatgattcggtagaattattccaagcattgtgtgaattatacgccgcatatatactacaaggactattatcatatgctccaggacaaacaataagtgtcaatatggtaaagaaatacgatagatatggagaagatttacatctcttaaaggaattaacaagaacttacgcaagtaaaagatatgacgcattctttcgaggggaaacctatgaaggatcatcagactacgtagttgacaaagcacaaggttatacaagatataatctaggcacaacacaacttagttatgatgactttcaaaaagcagtaaaggaattgtttaaaggcacagatgccttacaggatgaaagatatcagggaatgatggttgcttttggtgaacaacgctttttaagaaggttaaaaacaagcgacaatgggagcatatattatcaattacatttagaagaactacatgcgatactcgaaaatcaaggtaaacactacccatttttgttagcagaagaagataaaattgaaagcctagtctcattccgtataccatattatgtaggtccacttacgagggaaaatgcagcagtaggacatgatggaaaagagaggttcgcatggtcaagtagaagggacggaatggaacacgctgtaataactccgtggaactgggaagaaataatagatagggacaaatcagccgaagattttattatacgaatgactggagattgtacttatttacaaggagaacctgtattaccgaaatgttcgctgttatacgaagagttttgtgcgctcaacgagctaaatggagcacactggacgatagatgaagacgatgaaagacgtttcgatgctgcacaacgcgagagaatcatgtgtgatctattcagaagcacaagaaaagtaacatataagaaagtcagcgactggctagaaagagaagattcattcgtcggggcacgagtacacggtggccaaggcgagcatggattcgaaagtcaactaggttcctatatcttcttttgtaaagatgtattcaaaacggactcgttagacgaagcagattacccaatgatcgagcaaataatactatggtcaaccttatttgaagacagagacattctacggagaaagatagaagaggcttacggagatagattaacaacagaacaaataaaagtaatctgcaaaaagaggtttgcaggatggggtagattatcaaagaaattattaacaggcataaaagtagatacagatacaggacgtaaatcgattatagacgtactccgagaaggcaacccaaacgacggtcaaaggagcagaacgatggtatttatggaagtgctaagggatgaaggattaggatttcaaaaagccgttgatgacttcaacagagactacttcagtgaacataacaacggattaatggacgtgaatgatttacccggaagtcctgctattagaagatcgataaatcaagcagtacgaattgtcgacgaaatagtatctattgcaaagaaagaaccagcaaacatattcattgaagttactcgagaagaagacgatccaagaaagaaagggaaaagaactaaaaggcgatatgacgcgattaaaagtgcgctagaagtattcaagaaagacgatccccaactctggaaagagttgacgaagaaagactccaataacatggacgaacgattatcactttacttcatgcaaaggggtaaatgcatgtacagcggaagaccgataaaaatagaagaactgcacacagggaaatatgaagtagaccacataatacccagaagttacataaaagatgacagcctggagaataaagttctcgtatacagggaagaaaaccagcataaaactgatacacttctcatagacagctcaatccgtcgaaaaatgggaaaatactggaggatgctacataatgccaagttaataggtgataagaaatttagaaatcttttcagagatcatatagatgataaaactatgaaaggttttgtagccagacaaatagtagagacctcccaaatggtaaagctagttcaaaccttgctagaagccagataccccggagcaagaattgttccagttaaagcaaacatatcacatgatttaagagatgctgcaggattagtcaaatgcagagaagcaaatgatttccatcacgcgcatgatgcgtttctcgcatgccgagtagggttatttatacagaaaagacacccatcggtatacgacaacccaattggcttggctcacataatgcgagattatgcaagagcacaagcaagagaatataagaaaagtcactacctagcacacactaaaggattcatagttaattcatttttatcaagtgggtttgataaagagacaggggaagtttttaaagatgattgggacgcagaagctgaagtagaaggcatccgaagagtattgaactaccgacaatgctttattagcagaatgcctgttgaagcaacaggcacattttgggatcaaacgatatactcacccaaatgtggaaagaaactcactctaccgctaaaaaggggtttagaccccgacagatacggatcttatagccgagaacaattcgcatactttttcatatatgaagcaagggatcttaaacacgaaagacatatactacaatttgctcaagtccctgtaagagtcgctgcacatatagcaaaagacccatcacaacttgaatcctatgcagttaaactagcaggccaggccaacctcgcgtttgtaagaatagtgcgaagaagaatattgaagaaacaactactagaactaaatggcgaccgattaataataacaggtgtaagagaagtaagaaacgctacagagttcgcatttagtcttgacgaagaaacattaatcgaaagatgcgtacagatcgctaaagtaggttcactgataggtgtagtaaatgacgaagacgaagaacaattatctgcagatttaaatgaactctttagcagcttagtaaaaagaggcccgaaactttgtaataggctatacgcacaactaaaactagataaatacttgtccaaatttgacgaattaactttaacagataaagcgaaagtagttttacaactgattgctataactaatggcagcataaatatggctgacctgagcgcattaggaagctctaaatatgctggttgtatgcaagtttcatattttaaacaactaaacgctccgataggtgaagtaaatataatagatcagagtgttactggaatgttcgaacgtagaacgcatataggcctatga

SEQ ID NO: 5587 - RNA, 4188 nt, synthetic construct
  misc_feature 1..4188: note = Cas9 variant
  source 1..4188: mol_type = other RNA
atgaaagaaataaaggattatatcattggcttagacattggaacaaactcgtgtggatatgttgtgactgacaaacagaacaacatactaaaactgaaaggaaaaacagcaataggcgcacgactatttaaagagggccaagcagcagcagatcgaagatcatttagaacaacaagaagacgtttggcaagacgacactggagattagggttattagaagaaatattcgaccctgagatggaaaaaattgaccccaatttttttagacgattaaaagaatcggactattcaccaaaagactcgcgcaagcaatttaatgcaatagtattcaaatcaataaaggcagacaaaagattctacaagaaatatccaacaatataccacctgagaaacgctctaatgcatgataatcaaaaacatgatttaagagaaatattcatggcagttcaccatatagtaaaatatcgtggcaacttcctcagggaagatagtgtaaatgcattcaaggcagcaaaattttccttaagaggagaagatggaataggtccagttgacaaattaaacgacctccttaaagaaatatacagcgagtactcaccagaattagcaacaaacaatctatcaaagatcgaagacatcatcaaagacaaaaacctatacaaacaagataaactaaaacaagtagcaacactacttattaaagaagcagactctaaagataaggccaaattaaacaaagacatagcaaaacaagtagccaattcatttatgggatacatgttcaggctagatacccttttttcacttaccgacgtcgatgttaaggactacaaattaaagttttctgatgcgaacattgatgaaagcttagacgacttgacttcccttcttactgacgcccaaatagaattcgtattagaactccaatcaatttacaatacgatagtcttaaatgagatagtcccagacggaatgtctctcagtgaaagtatgataaaaaaatatgacgaccacaaagaagatctaaaaatcttcaaagaatacatcgatagcctatccgaccaaaagaaagccaaaaaattactttcagcatataatctatacgttaactaccgaaaatcagacctagtagaagcaaaaaatctatttaaaaataaaaaagttggagacaaaaacttcgctgatgtaatatctaatttcgaagttttcggaaaattcgtctccgacaatcttgacgactcagaattagcaaacaaaataaaagctagactagacctgggagaattcctaccaaaacaaagaactaaccaaaacggcgtaattccctaccaattacaccaagttgaattaacccaaatattagaaaaacaaggaaaatactacccctttctaataacaccaaacccagttgaatctcacaggaacaacgccccatacgaaataagtgaattagtatcttttcgagttccgtattacgtaggcccattaatcgacaaccaatccataaaggataaacaaaataaaaataaatttgcatggatggtaagacaaaaacaaggacaaatcacaccctggaacctggaagaaatggtagacacaaccgaaagtgccaaccaattcataaaacgaatgacaagaaaagacacgtatttattagcggaagatgtcttaccaaaatctagtttagtatatcaaaagttcatgattctagatgaacttaatcgaataaaaatagacggaaaaaagctaacatcagagttgaaacatgacatttttgaaaaactgtttaaaaaacaaaaatcgattaatttagacaacttaaaaaactatttgctagttgaggggaacatcccaggactgatcgaaggactgtcagacggtatcaactttaacaattcattcagcacctacattgattacagaaatatattcggtgacgagatagataatccaaataaacaagcagatttcgaaaaaatgatagaatggtctaccgtctttgaagacagaaagatttttaaacgaaaattaaaagagataacatggttaacgtcagaacaaattaaacaagtatcatcaaaaagatacagtggatggggtcggctcagcaaaaaactcctaacacaaatcacagacgaaaacggagtaaacatactacaaagattatggaatgaacctgaaaccttaacagaagtcctagccaacccagtcataaagcgaaaaatagtggaagccaattcaagtttcaccaaggcgaaagatatgaaagacatccttgttgaagcttacacaagcccccaaaacaaaaaagcgatacggcaagtaatgcgagtcgtagatgacataattgccgcggcacatggcaaaaaaccctcgcagatagcaatagaattcgcaagagaagatcaagacaatccacaaatgactaaatcacgcaaagcccagctagatcaaatctatgcaaaaattagtgatgaattcttagatgacgctgtgaaaaacgaactaaaaaatatgaaagacaacaaacccttagcaaaagacaaagtcttcctatactttaaacaaatggggagagacgcatacagcggggaaaaactatctttagataatttacaggactatgacatagatcatatctacccacaaagctttataaaggatgattcatttgataatagagtcctggtccaaagagcgtacaataacgggaaatctgacaatgtaccagtactgctatttggaaacaaaatagcagctggcttaggcataacaattagacaaatgtggaaaaaatggttggaattaggactgatttccaaaagaaaattcaacaacctaataacagacccggaaaaaatatcaagaaatatggcaagcggtttcgtaaaccgacaactagttgaaacctcacaagttattaaacttgtagcaaacatcctacaagctaaattaccggataccgaaatcatagaggtcaaagcaagctacaattccatacttcgtaaagaattcaatctatataaaagtcgcgaagtaaacgactaccaccatgcaatcgacgcgtacttaactaccatagtaggcaattatttatatcaggtttatccaaaactacgaccctactttgtatatgggcaattcaaaaaattcggaaaggcagaaaatcaagaagacgacccagtaaaaaaaataaaaaaattcaacttcatttaccaactaatctggggaaaagacgacgccatatgtataagtcacaccaatcaacaagtctttagcaaaaaagatattatagacaagttaacaaccgcatataactttaagtacatgaacatatcacacgcagtatatacaagaaacaataatatgtttaaacaaacactcttcccaataatcgaaagaaccacagcaaagactaaatcactaatacccaaaaaactagataggcccactgacatatatggaggctatagcaacaataacgacgcatacttagctttagttaaagtagacaaaaaaagaggtagcgaatacagggtagtaggaatacccatgagggctgcagctatgctaaaagcaagcaaaaactacgacgaagaccttagaaaagttatagaaccgatggtgatgtttgacaaaaacggcaaagcaaaacgaggcatagagggctttcgcgtattagtaggaaaaatgccctttaaacaagccgtcctggatggtaacaaaaaattcatgttaaccggaactgttgacaccccaaatttaaaacaactagtactatctcaacaaaacatgaaatacatcctagattacatagaagatgtcgactgcagaaaacacaaatttggagacaaagtacaaaacccagataagtgcttattagaggttttcgacgaaattatagaaatagtagacaaatactttgagctgttcgacagccgtgacttcagagaaaaactaagaaactcacggaataaattcatcaaattagaggcgtctaaaaaagcagacacaatattagctatcttgaaaggtctacaagctaaaagcacacgagcaactataaaagaactaaatatatcagatttcggacgaattattacatctagcatttcccccgaagctcagttaatatatcaaagccccactggattgtttgagagaagagtaaaagtcaaagacttatga

SEQ ID NO: 5588 - RNA, 4188 nt, synthetic construct
  misc_feature 1..4188: note = Cas9 variant
  source 1..4188: mol_type = other RNA
atgtccaagaaatatcaaaacacaaaatattatgtcggattagacattggtacaagttccgtaggatgggcggtaacagacgcaaattacgaactgttaaaagtaaatggacataaaacatggggaagtagactgttcacagaagcagaaacagccctcgaaagaagaacccatagagcaacgagacgcagactacaaagaagaaaacaacgattagatctacttgacgaactgtttgcagaagaattagcaaaagtggacccccaattcttactaagattaaaagaatctcaatatcacatggaagataaatctactgacgacaaatacgttctattcaacgaccaaaatcgcaccgacggagagttctttacagaatatccaacaatataccatctcagatccgaattaatgcaaggcaagaaagaagatataagagccgtctacctggcactccaccacattgtcaaatacagagggcattttctcctaccaggagataactatgacatgcaaggaaacctttcagaattgataaaaaggctatttaaattcatagaagaaacgttatttatagaagatctcggtcttacggacgaaatacaaagtaaaattgaagaaatactattaacaaaaacaaaaacgagactcgataggcaaaaagaaattgtaaaactattcaataccaaacaccaaaaactggacgacaaacagaagaaactcttagaagcaatattcaaattatgcctaggacttaaaggaaatatggtcaatatattcggagataaaggagaatatggaatagacttcaccgacgttgaagacaaaaagaagaaagtcgaattttcagcagactacgacaacaatattaacgattatgtagacttcttcggcgaatatttcgaattactagaaattaccaagaaaattaacgatactgtcatattttcagaaatacttgtagatggcaaaggtttctcagaaagcaaagttattagctatgaaaaacaccaacaagatctgagaaaattaaaaacattactaaaaagtcttgacaaaacactgggatacaaatacggagaagggttatatcagaaaatattactagatgatgtaaaatccaattatgtcaactactcagggaatagtcaaaaattgaagaaatgtacaaaagacgaattttacggatttataaaatcgaaattaaacagcgtcaccaagaaagaaaaagtaagcgaggctcaacaaaaagaaatagctcaaatacttgccgacatggaatttggggattacctcccattacaacgaacaacagacaatggagtgataccaaaccaattacacaagaaagaattaatcgaaataatcgaacaacaaacaaaataccacgactttttcaatgacgtagatgaaaatgggctgaccattaaagacaaaataatctcattaatgacatttaggattccatactacgtaggaccattaaatgattatcacaaagttgcagatggtacaggccacgcatggattgagaaaaagaaagacggaaaaatatacccatggaacttcgacgaaatggttgataccgaagccacagcagaaaaatttatcaaaaacctcacaaacaaatgtacttatttaaaaggagaagacgtcctcccaaaagaaagcaaactatacagtgaatttatgttactaaacgaacttaacaacataaaaatagataatcaaaaattagatcccaaattaaaaatgaaaatggttagcgaattatttatgaagaaaaatgagaaaataactaagaagaaaatagtagattatctacgatcgatcggccaagccaacggaaatgaaatggtatcaggcatagatagagagatcaaatccgatctgaaaacaatacacaaaatacaacattactatcaagacgcctctctggaaatggcagagaacattatacgctggaacacaatcttcaacgattcaacgtcggacatactcaaagacaaaataacgaaagcatacggcgatgtactaacaccaggccaaatcaaaggcttatcaaatttagcctgtaaagattggggtaaattgtcagaaaaatttctcacagggatcaggtgcgacgttggtgagttcaaaaatatttcgataatacaagctatgagagatacaaataacaatctgatggaactattatcaaacaaatatgaatttatggataaaatacaagaatacaataaagaatactatggcgactttaccttcaaagcagagccctcaataatggacgacctatacgtgggcccaggcccaaaacgcgcgatttggcaagctgtacgaatagttgaagaaattaaaagaatcatgggtcatgacccagagaaaatatttttagaaacaaccagaacaaatagagcgcccaaagtgaaaaatacaaaaagatacgatgccttggagaaaaagtacgagagcgttaaagaacacgaatatgcagaagttaagaaagagttcgaaatagagaaaaatgactcccttaacatcaagaaactattcctctatttcacgcaattaggacattgcatgtactccgacgagaaaataccatataacgaacttttcacaaatagatacgacatagaccacatatatcccagaagcaaaacaagggacaattctatggataatctagtattagtgaaagcagaatgcaacagggataagaaagataactaccctataaaacttaaaaccaatatccaacaaaaatgtcaagttcgatgggcctacctaagagataagaaattaataactgaagagaaatataacagattagtaagaaaaacaccacttacagaagacgaactatcacaattcatagccagacagcttgtctttaccagtcaatccgtcaaagctacagcagaggtgtttaaacgtttatacgaagatagcaaaatttgctacgtgaaagccgaaaatgtgtccgactttcgttacggaagcacgagaaaaatgtcaaaagacgatcaaccacaaccattcatcaaaaaccgtgacgtaaacgatttccatcacgcaaaagacgcatatttaaatatcgtagtagggaatgtatacgatgtcaaatttacacaaaaccctacaaggttcattaaagccaataaagactattcattaaattacatctttcgttatccagtcaacaagaaaggagaaaatgtatgggatcccgaacagtccatgaaaatagtagagaaaactcttaaaagcaatgacgtacgagtgaccaaactcgtaaaacctataacatccccaattagtaatgaaaccttacataaagctctaaaatgcaaaccaggatcctatttaccaaggaaaagtagtaaaggaacccctctcgcagacgtcacaaaatacggaggctatgagaaaatcaaaaacgcatattatagtatatacaaatatacatatatgaaaaagaaagaatgtatggaagaatttttattagtaccgataccaatccatctagtcaacaatgacgaagaactaccaaaatacataaacgataaaatagcagagcgggccaaaaagaagaaattagagacagtagagtgcatagtaaaagaactttatcaaggaacattagtaagaatcaatggctatgattatagaatagcaggctcaagcggaaaacaattcgaactacacaacggaataaacctcatagtagaaccttgggtggaaaaagtcctaaaagaaaccgacaaatttgtaagaaaaagcaactcaaaactagacaagaaacaacaaaaagaaaacacaacagaaacacttatagaaaaacaattaaacgatgtttttgaatatctttgtcgaaaactaaatcaaggaatcttcaaaaacaataaacacacactaccagcaaaactcctaggggattcaatacagaaaaggttcgaagacgccagcatagaagatgagttcgaagtcataaaagaactaatcagtgctatagctaaaaatccccagaacttcaaaacaatacaaaaagtcttagatatttccggaagttcaattccaagatttaacctaaaactcaccaaaaataacgtcgacgagttcataatcaaaaacgaatccgtcacaggattatttactcacgaaaaagtcatttttcgaaaatga

SEQ ID NO: 5589 - RNA, 4188 nt, synthetic construct
  misc_feature 1..4188: note = Cas9 variant
  source 1..4188: mol_type = other RNA
atgaaaaaagagataaaagactacttcttagggctagacgtcggcacaggttcagtcggatgggcagtcacagacacggattacaaactcttaaaagcaaatcgcaaggatctatggggaatgagatgcttcgaaaccgctgaaactgccgaagtacgtagattacacagaggagcacgaagacgcattgaacgtagaaaaaaaagaataaaacttctgcaagagctcttttcgcaagaaatagcgaaaattgacgagggatttttccaacgtatgaaagaaagcccattgtacgcagaagataaaacaatcctccaagaaaacactctattcaatgacaaagatttcaccgacaaaacttaccataaagcctatccaactataaatcatcttataaaagcatggattgaaaacaaggtaaaaccggatcctagactactctatttagcgtgtcacaacatcataaaaaaacgaggccatttcttgttcgaaggagactttgattctgaaaaccaattcgacacatcaattcaagctttattcgaatatctcagagaggacatggagctagacatagatgcagactcccaaaaagtgaaagaaatattaaaagactcatcactcaaaaactccgaaaaacaatcaagattaaataaaatgctagggcttaaaccaagtgacaaacagaaaaaggccattacaaacctaatatcgggtaacaaaataaacttcgcagacctatacgacaatccagacttaaaagacgctgaaaaaaacagcatctcattctcaaaagatgacttcgatgcgctcagcgacgatctcgcaagtatactcggtgattcatttgagctcctattaaaagcaaaagccgtatataattgctctgtactctccaaggtaataggagatgaacaatacctttcctttgcaaaagtaaagatctacgaaaaacataagaccgacctaacaaaactaaagaatgttatcaaaaaacactttccaaaagactacaaaaaagtcttcggctacaacaaaaacgaaaagaataataacaactactccgcatatgtaggagtatgtaaaataacacacaaaaaattagtaatcaaaaattctgcatcccaagaagacttttacaaatttttaaaaacaatcctatccgcaaaatcagaaattaaagaagttaacgacatactaacagaaatcgaaacaggcacattcttaccaaagcaaatttcaaaatcaaacgcagagataccttaccaactaagaaaaatggaattagaaaaaatattatcaaacgcagaaaaacacttcagttttttaaaacaaaaagacgaaaaaggattaagtcactccgaaaaaattatcatgcttctcacatttaagataccatattacataggacccatcaacgacaaccacaagaaatcattcccagatagatgttgggtcgtgaaaaaagaaaaatccccgtcagggaaaaccacaccatggaatttctttgatcatatcgataaagaaaaaactgcggaagaattcataaccagtagaactaacttctgcacgtatctgattggcgaatccgtactgcctaaaagctctttactgtattccgaatataccgtactaaacgagataaacaacttacaaataataattgatggcaaaaatatttgcgacattaaactaaaacaaaaaatatacgaagaacttttcaaaaaatacaaaaaaataacacaaaaacaaatatcaacatttataaaacacgaaggaatttgcaacaaaacagacgaagtaataatccttggaatagacaaagaatgtacctcatcgctcaaatcgtatatagaactcaaaaatatctttggaaaacaagtagatgaaatttccacaaaaaatatgttagaagaaataattcgatgggccaccatatacgacgaaggagaaggaaaaacaatattaaaaacaaaaatcaaagcagaatacggaaaatactgcagcgacgaacaaatcaaaaaaattttaaacctcaaattctcgggatggggccgtctatcacgaaaatttttagaaactgtcacctcagagatgccgggatttagcgagcccgtaaacataataaccgcaatgagagaaacacaaaataacttaatggaactattatcatcagaattcaagttcaccgaaaacataaaaaagattaattcaggtttcgaggatgccgaaaaacaattctcatataacggcctagtcaaaccgctattcctgtcgccgagtgtaaaaaaaatgctttggcaaacactaaaactagtcaaagaaataagtcacataacacaagcccctccaaaaaagatcttcatcgaaatggcaaaaggcgcagaactagagccagcacgaacaaaaacacgactcaaaatactacaagatctctactcctcttgcaaaaacgacgcagacgctttttcatcagagatccaatatctatcaggaaaaatagaaaacgaagataatctaaggctacgaagcgataaactgtacctatactacacccaacttggaaaatgcatgtactgtggcaaaccaatcgaaataggacatgtcttcgacacctccaactacgacatcgatcatatatatccacaatcaaaaattaaagacgactccatctctaacagggtactagtttgtagctcatgcaacaaaaacaaagaagacaaatacccactaaaagcagaaattcaaagcaaacaaaggggattctggaactttttacaaagaaataacttcatatcactagaaaaattaaatcgactaacaaggacaagtcccatctccgacgatgaaaccgcaaaattcattgcacgccaactggtagaaacaagacaagccacaaaagtggcagcaaaagttctagaaaaaatgtttcccgagaccaaaatagtctacagtaaagctgaaacagtatcaatgttcagaaataaattcgacataataaaatgtcgagaaataaacgactttcaccacgcgcacgacgcgtacctaaacatcgtagtaggaaatgtatacaatactaaattcaccaacaacccatggaatttcatcaaagaaaaacgagacaacccaaagattgcagatacctataattactataaggttttcgactacgatgtaaaacgcaacaacataacagcgtgggaaaaaggaaaaaccatcataacagtaaaggatatgctaaaaaggaacactcccatatatactagacaagcagcctgtaaaaaaggcgaactatttaaccaaacaataatgaagaagggtttaggacaacatccactcaaaaaagaaggaccgctatctaacataagcaaatacggcggttataacaaagtatcagctgcatactacacattaatagaatatgaagaaaaaggctcaaaaataagatcattagaaaccatacccctataccttgtaaaagatatacaaaaaaataaagacggtttaaaatcatacctaacagaccaaattggcaaaaaggaaataaagatcctaatacccaaaatcaaaatcaattctctactaaagataaatgggttcccgtgccacatcacaggcaaaatgggtgaagctttcgttctacgacccgcagttcaattttgttgttcaaatgatgaagcactctattttaaaaagataattagattcaatgaaataagaaaacagcgagagaaaatgggaaaaacaatatcgccgtacgaagacctaagtttccgaagttacataaaagacaatctttgtaaaaaaactaaagcagatgagatagaagaaaaagaattctacgatcttttacaaaaaaaaaatctagagatctatgatatgctcctgacaaaacataaagacacaatatataaaaaaagaccaaattcagcaactatcgatatattagttaaaggtaaagaaaaattcaaatctttaataatcgaaaatcaattcgaagtaatcctagaaattctgaagttattctccgcaacacgtaatgtctcagatcttcaacacataggcggttctaaaaatgccggcaatgcacgagtaggaaataaaatatcaagtttagataattgtatcctaatctaccaatcaatcaccggcatattcgaaaaaagaatcgatttactgaaaatctga

SEQ ID NO: 5590 - RNA, 4188 nt, synthetic construct
  misc_feature 1..4188: note = Cas9 variant
  source 1..4188: mol_type = other RNA
atgtccttcaaaaaaattttaggcttagatgtaggagtggctagcataggctgggcagtcgtaagggaaaacgaagaaaacccaaattttaatacaataaccaaattaggagtaagggtagttccaataacatcggacgaaaaactaaatttcgaaaaagggaaatctatcacgtcaaacgcagaaagaacactggcacgatcatctagacggaatctccaacgattccgtctaagacgaaaaaacctaatcgctatcttgctgcaaaaccagataataaccccaacaactcctctcaccgaaaaaggcaaattcaccactttcgaaacattaaaaataagagctaaagctacaaaagaaaaaattgaactagaagaactcgcacgagtcctactccatatcaataaaaaaagaggttataaatcttcacgaaaagtcaaaaattcagaagacggaaaagccatagatggaatggaagctgcaaaaatcctatatgagaacaagctaaccccaggtcaatacacgtatcagcttctagaaaaaggaagtaacaaaatacctgatttttactgcagtgacttacaaatagaatgggaagtaatatggaattttcaaaaacaattctaccccaacctcttaacagaagatttcaaaaaagaactgaaagggattggccagagggccacagctgcactgttcttaaaaaaatacggcatatatacagcactaaataaaggcaaacgagaagaaaaaaaattgcaagcttataaatggagatcaaaatcagtaagtgaaaaaataccagtggaagaactcgcatacgttattgcagaaatcaacagtcacattaccaattcatcaggttatttgggaacaatcagcgatagatcaaaggaactatattttaaccagcaaaccataggagagaatctctatgcacaagttgccaaaaatacgcatgccaaactaaaaaatcaagtcttccttcgacaagattacagcgccgaatttgaacaaatctgggaaactcaagctaaattccacccacaactcactccagagcttaaaaagaaaataagagattcaataatattctaccaacgaaaacttagaagccagaaacgattaataagcatctgcgaattcgagaatagagaaatcgaaataataaaaaatggaaaaaaaaaaaaaaaaaaaattggcttaaaagctgcacctaaatcttcgccattatttcaagagtttaaaatctggcaagtactaaacaatattgtcataaaacaagaaggcaaagacagactattaacatgggaagaaaaagagctactattcaccgagctaaacatcaaaggaaatattagcgggcaaaaagcccttgctcttttaaaactctccccaaaagacaccaaaataaatgtcactatactggaaggcaaccacacccaagaacaattatatcgagtttacctacgcatactaggcatggaagggtatgatgtatttgaccttctgaaaataccagaaaaccaagatgaaattaaaccagcagattcaaaaatttcagcagccgaaataaaagaaaccgtaaaatcagtattcaaaacatgttcaatctcgccatcaatattagacttcgaccccttactacccaaccccgaatttgaaaaccaatcatcttaccaactgtggcacctactatattcctacgaaggggatagttcaccttcaggaaacgaaaaattgctagaattgctaaaaaataaatttggcttcaagaaagaacatgcacttctacttgcaagcatcagctatacatacatatacggaaacctctcttcaaaagcaatgaggaaaatctacccttactcaaaagaaaatacctactcggaagcttgcatgctagcaggatatcgtcattctaaaaacgcactaccaagagaagaactagtaaagtaccagctaaaagaccgactagagatattaccaaaaaactcccttagaaatccagtagtagaaaaagtattaaatcaactaataaacctggtcaattcattgatggacgaatatggagcattcgatgaaataaggctggaaatggcacgggaactaaaaaaaaacgcaaaagaaagagaaaaatggtcaaagaatatcgctgacgctacaagccgaaaccaaaaacatgctgagatcctaaaaaaagacttcaaaataagcaatccgtccaaaaatgacctcatacgttatagattatacttagaacttaaagccaacggctataacgacttatacacaaatacttacattgacataaactatctatttactcaccgatacgacattgatcacatcataccgcagtcaaaggtattagacgactcattttcaaataaagtactagtaccacgtcaagccaacctagaaaaaagcaacctcacagcatttgattatatttcccatcagggaaaagaaaaagaagaacactatcttaacgtcataactgagctatataagcgaggttctatatccgaaaccaaatataaaaacctacaaaaaaagggaaacgaaataggagaaggtttcataaatagagacctaaaaaatacccaatatatagtaagaaaggccagagagattttaagtctcattacaccgaatgttgtcacaaccacaggcgaaattacagcaaaattaagaaaggattggaatctaatcaatagtatgaaagaactaaacatggacaaattcagaaacgcccggctaacagaactggtagaaaacagccgaggtgaaaaaaaagaaattataatcgattggaacaaaagaaatgatcaaagacaccatgctatagacgcattagtagtagcatttacgacacgtaatcacgtacaatacttaaactacatgaacgctagggaagatgaaagccataaacaacactctcacatactatctatagaaaaaaaaataaaatacgacaaattccatgaaaatggaagccgacaatctcggttcatctatcccacaagtaattttcgtgaagaagcaaaaaaaaaactaaaggaaatattagtgtcatataaaaccaaaaataaagtcgtaaccgttaatataaacaagccaaaaaaaaaaggcggctatagtccaaaacacgaattgactccacgcggccctctacacaaagaaaccatctacggtatgataagaatcttacatacaaaagaaataaaagtttcatctaaattaaatttcgaaacggtggtcagaatacaaaaccccagatatagaaacgcattgctagaacgcttaaaagataattttaatgacccaaaaaaagcattctctggaacaaactcattaacaaaaaatcctgtatttctgaccgcaaactccacagaaacagtaccagaaaaagttactatacaatggttcgaaaaagtgtatactatacgcaaacctatcaatcccacaaattttaaaaacgaaaaaaacatcgaaaaagtacttgaccctacaattcgcaccttactgaaaaaaaggctacaagaatataacggaaacgcaaaagaggcattctcggacctggaaaaaaatccgatctggctaaaccaagaaaaaggtatctgcataaaaacagttacaatcacaggaatatccaacgtagaatctttacacaccaaaaaagatcactttggtaaagaactactagacataaatggaaatccaatccctgtagattttgtaagtacaggaaacaaccaccacgttgcaatatatgaagatagtgaagggaatttacaggagaaagttgtatcattctatgaagcagtcgaaagagtaaatcaagggttaccggtcatagacaccttatataacttagacctaggatggaaatttctatttaccatgaaacaaaacgaaatgttcctattcccagcagacgatttcgacccaaacgacattgacatttatgatgaaaagaatctaatactaatcagcaaacatttgtttagagtccagaaactttcatcaaaagactactgtttcagacaccacttagaaacgtctataaactttaatgaccccgcactaaaaggtataacttggcgtagagaaagccccaatggcctacgaaatcttgttaaagttagattaaaccacttaggcaaaattgtgcacatcggggaatga

SEQ ID NO: 5591 - RNA, 4188 nt, synthetic construct
  misc_feature 1..4188: note = Cas9 variant
  source 1..4188: mol_type = other RNA
atgaaaaaagaaataaaagactattttcttggattagacgttggcaccggatcagttggctgggcagtaacagacaccgactacaaactcctaaaagcaaatcataaagatctttgggggatgcgatgttttgaaacagcagaaaccgcagaaaaaagacgacttttcagaggtgccagaagaagaatagaaagacgtagaaaaagaatcaaactcctccaagaattgttctctcaagagatagcaaagatagacgaagatttcttccaacgaatggaagaatcccctttctacgcagaagataagactatactacaagaaaacacgctattcaacgatcgagactttacagacaaaacatatcataaagcttatccaacaattaaccatttaataaaagcatggatagaaaacaaagtcaaacccgatcctagattattgtacctagcatgccataatattataaaaaaaagaggtcactttctattcgaaggagacttcgactccgaaaatcaatttgacactagcgtacaagccctattcgaatacttacgagaagatatggagttagacatagatgctgacagtaaaaaaatcaaagaaatccttaaagacagtgctctaaaaaactcagacaagcagaataggctgaacaaacttcttggcttaaaaagctctgataaacaaaaaaaagccctgacaaatttgatttcgggcaacaaagcaaacttcgcagatttatacgacaaccctgacctaaaagatgcagaaaaaaattccatctcattttcgaaagacgactttgatgcactttccgacgaactcgctagtgtactcggagactcatttgagctccttctcagagcgaaagctgtatacaactgcagcgtcctatcaaaagtaatcggtgacgaacaatacttaagcttcgctaaagtaaaaatctatgagaaacataagaacgatttaaccaaactcaaagaagtcgtaaaaaaatatttcccgatagaatatcgcaatatattcggatataaacaaagtgaaaacaataattgcaattattccagatatgttggagtatgtaaatctggaagcaaaaaaaaagttatcaacaagacagcgtcacaagaggacttctacaaatttctaaaagacatattactaaaaaggtcagacgtaccagaagccaacggaatactcacagaaatagaaaccggtacattcctaccaaagcaaatatcaaaaaataatgcggaaataccttatcaattaagaaaaatcgaattagaaaaaatcctcaccaatgcggaaaaattcttttcgtttctcaaacaaaaagatgaaaatggcctttcccactcagagaaaataataatgttacttacatttaaaataccctattacatagggcctatcaacacttcacacaaacaatatttcccagatagatcatgggtgatcaaaaaagaaaacgccccacaagaaaaaattacaccctggaacttcttcgaccacattgacaaagagaaaaccgctgaagctttcattacaagccgtacaaacttttgtacgtacctaataggagaatccgtattaccaaaaaacagcctgctatactctgaatacacagtcctcaatgaaataaacaaccttcaaataataatagacggaaagaatatatgcgatgtcaaattaaaacaaaagatctacgaagaacttttcaaaaaatacaaaaaagtaacccaaaaacagataagcacatttatcaaacacgaaggaatatgtaataaaacagacgaagtcataatcctaggaatcgataaagaatgcacctcatccttaaaaagttacatagaattaaaaaacattttcggtaaacaagttgatgaaatttcgacaaaaaacatgctagaggatataatccgatgggccaccatatacgatgaaggagaaggaaaaactattcttaaaacaaaaatcaaagccgaatacgaaaaatattattcagacgaacaaataaaaaaaatattaaatctaaaactatccggctggggaagattaagccgaaagttcttggaatctatcacaagcgaaattccaggattcatagaaccagttaatatcataaccgccatgcgagaaacacaaaacaatttaatggaactactctcttcgaaattcaaattcaacgagaacattaaaaaaataaactcaggattcgaagacacagacaagcgatttagttacaactctctagttaagcctttattcctatccccttctgtcaaaaaaatgctgtggcaaactttaaaactagtaaaggaaatatcacatataacacaggcacccccaaaaaagatttttatagaaatggccaaaggtgccgagttggagcccgcacgaacgaaaacaaggttaaaaatcttacaagacctatataactcatgtaaaaatgatgcagatgctttcagctctgagattcaatacctactcggcaaaatagaaaatgaagacaatcttcggttaagaagcgacaaactttatctatactacacccaactaggaaaatgtatgtattgtggtaaaccaatagagataggccacgttttcgatacctcaaagtacgacattgaccatatatacccgcaatcaaagatcaaagacgactccatcaacaaccgagtcctagtctgcagctcttgcaacaaaaacaaagaagacaagtacccactaaaaccagaaatacaactaaaacaaaaaaaattttggaatttccttcaacgaaacaacttcatcagcattgaaaaatttaatcgtttaactagaacaacccccatatcagatgatgaaacagcaaaattcatcgcacgacagctagtagaaactaggcaagccacaaaagtagcagctaaagttctagaaaaaatcttccctgaaacaaatatagtatatagcaaagctgaaacagtatctatgttccgcaataaattcgatattatcaaatgccgagaaatcaacgactttcaccatgcccatgatgcatacctaaatatcgtagtcggaaatgtatataacactaaattcacaaacaacccttggaattttattaaggaaaaaagagataaccctaaaataggcgacacatacaactattacaaagtgttcgactatgacgttaaacggaacaatatcacagcatgggaaaaggaaaaaacaataatcacagtaaaaacaatgctaaaaagaaatacccccatttatactagacaagccgcctgcaaaaaaggagaacttttcaaccaaactataatgaaaaaaggactaggtcaacatccactaaaaaaagaatgccctttctcaaatatctcaaagtacggaggttacaacaaagtatcagcagcctattacactttcattgaatacgaagaaaaaggcaacaaaatacgatcactcgaaacaatacccttatatttagaaaaagacatacaaaaatcacaagatggactgaaaggctatctaacagatcagctaggcaaaaaagaaataaagatacttgtacctaaaattaaaataaactcattacttaaaataaacggattcccctgtcacatcactggaaaaaccggagcctccttcgtactaagacccgccgtacagttttgctgctcaaacgatgaagtcttatacttcaagaaaataataagatttaacgaaataagaagtcaacgagaaaaaatgggaaaaacaatatctccatacgaggaccttagttttcgctcatacataaaagaaaatctttgcaaaaaaacaaaaaacgatgaaataggcgaaaaagaattctatggattcctgcagaaaaaaaatctagaaatatacgatatgctactaattaaacacaaagacacaatatattcaaaacgaccaaattcaactacactagatatgctaatcaaaggacgctatgaattcatcaatctaaaaccagaagatcaaattagagtaatgttagaaatcctaaaactcttctgcaccactagagaagtcatcgacttagggctaataaaaggcaagtccgaagcaggcgttacaactttaggaaaaaaaataagcaaccttgattcatgtatacttatatatcaatccataaccggtatatttgaaaaaagaattgacttactaaagatttga

SEQ ID NO: 5592 - RNA, 4188 nt, synthetic construct
  misc_feature 1..4188: note = Cas9 variant
  source 1..4188: mol_type = other RNA
atgaaaaaggaaattaaagattattttctaggactcgacgtaggtacgggcagtgtaggatgggcagtcacagacacagactataaattattaaaagcgaatagaaaagatctatggggaatgcgctgtttcgaaacagcagaaacagcagaagttcgtaggctacacagaggagccaggagaagaatagaacgcagaaagaaaagaatcaaattacttcaagaattattttcacaggaaatagctaaaacagacgaaggatttttccaacgaatgaaagaaagccctttctacgccgaagacaaaacaattctgcaagaaaatgcactctttaatgacagagacttcactgacaaaacatatcacaaggcctaccccactataaatcacctcattaaagcatggatagaaaacaaagtaaaaccagatccccgcttattatatctagcatgtcataacataataaaaaaacgaggacatttcctattcgaaggagactttgatagcgaaaatcaatttgacacctcaatccaagcattattcgaatatttaagagaagacatggaagtagatatagatgcagactctcaaaaagtcaaggaaatcctaaaagactcaagtttaaaaaacagcgaaaaacaatcaagattaaacaaaatgcttggactgaaaccaagcgacaaacaaaaaaaagcgatcactaatctaatcagtggaaataaaataaacttcgcagatttatatgataaccccgatttaaaggacgcagaaaaaaatagcatcagcttttctaaagacgacttcgacgctctttctgatgaccttgcaagtatactcggagactctttcgaattattactaaaagcaaaagcagtatataactgctcagtcctatcaaaagtcattggcgatgaacaataccttagctttgccaaggtaaaaatatacgaaaaacacaaaacggatctaacaaaattaaaaaacgtgataaagaaacactttccaaatgattacaaaaaagtctttggatataacaaaaatgaaaaaaacaataacaattattcggcctacgtgggcgtttgcaaaaccaaaagtaaaaaacttgttataaataatactgtcaaccaagaagatttctacaaatttctcaaaccgattctactcgcaaaaagtgaaataaaagaagtgaacgatatattgaccgaaatagaaactggtacttttctgccgaagcaaatttctaaatcgaatgcagaaatcccatatcagcttagaaagatggagctagaaaaaatattatccaacgcagaaaaacatttctctttcctcaagcagaaagatgaaaaagggctatcacacagcgaaaaaatcataatgttactaacattcaaaattccttactatataggtcccataaacgacaaccacaaaaaatcattcccagatcgctgttgggttataaagaaagaaaaatcacccagtggtaaaacaacaccatggaatttctttgaccatatcgataaggacaaaacagccgaggcatttataacgtcccgtacaaatttttgcacatatctagttggggaatccgtactcccaaaaaactcattattgtactcagaatatacagtattaaacgaaataaataatttacaaattataatcgatggaaaaaacatctgcgacataaaactaaaacaaaaaatatatgaagaactattcaaaaagtacaaaaaaatcacacaaaaacaaatctctacctttataaaacacgaaggaatttgcaacaagacagatgaggtcataatactcggaatagataaagaatgtacttcatctctaaaatcatacattgaacttaaaaacatattcggtaaacaagtagacgaaatatcaaccaaaaacatgttagaggaaatcattagatgggcaacaatatacgacgaaggagaaggaaaaacgatacttaagacgaaaataaaggctgaatatggaaaatattgttcagacgaacagatcaaaaaaatactcaatctaaaattcagcggatggggccgactttcaagaaaatttttagaaacagtcacctcagaaatgccaggcttttccgaacccgtaaatattataaccgcgatgagagaaactcagaataacttaatggaactgttaagctcagaatttaaattcacagaaaacatcaaaaaaatcaattcaggatttgaagacgtcgaaaaacaatttagctacgattccttagtgaaaccattatttttgtctccatcagtgaaaaaaatgttatggcaaacactgaaattagtcaaggaaatttcacacataacacaagcgccgccaaaaaaaatattcatagaaatggccaaaggggccgaattagaccccgtacgaacaaaaacacgattaaaaatactacaagacttatataacaactgcaaaaacgacgcagacgcattcagctcagaaataaaagacctctcaggaaaaatagaaaatgaagacaacttaaggctaagaagtgacaaactatatctgtattacacacaactaggcaaatgcatgtactgcggtaaacccatagaaataggacacgtatttgatacatcaaattatgacatagaccacatatatccccaatcaaaaataaaggatgactctatatcgaacagagtattagtatgcagttcatgtaacaaaaacaaagaggacaaataccccctaaaagccgaaattcaatccaaacaaagaggtttttggaactttcttcaaagaaacaactttatatccctagaaaaactaaatcgactaacacgaacctctccaatatccgacgacgaaaccgcgaagttcatagccagacaacttgttgaaacacggcaagcaaccaaagtagccgcaaaagttttagaaaaaatgtttccagagactaagatagtctattcaaaagctgaaacggtctccatgttccgaaacaaatttgacataataaaatgccgcgaaataaatgacttccaccacgcacatgatgcataccttaacatcgtagttggaaatgtatataatacaaaattcacaaataatccatggaactttataaaagaaaagcgcgacaaccctaagatagccgacacttacaactattataaagttttcgactatgacgttaaaaggaataacataacagcttgggagaaaggaaaaacgataataaccgtcaaagacatgctaaaaagaaacaccccaatatacacaagacaagcagcctgtaaaaaaggagaactattcaaccaaacaataatgaaaaagggacttggacaacaccccttgaaaaaagaaggccctttaagtaatatatctaaatacggcggatacaacaaggtcagcgcagcctactacacgcttatagaatacgaggaaaaaggttcaaaaatccgctcactagaaacaataccactctatctagtaaaagacatccaaaaaaataaagatggcctgaaatcatacctaacagaccagataggaaaaaaagaaattaaaatcctaatacccaaaatcaagataaacagtctcttaaaaatcaacggattcccatgccatataacaggaaaaatgggtgaagcgtttgtactgagaccagccgttcaattttgttgctcgaatgacgaagcattgtatttcaaaaaaattatcagattcaacgaaatacgtaaacagagagaaaaaatgggaaaaacaatctcaccttatgaagatttgtcatttagatcctatataaaagacaacctatgtaaaaaaacaaaggctgatgaaatagaggaaaaagaattctacgacctcctacaaaaaaaaaacttggaaatatacgacatgttattaactaagcacaaggatacaatctataaaaaacgacccaattccgcaacaatcgacatcttagtgaaaggaaaggaaaaattcaaaagcctaataatagaaaaccaatttgaagtgattttagagatattaaaattattcagtgcgacccgcaatgtctcagatctacaacatataggaggctccaaaaatgcagggaacgcaagagttggaaacaagatatcctcactcgataattgcatactaatctaccaatcaataacaggaattttcgaaaaaagaattgacttattaaaaatctga

SEQ ID NO: 5593 - RNA, 4188 nt, synthetic construct
  misc_feature 1..4188: note = Cas9 variant
  source 1..4188: mol_type = other RNA
atgaagaaagaaattaaagactactttttaggattggacgtaggaacagggtcagttggctgggcagtaacagacacagactataaattactaaaagcaaatcgaaaagatctatggggaatgagatgctttgaaactgccgaaaccgcggaagtgagacgattacatagaggagccagacgaagaatagaacgacggaaaaaacgaataaaactactacaagagctattttctcaagaaatagcaaaaatagacgaaggatttttccaacgtatgaaggaatcacccttctacgctgaagataagacaatcctccaagaaaacgcactctttaatgataaggattttacagacaaaacataccataaagcttaccctacaatcaaccacctcatcaaagcctggattgaaaataaagttaagccagatccccgacttctctacttagcgtgccataatatcataaaaaaaaggggccatttcttattcgaaggggacttcgactcagaaaaccagttcgatacaagcatacaagccctattcgaatatctgcgagaggacatggaagtagatatagacgcagactcacaaaaagtcaaagaaatacttaaagactcatcactaaaaaattcagaaaaacagtccagattaaataaaattctcggactaaaaccatccgataaacaaaaaaaagcaataacaaaccttatatcaggaaataaaataaattttgccgacctctatgataacccagatctaaaagatgcagagaagaattcaatatcttttagtaaagatgactttgatgccctatccgatgacctagcatccatactaggagatagttttgaattgttactcaaagctaaagcagtatacaactgtagcgttctatcaaaagtcattggcgacgagcaatatctatcattcgcaaaagtaaaaatttacgaaaaacataaaacagacttaacaaaactaaaagcagtaataaaaaaacactttccgaacaactataaaaaggtatttgggtataatcaggacaacgaatccaaaaacaactactctgggtacgtaggagtctgtaaaacgaaaaacaaaaaattagttataaacaatagtgtaaaccaagaagacttctacaaatttcttaaacctattttatctgcaaaatcggaaattaaagaagtaaatgacatcctggctgaaatcgaaactggtaacttcctaccgaaacagataagcaaatcgaacgcagaaataccatatcaattaagaaaaatggaacttgagaaaatactaagcaatgcagaaaagcatttctcattcttaaaacagaaagacgagaaaggacttagccacagtgaaaaaatcataatgctactaacattcaaaataccatactacatcgggccaataaacgataatcataaaaaatcttttccagacagatgttgggtggtgaaaaaagaaaaaagcccctcaggaaaaacaacaccatggaattttttcgaccatatcgacaaagaaaagactgcagaagaattcataacatcacgaacaaatttctgtacatatctaataggcgaatcagtactacccaaaaactccttactgtactccgagtacacagtccttaacgaaataaacaacttacaaataatcatagacggtaaaaacatttgcgacactaaattgaaacaaaagatatatgaagatctatttaaaaaatacaaaaaaattactcaaaaacaaatcagcactttcataaaacacgaaggtatatgcaataaaaccgatgaagtaattattttaggaatagataaagaatgtacttcatctctcaaaagctacatagagttaaaaaatattttcggtaagcaagtagatgaaatttcaacaaaaaacatgctggaagagataataagatgggcaacaatatacgacgaaggagaaggaaaaacgatattaaaaaccaaaataaaagccgaatacggaaagtattgttctgacgaacaaataaaaaaaatattaaacttaaaatttagcggatggggacgcttaagccgtaagtttctcgaaacagtaacatcagaaatgcccggttttagtgaaccagtaaatataatcactgctatgcgtgaaacgcaaaacaacctaatggaattattgagtagcgagttcaaattcacagaaaacataaaaaaaatcaattcaggcttcgaagacgccgaaaaacaattctcctatgatggattagtaaaacctttatttcttagcccttcagtaaagaaaatgctgtggcaaacactcaaactagttaaagaaatctcgcatatcacacaagcaccccccaagaagatattcatagaaatggccaaaggtgccgaactggaaccagccagaaccaaaacgagattaaaaatacttcaagatttatactctagctgcaaaaatgacgcggacgcattttcaagtgaaattcaatatctttccggaaaaatcgaaaacgaagacaatctccgattacgaagcgataaattatacttatactacacacagctagggaaatgcatgtactgcggtaaaccaatagaaattggacacgtatttgatacatcgaattatgatatcgatcatatctacccgcagagtaaaattaaagacgactctatctcaaatcgagtcctagtatgctcttcttgcaataagaacaaagaagataaatatccacttaaatccgaaatacaatcaaaacaaagaggcttctggaattttctacaaagaaataatttcatttcccttgaaaaactcaaccgcctaacccgaactacccccatatctgatgatgaaaccgctaaattcatagcacgccaactagtcgaaacacgtcaagccaccaaagtagcggcaaaagttttagaaaaaatgttcccggaaacaaaaattgtgtactcaaaagcagaaacagtaagcatgttcagaaacaaatttgacattatcaagtgtcgagaaatcaacgatttccaccacgcacatgacgcatatctaaacatagtagtaggaaacgtatataatacaaaattcacaaacaacccatggaacttcataaaagaaaaaagagacaatccaaaaatagccgatacatacaactattacaaagtcttcgactacgatgtcaaaagaaataacattacagcatgggaaaaaggaaaaacgataataacagttaaagacatgctcaagagaaacacgccaatatacaccaggcaagcagcctgtaagaaaggtgaactatttaatcaaactattatgaaaaaaggattaggacagcacccactcaaaaaagaagggccattttctaatatcagcaaatacggaggatataacaaagtatcagcggcctattatacattaatagaatatgaagaaaaagtaaacaaaatacgctcacttgaaacaatacccctctatttagtaaaagacatacaaaaagaccaagatgtgctaaaaagttatctaactgatctactcggaaaaaaagaaataaaaatactagtcccaaaaataaaaataaattcattgcttaaaattaacggattcccatgtcacataaccggaaaaacaggagattccttcgtactcagaccagcagtccagttctgttgcagcaatgatgaagtcctgtatttcaaaaaaatcatacgttttaatgaaatacgatcccaaagagaaaaaatgggaaaaacaatctcaccctacgaagatctatcctttagatcctatataaaagaaaatttatgcaaaaaaaccaaagccgatgaaataggagaaaaggaattctacgacctactacaaaaaaagaacttagaaatatacgatatgttacttacaaagcacaaagacacaatatacaataaaagacccaattccaccacacttggaatgctaacaaaaggccgttacgaatttataaaccttaagccaaaagaccaaattatagtcatgctagaaatccttaaattattctgtacaacaagagaagctatcgacctaggcctaataaaaggaaaaccagccgcaggcgtagctactttaggaaaaaaaatatccaatttagataactgtatactgatatatcaaagtataaccggtatattcgaaaaacgaatagacctactaaaagtttga

SEQ ID NO: 5594 - RNA, 4188 nt, synthetic construct
  misc_feature 1..4188: note = Cas9 variant
  source 1..4188: mol_type = other RNA
atgaaaaaagaaataaaagactattttttaggtctagacgtaggcacaggatccgtcggatgggccgtgacagatacagactacaaactactaaaagcaaatcgcaaagacctatggggcatgagatgctttgaaactgcggaaactgcagaagtaagaagactacataggggagcaagaagacgcatagaacgcagaaaaaaacgcataaaacttttacaggaactattcagtcaagaaatcgcaaaaattgacgaaggttttttccagcgtatgaaagaatccccgctatatgccgaagataaaacaattctacaagaaaataccctttttaacgataaagattttaccgacaaaacatatcataaagcatacccaacaataaaccatctaataaaagcgtggattgaaaacaaagtcaaaccagatcctagattactctacctcgcctgtcataatattatcaaaaaaagaggccactttctattcgaaggagactttgactccgaaaatcaatttgatacatcaatacaagccttattcgaatacttacgagaggacatggaagtagacatagacgctgactcacaaaaagtcaaagaaatactaaaagattccagccttaaaaattccgaaaaacaatctcgactcaataaaatgctaggactaaaaccaagcgataaacaaaaaaaagccataacgaatctaatcagcggcaacaagataaacttcgcagatctatacgacaaccctgatctaaaagacgccgagaaaaattccatcagcttctcaaaagacgactttgacgccttaagtgatgatttggcatcaatattaggagattcatttgagttactgctaaaagcaaaagcagtctataattgctcagtcctttccaaggtaatcggtgacgaacagtatttaagctttgccaaggtaaaaatttacgaaaagcacaagactgacctaacaaaactcaagaacgtgataaaaaaacatttccctaaagattacaaaaaagtcttcggatacaacaaaaatgaaaaaaacaacaacaactacagcggctatgtcggagtatgcaaaactaagtcaaaaaaattgatcattaacaattccgtaaaccaagaggacttttacaaatttttaaaaacaatactcagtgcgaaaagtgaaataaaagaagtaaacgacatcttaacggaaatagaaactggaacattcttaccaaaacagatatccaaatcaaatgcagaaataccctaccaactccgaaagatggaactcgaaaaaatcctgtcaaatgcagaaaaacacttctctttcttgaaacaaaaggacgagaaaggattatcacattccgaaaaaataataatgctactcacgttcaaaataccatattacatcggcccaataaatgataatcataagaaatccttccccgaccgctgttgggtggttaagaaagaaaaatccccttctggaaaaaccacaccttggaacttctttgaccatatagacaaagaaaaaacagcggaagaatttataacttccagaacaaacttctgcacttatctaataggagaatcagtactcccaaaaaattcactcctttactccgaatacacagtactcaacgagatcaacaatttacaaataattatagacggtaaaaatatatgcgatacaaaactaaaacaaaaaatctacgaagaactattcaaaaagtataaaaaaattacacaaaaacaaataagtacattcatcaaacacgaaggtatatgcaacaagacagatgaggtaataattcttggcatagacaaagaatgtacatcatccctcaaaagctatatagaactcaagaacatatttggaaaacaagtcgacgaaatctcaacaaaaaatatgttggaagaaattataaggtgggcaacaatctatgatgaaggtgaaggcaaaaccatattaaaaacaaaaataaaagcagaatatggaaaatactgctctgacgaacaaataaaaaaaatcttgaatctcaaattctccggatggggacgactatcaagaaaattccttgaaacggtaacctcagaaatgcctggattctcagaaccagtaaatataataaccgccatgagagaaacccagaacaacctaatggaactgctatcatcagaattcaaattcacagaaaacataaaaaaaatcaattcaggattcgaagacgtagaaaaacagtttagttacgatggactcgtcaaaccactattcctatcaccctctgtgaaaaaaatgctttggcaaacattaaaacttgtaaaagaaatttcacacataacacaagccccccctaaaaaaatctttatagaaatggccaaaggggcagagctagacccagtcaggaccaaaacaagactaaagatactccaggacttatataacaattgcaagaacgacgcagacgctttcagctcagaaatcaaagacctatctggaaaaatagaaaacgaagataatttaagactaagatctgacaaattatacttatactacacacaactaggaaaatgcatgtactgcggaaaacccatagaaatcggacatgtctttgacaccagcaactacgatatagatcatatctacccccagagcaagataaaagatgactccatatcaaacagagttctagtatgtagttcctgcaataaaaacaaagaagacaaataccctctcaaagctgaaatccaaagcaaacaacgaggattctggaactttctacaacgaaataatttcataagcttggaaaaatttaacagactcaccagagcaacccccataagcgatgacgaaaccgcaaagttcattgcaagacaactagtcgaaacaagacaggcaaccaaagtagctgcacgagtacttgaaaaaatgttcccagaaacaaaaattgtatactcaaaagcagaaacagtatcaatgtttcgaaacaaatttgacatagtaaaatgtagagaaataaacgatttccatcacgcacacgacgcttatctaaatatagtcgtaggtaacgtctataataccaagttcaccaataacctatggaatttcataaaagaaaaaagagataacccaaaaatcgctgacacatataattattataaggtattcgactatgacgtaaaaagaaacaatatcactgcatgggaaaaaggaaaaacaataataacggtaaaagacatgttgaagagaaatacaccaatctacacacgccaagccgcatgcaagaaaggaggactcttcgaccaaacaataatgaaaaaaggcctcggacaacaccccttgaaaaaggaaggaccattctcaaatatatctaaatacggaggttataataaagtctcggcagcttactacactttgatagaatacgaagaaaaaggtaataaaatccgatcactagaaaccataccactatatcttgtgaaagatattcaaaaagatcaagacgttctaaaatcctacctaacagacttactaggaaaaaaagaatttaaaatacttgtcccaaagatcaaaatcaacagtctactaaaaatcaacggatttccctgtcatatcaccggtaaaactaatgattctttcttactaagacctgctgtccaattctgctgtagtaacgacgaagttctctatttcaaaaaaattattcgcttttcagaaatacgctcacaacgggaaaaaatcggaaaaaccatttcgccatacgaagatctctccttcagatcatacattaaagaaaatctctgtaaaaaaacaaaaaacgatgagatcggtgagaaagaattctacgatctattacaaaagaaaaatctggaaatatacgacatgctattgaccaaacacaaagatactatatataaaaaaagaccaaattctgcgactattgacatactcgtcaaaggtaaagaaaaatttaagagtctcataatagaaaaccaattcgaagtaattctagaaatcctaaaattattctcagcaactagaaacgtatctgacttacaacacataggtggtagcaagtattccggtgtagcaaaaataggaaacaaaatatcaagtctagacaactgcatacttatataccaatctataactggaatattcgaaaaacgcatagacctactaaaagtatga

SEQ ID NO: 5595 - RNA, 4191 nt, synthetic construct
  misc_feature 1..4191: note = Cas9 variant
  source 1..4191: mol_type = other RNA
atggacagcagtaaacaaggactacgccggtatcacctaggattagacattggtacaaatagtataggatggacagcaatcgatgatcacttttcacttttgagagtaaaaggcaagaatgccataggtgttagaacttttaaggaaggagagacggcagcagacaggcgcggatttagaactgccagaagacgattaagtcgaagacgctggcgtctccaatttcttgacgagttctttgctccatatctagccgaagtagatccaaactttctagcaaggctaaaacaaagcgatatctctgcaaaagatccagctaaaaatcaagaatatatgggcaaactcctcttcccagaccaagaagccgcaagtgatggaaacggctatccaacgctaatacagatgcgcaaagccatgccagcagaaaaagccgcagattttccagtattcaacatatatcaattacgctatgcactaatgaatgaaaaacggaaatttgacctaagagaaatctacttggctgttcatcacatcgtaaaatatagaggtaatttcctcaacaacacaagcgtcgataaatttaaagctgatcagatcgatttcaataaatcattcgaaaccctaaacgacctgttccgacaggtccaacctatagcaccgttccaaatcgatctgacaaaagtagatgaacttggtaaacttttacttgatactaaacaaaagaaactcgatagacaaaaagctgtcgcaaaactactaccgcttatagaagatggaacagacaaagaaattgttaaagcacatcaacagacagcacgtgaaatatctaaattaatattaggttataaagccaaagttggactaattctacaaaacaatctcgaccaaacactggacatgtctacagaaaatagcgatgatcaactaatgcaaatcgcagaagaactagacgattaccaaatggaacttataaatcaactctcattattatactcacaaataatgctgaatgaaatagtacccaacggagaaacagtgtctgcgagcatgttaaaccgatactacaaacacagatgtcagctcaaagaattgaaagattatggagccgcccaagacaagaaaactagagaacaactagaccatctatacgctgaatacataggacaaataccaaaagactcaaaatttgactttacaaaagaccttaagaaattaatggataaaagcgacctaggacagaaaataaaagatgaaatagaagctggtgattacctaccgaaacaacgaacatcagcaaatggtgtaataccccatcagatgcatcaacaagaactcgatcaaataatcgaaaaccaaaaagagtattacccctggctagcagagcctaatccagtcgagaaaaacattaaaaatgcaaaatataaattggatcagctagtatcatttagagttccctactatgtagggcccatgatcaccttagccgatcaacagaaaacttcaaaggcttccttcgcttgggcagtcagaaagaaagcaggtaaaataacaccatggaatttctatgacatgatagatagagaaaaatccgccaataattttataaaacgaatgaccaataaagatacatatttactaagcgaggacgttctcccagcttcaagtttactataccaaaaattcaccgtattaaacgaattaaataacatacgagttaacggtcgaaaactacaaccagcactcaaacaagcaatatatactgacttattccaaaaacgaaaaacagtaaacctaaaaacgctgacgaactttttagcaatacatgaaccaactctcacaaaaccaaaaatagagggcttatctaatggcaggtcattcaactcttccttaggaacctatatagacatgtcaaaaatactcggggactccctagatgacttaaactaccgagatgatatcgagaaaatcatagaatggtctaccgtattcgaagattcagaaatatatggagtaaaactacaagaaatacaatggttaacaaatgaacaacgagaaaaattagttagaaaaagataccaaggttggggaagactctccaagaaactattaacaggtataacagacgaaaatggacaacgcataatagatttaatgtgggacaccagcaaaaatttcatgcaaattgtacatcaaccagtctttgaagaacaaattgcagaactcaaccaacagcttttacaagatgcagacaaagctcctcttgaagtagtagatgacatattggctgatgcctatacatcacctcaaaataagaaagccattagacaagtagtaaaagtagtagcagacgtcgtaaaagcagtaggaaatgctcccgccagtatatccattgagttcgcaagaaatgaagaccgtaataaagaactgaaaaactctcgacgacattcaatagaaaaattataccatgaaaccgcagaaaaattagtcaaacaaacaaacttactagaagaattgggcaatgttaaagatctaaatgatcggtattatctatattttacacaagcaggccgtgatatgtatgacggaacacctattaacatagatgaaatcagcactcactacgaaatagatcacattttacctcaatcattccttaaagacaacagtctggataatagagtgctagtaaagaaaagtgaaaacgcagcgaaatctgatcgagtacctgcaaaactatatggagccaaaatgagagcattttggaaacaactgaaagaatcgcaattaatatctaatcgtaaatatcttaatctcaccacagacccagaacaagtagataaataccaaatgcaaggattcgtacataggcagctagttgaaacacgccaaataatcaagctagcagctaacatattcgggagtctatatcctgacagcgcagtaatcgaaacaagagcggaactaactaaacaattaagagaaaaattcagcctatataaggtaagggatgtaaacgattaccatcacgcagttgacgcctatcttactgcctttgcagggcattatctttaccaacgttaccccaaacttcgccccatgttcgtatacggagactacgctaaaatatatgcagacgatctcaaaaggttaagatctgtgaatctctttcacgaccttgagaaagaccaatacaattctggaacggcagtaaatccagaaactaaagagaaaatcgtagacgtcgactggctaagtgattacgtgagcaagatacaacactttaagtatatgctcataagcaaagctgtatatactcaacacggccaattatatggagcaacaatactcccagtcgctcaggttgacaaaatatccgcgccaattggcatcaaagatgacaaacccgttgacatatatggcgcctacacaaatgaagttgctgcttatatggcaatagtcagagttaatggtaagaaaccaaaatataaagtcgtttccgtcccagtaagaatgctacaaagactaaaaatggctgaacaaaaaggacatgatcagtatatgcaaaccctacacgatgtgctattacgcaattttacctcactaaagaaaaacagaaaaacaggattgaaagaagcagtagttaaagacttcgacgtattagtaccatgcgtaagatataaccaattagtaattgatggcgacaccaaattcacattaggaagcgctacataccaacacaacgccaaacagctagtattatgtaatcactctctcgaaacactcgcgaacaactttgaatacgtaagaaaacatccagatgaagcggacgaaagaatgataatgctatatgatgacatattagatcaagtaaatcactattttaccttgtatgacaaaaataaatttcgagaaaaattaaacgctggaagagataaatacttaaaactacccacgttttcacaattcgaaaataacaagaaaacagcaatcggaaaaagtgaagcaataataaatatactaagagggttacatgcgaacgctgctattacaaacctaaaatgcctaggtgtaagcacaccgttcggtcaactccaatcaccatcaggcattgaattaagtgaaaacgcaaaacttgtatatcaatcccccacgggtctcttctcaagagaagtactattgaaagatctatga

SEQ ID NO: 5596 - RNA, 4191 nt, synthetic construct
  misc_feature 1..4191: note = Cas9 variant
  source 1..4191: mol_type = other RNA
atggcaaatttgagaaactataaaggtgattataatattggacttgatatgggtacaggtagcgtaggatgggcggttacggattcagaaggaaaattattacattttaagaaacaaccgacctgggggagccgtcttttcgactcggcagaaacagcagccagtgcgagaataccaagaggacaacgtaggagatatgtaaggagaaggtggagactagacttactacaacagctatttcaggacgaagttagtaaagcggatcccgagttcttcataagattaagacaaagtagattattgaaagaagatagagaggagggacatcgggattacaatcatccattatttaatgattcagacttcactgagacagactattataataggtttccgacaatatatcatctaagaaaatggctaatggaaacggatgaaaaagcggatatccgattagtatatttagcagcacacaacatagttaaacatagaggtaattttcttcgacaagaaaatacgagtttaagcgctaaaaacgctcgaccgctagatgcattgagagaatttaggtcggcattagtagactggtgtgcggaacttggatacgaatgtaatcctgacgaatcaggtgaaattagtaacgagatattgtcagtccttgaagaggaacacgtagctaacagcgataaaaagaaacgaatatcgagcttaataggggtagcaatgaacgaaggagcaaaagagagcaaagcgtgcaatgatgcccttgctggtgcaatggtaggattgaaagcagagttcaaaaacgtattcggagaaatttcagcagaacagactagcatatacttgagtaatgacgaagcggtagacgcattaagagaaggcataccagatgaaggattagaactcttcggtaaactatgtagcgtatatagcgcgtatgtacttcagggactgctaagctatgcaccaggacaaacaatatcggtaaacatggtagctaaatatgaaaaatatggaaatgatctgaaaacgctaaaagcgctagtctgtgaatacgcaagagcggaatatgattccttcttccgcggagaattttatagagatcaggatggacatgaattgaacatatataacgccagtaaagcacaagggtatactagatataatttagggacatcaaagatgagttacgaagatttcgaaaaagcggtaaagaaactattcgcaggaacggcagctgaagaagacggaagatacctgcaaatgatgaaagaatttggcgaacaacgattcctaagaagattgaaaacaagtgacaatggaagtatttactatcaacttcatttggaagaattaacagctatattgagtaaccaagggaaacactatcccttcttagtagaagatgctgagaaaataaaaagtttggtatcttttcgtattccatattacgtaggtccgttgacagatagaaacgcaaggaaagataagcatggcaaaaatagattcgcgtggagcgaaagaaagagtggaatggaagacgcggtaattacaccatggaattgggacgaagtgatcgatcgaggaaagagcgccgaagcattcattacacgtatgactggaatgtgtacatatttgcagggagaagatgtactaccaaaatgtagcctcctgtatgaagagttctgcgtattaaatgaattaaatggaagtcgatggggcatggacggagataaagaacacaggttcgatgcagcagaccgggaagcaatcatagaggaacttttcaaaaagaagaaaaccgtgaaatataaagacgtcgcaaactggttggaaagagaggcaggtaggatgaacgttcatgtcatgggaggccaaggtgaaacaggatatgagagtaaattaagtagctattacttctttcgcagagatatctttgatgttgaagaattagacagagctgattatccaatgattgaacaaatcatcctgtggaacacactctttgaagatcggagaatactaaaagaaaaactagaagacgcatacgggccaaaaggaaacggacggctggacgatgatcaaataaagaaaatatgccgaaaaagatttacaggttggggtagattaagtaagaaattcctgacaggaataaaagttgatacggactgtggacctcgatctataatggatgtgctaagagaaggagatcctaacgcaggtttccgcggaaaaacaatggtaatgatggaagtcctaagggatgaaaacctaggttttcagcaaaaagtggatgagtttaacaaaaactatttcggtcaaaaagggaaagcattagaggtaaatgaattaccagggtctcccgcgataagaagatcgttaaaccaagcaataagaatagtagacgagatcgcaaaaatagcaggaaaagacccagaaagtatatttatcgaagtaacaagagacgacgaactagacaaaaggggcaaaagaactaagagacgatacgatgcactgaaagaagcactaacagtatttaagaaagaagatccggaaatatgggcagaattacaagctacaagcccctcggatttggatgaaaggttgactttatattttatgcaacgagggaaatgtttatactcaggagaacctatagatataaacaaactctcaagcggcgaatacgaagtagaccacatcataccaagaagttatataaaagacgatagcctagagaataaagctctagtgtgcagaaaatacaaccaatcaaaaactgacgcgatgctcctagatcctagtataaggcgaaaaatgagaagttattgggatatgttactagacgctaaactaattgggcccaagaaacatcggaatctactaagggatcacatagacgaaaaagcgatgaaaggatttgtagctaggcagcttgtagaaacgtcccaaagcgtaaaactagcaggcagcctgctaagcgtcagatatccaaacgcgaatattgtacctgttaaagcaagtatgagccacgatttgcgagaagctgcaggatttgtaaaatgccgtgaggcaaacgactttcatcatgcacacgacgcgtatttagcatgtagaatgggactttttatacagatgagacatcctaaagtatatgaaaatccgatagcaatgacaagggtaatgcagaaatatgcacaacaacaatctaaggaatttaacagaaatcacagagttcctggaacatctggattcattgtaaacagctttatgtccagcggattcgataaagaaacaggagagatatttaaggacacttggaatgcagaaacagaaatcgaaggaataagaaaggctctaaactatcgtcaatgttatatatctagaatgccaatggaagataccggagccttttggaacgcaacggtatacagtcctagagatcctaaaatgggtccaaagttagcgctgccacttaagaaaggactggacccgaaaaagtacgggggttttagcagccagcaattcgcatatttctttgtatacgaagcacgcgataaaaaggataaacaagtttttagatttgcagaagtgcctgtatggttagcctcccaaatagaatcagataagatagcactagagagatatgcaacgggcctcgcagaagcagaaaaactaaaattcgtaagaatagaaagagctaaaatattgaagaaacaactaatagaaattgatggagatagatttatactaactggtaagaaagaaatgaggaatggacgggaactggcgttatcacaaaaagaaacactaaatctaatagtagccggagatgaaaatgcaagcctagatgatcgcggaaacgcatcagatgcagtttttgacgcgatcgtacgtcagggagacgaaataggattaagactatacaaacaactaaaaatagcagaaatagcagaaagatacagaagcgtaggcgcagatgcaaaagttggtgcggtaatgtctttattatcatcaataaatgctagttcaaatatggttaacctgagtatggttggaggatccaaatacgccggaaatttgcagccaaattattcgaacttactctcagatccagaaaccaacttcgtaataatagatcaaagtgttacagggatgttcgaaagaaggacacggattggattatga

SEQ ID NO: 5597 - RNA, 4191 nt, synthetic construct
  misc_feature 1..4191: note = Cas9 variant
  source 1..4191: mol_type = other RNA
atgactaaaccatattcaataggtttagatataggaacaaacagcgtgggatgggcagtaataaccgacgattataaagttcctgccaagaaaatgaaagtactcggtaatactaacagagactacatcaagaaaaacttgctaggagcactattgtttgatggaggagaaaccgcagaaggaagacgactaaaacgaactgcaagaaggcgatacacaagaaggaaaaacagactaaggtatctacaagaaatatttgcagaagaaatgatgcaagtagacgaaagtttctttcaaaggttagacgactcttttctggtagaagaagataaacaaggtagcaaataccccatatttggaacacttaaagaagaaaaagaatatcacaagaaatttaaaacaatttaccacctaagagaagaactcgcaaactcaaaagaaaaagctgatctaagattagtatatctagcattggcacatatgataaaattcagagggcatttcctttacgaaggagacctcaaagccgaaaacacagatgttcaagccctattcaaagatttcgtcgaagaatacgacaaaacaatagaagaaagccacctaagtgaaataacagtggacgcattatcgattctcacagaaaaagtatcaaaaagctcacgtttagaaaacttaatagctcactacccaacagaaaagaaaaatacactttttggtaacctcatagccctatcactaggattacaagccaatttcaaaacaaattttcaattaagcgaagacgcaaaattacaattctcgaaagacacctacgaagaggaccttgagggattactcggagaagtgggggacgaatatgcagatctctttgtcagcgccaaaaatctctacgatgcaatacttctctccggcatactaacggtggatgacaacagtacaaaagccccactgagcgcctcaatggtaaaacgatataaagaacataaagaagaactcgccgcattcaaaagatttataaaagaaaaattacccaagaaatatgaagaaatatttaaagatgacaccaaaaatggctacgcgggctatgtaggagcagataagaaacttagaaaacgatcgggaaaactagcgacagaggaagagttctacaaatatgtgaaaggtatattaaacaaagttgaaggtgctgactactttttagataaaatagacagagaagacttcttacgtaaacaaaggacgtttgacaatggatcaataccccaccaaattcacttacaggaaatgcacgcaatactgagacgacaaggggaacattacccctttttgaaagaaaaccaggataaaatagaaaagatactgacatttaggataccatactatgtgggaccactagcacggaaaggatcacgcttcgcctgggccgaatacaaagctgacgagaaaataacgccatggaatttcgacgacatactggacaaagagaaaagcgctgaaaaattcatcacgaggatgacactaaacgacctatatttaccagaagaaaaagtattacccaaacacagcccactatatgaaacattcaccgtctataatgaactcaccaaagtaaaatacgtaaatgaacaaggagaagccaaattcttcgacacaaacatgaaacaagaaatcttcgatcatgtatttaaagaaaatagaaaagttacaaaagataaactacttaactatttgaataaagaatttgaagaatttcgtatagtaaatctgacgggactagacaaagaaaataaagcatttaatgcgagtttaggtacttaccatgatctgcgtaaaatattagacaaatcattcttagatgacaaagtaaatgagaaaataatagaagacatcatccaaaccttaacactattcgaagatagagaaatgattcgacaacgtttacaaaaatatagcgatatatttacaacacaacaactaaaagaattagagagaagacactatacaggatggggacgactatcttataaactaataaatggaatacgaaacaaagaaaataagaaaactatacttgactatttaatagacgacggatacgcaaacagaaatttcatgcaactgataaacgacgatgcgcttagctttaaagaagagatagctagagctcagataattggagatgtagatgacatagcaaacgtagtccacgatctcccaggtagcccagccatcaagaaaggaatattacaaagtgtaaaaatagtagatgaattagtaaaagttatgggccataatccaacaaatataataatcgaaatggctagagagaatcagactacagacaaaggaagaagaaactcacaacaaaggttgaaactcttgcaagattcactaaagaaccttgacaacccagtaaatatcaaaaatgtagaaaatcagcaactgcagaacgatagattattcctctactacatacaaaatgggaaagacatgtacaccggtgaaacactagacattaataacctatcgcagtatgacatcgaccatattataccacaagcatttattaaagacaattctctagacaacagagtattaacgagatcagataaaaaccggggcaaaagtgatgatgtcccctccattgaagtagttcatgaaatgaagtctttttggagcaagctactttctgtaaaacttatcacacaacgtaaatttgacaacttaaccaaagcagaaagaggcggcctaacagaaaacgataaagcaggctttataaagagacaactcgttgaaacacggcaaatcacgaagcacgtagcacaagttctagacgcaaggtttaacgccaagcacgatgaaaataagaaagtaataagagacgtaaaaataataaccttaaaaagcaatctagtaagccaatttagaaaagacttcaaattctataaagtacgagaaataaatgactaccaccatgcacacgacgcatacctgaacgcagtaataggaacagcgttactaaagaaatatcccaaattagcctcagaatttgtttacggagaatttaagaaatacgatgtcagaaaattcatagcaaaatccgataaagaaataggaaaagcaacggccaaatacttcttttattcaaacttaatgaatttctttaagaaagaggtgaagtttgcagatggcacagtggtagaacgacccgatattgaaacaagcgaggatggcgagatagcgtggaataagcaaacagattttaaaatcgtaagaaaagtcttaagttaccctcaagtcaacatagttaagaaaacagaagtgcaaactcatggattagatagaggcaaacctagaggattattcaacgctaatccttctcctaaaccaaaaccagattcaagcgaaaatttagtaggtataaagcgcaacttagatccgaagaaatatggtggatatgcagggatatcaaattcatacgcggtattagtaaaagctattatcgaaaaaggtgtcaagaagaaagaaacaatggtactcgagttccagggaattagcatacttgacagaattacattcgaaaaagataaaagagccttcttattaggaaaaggatataaggacatcaagaaaattatagaattacccaaatacagtctttttgaactaaaagatggatctcgcagaatgttagcgtcaatactatccactaataataaacgaggggaaatccacaaaggaaatgaattgtttgttcctcaaaaattcacaacgttactataccatgcaaaaagaataaacaaccctatcaacaaagatcatatcgaatacgtaaagaaacatcgtgatgacttcaaagaactacttaactatgtattagagttcaatgaaaagtatgtaggagcaaccaaaaacggagagagactaaaagaagcagtagcagactttgatagcaaaagtaatgaagaaatatgcacaagttttctcggagccgtaaattccaaaaacgcaggtctcttcgaactgacctcacttggatcagcatctgatttcgaatttttaggcgtcaaaatacctagatacagggattacacaccatcatcattattaaaagacagcatattaattcatcaatccataacaggcctatatgaaacaagaatcgaccttagcaaattaggtgaagactga

SEQ ID NO: 5598 - RNA, 4191 nt, synthetic construct
  misc_feature 1..4191: note = Cas9 variant
  source 1..4191: mol_type = other RNA
atgaaacgagtgaatgaagattacattctgggactcgatataggaaccaacagctgcggatgggctgtaaccgacaagaaaaacaatttactcaaattaagaggaaaaacagcaatcggtagtcatttattcgaagaaggtcacaccgcagctgatagacgaggattcagaacaacaagaagaagactaaaaagacgaaaatggcgcctccgattgctagaagaaatcttcgcagaacctatggcaaaagtagatccaggattctttgttcgtctccatcaatcctgggtaagtccactagataaagatcggaagaaatacaacgcgatagtattcccaaccgcaaaagaagatcaagcattctacaaacactacgctacaatttatcacctccgagacgaactaatgacacaagacagacaattcgacttaagggaaatattcctcgcgattcaccacatagtaaaatacagaggaaactttttacaagacacgcctgtcaaagactttgaagcatctaaaattgaagtcggcccaattctttctcatataaacaatgcatttgcagagaaaatagtggaagaccaagacccaatagaactaaatgttgccaatgccgcagacattgaagatgtgatacgaggtaaagacgccgagaaaaccgtttacaaattagacaaagtcaagaaaatagcaaaactcctcactgacagcaccgcgaaagaagagaaaaacgtagccaaacaaatagcaaacgcaatcatgggatataaaacccaatttgaaacaatcttagacaaagaaatagataaaagcgataaagcacaatgggaatttaaactaagcgatgcagacgctgatgataaactagacgcgctactaccagaccttgacgaaaccgaccaaacagtcgtagccgaaatagaaaaacttttctctgctataacactttcaacaattgtcgacgaaaataaatcattatcacaatcaatggttgaaaaatacaagaaacacaagaaagattacaagaaactaaagaaatacatcaatacactacaagaccaaactaaagcaaagaaattactattagcgtacgatctatatgtaaacaacagacatgggagactattagaagccaagaaaaccttcgaagataaaaagaaaaagaaagcattaacaaaagacgagttctacaaaatagtaaaagataatttagacgactcagacctagcacacgaaatacaacaagaaatagcagcagacaatttcatgcccaaacaaagaacaaattcaaacggagttataccattccaacttcaccaaatagaactagacaaaattatagctaaccaaggtaaatactatccattcttagcagcagaaaacccggtagaagatcatagaaaacaagcgccttataaactagacgaattagtgagatttagagtaccatattatgtcggtccaatgataacagctgatgaacaagagaaaacctccggcaaatcctttgcatggatggtgcgaaaagaagacgggcaaatcacaccctggaatttcgaacaaaaagttgacagacaagaatcagccaacaaattcattaaacgcatgacaataaaagacacctacttgttatccgaagacgtactgcctgccaattcactattataccaaagattcgaagtcctaaacgaactaaacaacatacgtattaatggtagtagaatatcagtagaccttaaacaacaaatattcaatgacttgttcgaagagaagaaaacggtaacagaaaaatcactaacatcatacttaaaacaaaacttgcacctccccacagtagaaataaaaggtctagccgacccaactaaattcaattcatctctagcttcatattaccatttaaaatcactacatgtctttgacaaagaacttgcggacccacaataccagaaagatttcgagaaaataattgaatacagttcaattttcgaagataagaaaatcttccaagacaaactacatgccgagttcaaatggctaacacccgaacaatttaaggctattagtacttggcgattacaaggatggggacgtttatcccgtaaactacttgtggaactacatgacactaatggacaaaacataatggagcaattatgggattcacagaaaaactttatgcaaatcgtaaccgaaccagactttaaagatgccatagccaaagaaaatcagaacgtcacaagagctaacggcgtcgaggaaatactagcagacgcatatacatccccagcaaataagaaagccatccgccaagtcgtaaaagtagttgcagacgtcgtcaaagctgctggcggaaagaaacctgcacaatttgcaattgagttcacaagagatcccgataaaaatccacagttatcacatattagaggaaccaaactacttaaggcttatcaagaaaccgcaggagaacttgtagaccaaaaattaactgattcgttaaaagaggcaatgacctcgaggaaactattaaaagacaaatatttcctgtattttatgcaagcaggacgtgatgcatacacaggtcagaaaataaacatcgatgaagttagtacaaattaccaaatagatcacatattacctcaatcatttataaaagacgatagttttgataatagagtactaacagccacaccactaaacgcggagaaaagcgacgatgtaccgtacaaacgcttcgcaaacaattatgtgtccgatatgaaaatgaccgtaggcgaaatgtggaaacattggcaaaaagcgggaatcataaataaacacaaacttggaaacttactcctcgatccagacagactaaataaattccagaaaagcggttttatcaacagacagttagtagaaacatcacaaattatcaaattagtttcagttattctccaaaacaaatatccggacgctgaaattataactgtaaaagccggagataactccgcgttaagacaacgccttaatctatacaaatcaagagatgttaacgactaccatcatgctattgacgcctacctatcaataatttgcggcaacttcctatatcaagtataccctaaatatagaccttattttgtttatggaaaatacaagaaattctcacaagatcccgacctacaaaaagaagttatcaaacactttaaaggatttacatttatgtggcccctattacaaaaagacaattcagagaggaaagcaccagaaaagataaaagagaataactccgatcgcatagtcttctacaaacacccagacattttcgataagctccgaaaagcatacaactacaaatatatgctagtatcaagggaaaccaccacagaaaactcagggctttttgacgtcactatttaccctagaggagaaagagacttagcaaaaacaaggaaattaataccaaaaagtaacggcctcgatcccaaaatatacggcggatattcaggtaacactgacgcttatatggtaattgttaaaatagataaaggaaaagaatcaatatacaaggtcatcggggtaccaatgagagcactggcctcacttaacagggctaagaaacaaggtaattataaagaagaacttcatcaagtgcttgaaccacaaataatgtttgataaaaatggcaaaccaaaacgatcagtaaaaggcttccgtataatcaaagaccacgtaccattcaaacaagtcgtattagacggtgacaaaaagtttatgcttaattcctcgacatatgaaataaatgccaagcagttgaccttaacaccagaaaccatgagaatagtaacagataacttgaagaaaggagaggatcaagaccaattattagttaaagcatacgacgaaatactacaaaaggtcgaccaatacttacctttattcgacgtaaacaaatttagaaacagtctccatctcggcagagctaaattcttggatctagcagtaaacgataagaaaatcacactaaccaacatactcaacggtttacatgataacttagtaacacctgatcttaaaaacatcggaatcaaaacacccctaggtaaactacaagtaccatctgggatagtgctcagctcagaagcaatattaatctttcaatcaccaacaggtctcttcgaaaagcgggtaagaatagctgatctatga

SEQ ID NO: 5599 - RNA, 4194 nt, synthetic construct
  misc_feature 1..4194: note = Cas9 variant
  source 1..4194: mol_type = other RNA
atgaaagactacaatataggattagacataggaacatcaagtatcggatttgccgccatagatgatgataataatctcattagagtaaaaggtaaaaacgtaatcggatcgagacttttcgcagaaggtaaaacagcagcagaacgtagaggtttccgaacagccagacgacgctacaaccgaagaaaatggagactaaagctattagacgaaatattctatgaggaaataatacatatagacccagagttctttaatagattaaaacaatcatcaatatctccaaaagatgaatcaaagaaatattttggatccttattatttccggacaaaacagattccgcgtactatcatgatggaaaccaaacaatataccatcttagaaaccgtcttgtgcatcaaaaagaaaaagccgatataagagaaatttatttggcgctaagacacatagtaaaataccgcggaaacttcctagacagtacgccagtcagctctttcgaagctgataacctgaaactagacgaactcgtcccagtaataaatgatatgtacgagaacattgacattgacttcagcattaatgtcgacaatatatcggaaatagaaaaagtactcttagataatcacctaaaatcagcagacaaacaagatcgacttaaagaattactttacgacaaccccgaatatcccgatgacaaagtcaaacaaaaggaaataagtaaattccgcaaagatctagacaaagaaataattaaagtaattgttggatataaattcaatgcatacaaaatagtaaattacatacccgacgacggatctaaattctcattcagcttctccgatgaatcatccgacgacaaactagatgacttatccgaagtactagatgactcacaaatggaaatactcaatacactaaaagttatttattcccgcgtacgtttaaaccaaataataccaaatgggatgggattatcagaatcaatggtagcaaaatacaacaggcatcacgagcaactcgaagacctcaaagagttactagacgtactcccaaatgatgaaaaacgatcaatagaatatgcatatacagcatatataggaaacgttgacaaacaaaaatataataataatttagtcgcatctctaaaagacctgccaatcaaaggagatatcaacaaaaagatccaagcggtatttgaatacgcaaaaggccacatatcatcacaagacctgtatgatgttatcaagacaattattatagataaatatctagaagatgaatcatttgaatatcatgatcttgtagaacgaatttccaacgacatagataataaggattacctacttaaacaaagatcctcccaaaacggaaatatcccacatcaagttcaccaaatggaaatggacaagataatcgccaatcaaagtcaatattaccctttcctaggagttttaaatcccaatgaatccagacgtcatatcgctaagtataaaatatccgaattagttagcttcagagtgccatattatgtgggaccattaataacacccgaggaacaagagaaaacatcaggtaaacatttcgcctggatgaaaaggaaagaagcaggtaaaatcaccccatggaattttgaagaaaaagttgacaaagaagcaacagccgctaaatttatcaaaagactgacggtcaaagacacttacctactcaacgaagacgttcttccagacaatagtttactatatcaacaatttaaagtcttaaacgaactgaacatagttaaagttaacaataaaagactcacactatcagaaaaacaaggtgtatacaacgatctttttaaaaacacaaaatcgataactgttaaacgcctcaaaaattacctaatttctaattacaaacaccttgaaaacattgaaataacaggcttatcagacggcgataaatttaacaatagtttaggaacttataacgacttcaagaaaattttcggagcacgtattgacgacgtgaattatagcgcagacttcgaaaacataatagaatggtcaactgtctttgaagaccgatcaatactcaaagaaaaactggaaaaagacatcgattggattaccccagaagaaataaaagcagtagtggcaaaacgatatagcggctggggaagactatctgctaaactactaacggaattattggacgacgatggacaacgtataattgatattctatggaacgattcaattacatttatggaagcagtctcaaaaccagaaataaaagctcaaatccaaaacatcaatagagattttattaaagcaacagacattgaaactgtattggacgaagcctacacatccccacaaaacaaaaaggcgatcagagaagtatacaagctagttaaagatattcagaaagcgatgggaggtaaagcaccctcgtcaataagtattgaatttacaagatcacctgaagataatggaagcgttaccaaaacacgatacaacaacatgcaaaacaaatacaaagaactaggtaaagaattatcagatgacctatcagcacaactcaaagaatacaaaggtagaatggaccaagataaattctatctctactttatgcaaatgggaaaagatttgtatgacggatcaacaataaacctagatgacttaaattcttatcaaatagatcatatcgtaccacagagcttctataaagacgacagcatcgacaaccgagttctaacacactacaccaacaatcaaaagaaaggaaaccatacacccctaaatggacttaacattgacgcacaaacgcaaaatctatggaaacatcttaacaaattaggtcttatcagcaaaaagaaactacaaaatctgtgttttaaagacataaaccaactatcaaaatatacaaaacacggattcgtacgacgacaactggtagaaacatcccaagtaataaaacttgttgcaaatatactttccgacgagttcgcaaacgacggcaccaaaataatagaagtaaaagcgaaaatgaactcattgatgcgcgacacattcaatctatataaagttaggcaattaaatgattatcatcacgcagtagatgcataccttacgacctttgtaggaaaatacctatacaaaagatacccaaaattaaggtcaatgtttgtctatggggattttaagaaatttagcgcagaagatgacctaaaagatataaaaacgttcaactttttacacgatataactaatccgaaagaaagcaataaagagaaaatatatgacgaaaaatcaggagaattaatactagatagaaaacatgcaatcgaaactattaagaaaatttatcaatacaaatttatgctcattgttcgagaagtttcaactaaatctgggcaattattcaaacaaacaatatatagcgctaagaaaacgaatggactgaaatcagcaataccggtcaaaagtaacctagaaccaagcatctacgggtatcggtcaggaaatgtagaccatcatatggtcatcgttaaaataaagaaaggcacaaaatatagtttcaaagtcatagggatatctgcccgagcaatccaagaattagaaatagcaaagaaaataggtaactatagagataaactatatgaagtagtctcagacagactatcccaatcaatgaaatcagtcgagagcttcagaataatcctagataacatcatgtacggacaattgatcgtagacggaaatgacaaattcacactcggctcagcagactacaggaaaaattcacggcagctagtactatgcacgaactcactgaaaatacttaaagacgaggactatatgaacagactatcagacatacaacgatccaaattaatggtccaagtatacgacgaaataattaaaatcatgaaaaataaatattcattattcataagcaacacggaaaaactcttagagaaaagagacatcttttgtggactctcatttgatgaacagaaaatagtaatatggaaaataataatcgatttacataatggaccattcacgaaaatccaagaacttggcattaataacaaaatgggaacgttccaaacaaaacatggtataatacttacagaaaatgccattgttatataccaaagcccttcaggattattcgagaggaaagttagactaaaagatctttga

SEQ ID NO: 5600 - RNA, 4194 nt, synthetic construct
  misc_feature 1..4194: note = Cas9 variant
  source 1..4194: mol_type = other RNA
atgaaaaaagtactaggattagacctaggaacgaattctatcggttgggctctagtaaatgaggcaacaaaggaagagaaaaaagaagggaaaagttctgaaataataaaactaggagtaagagtaaatcccttaacagttgacgaaaaaacgaacttcgaaaaaggaagaccactaagcacgaatgcggacagaacactgaaaagaagtgccaggagaaacttacaacgttataaacttcgacgcagaaacctcatagaaatattgattaaaaacggattcataactaaagatacaccacttacagaaacgggcaaagatacaacgcaccaaacactgaaactaagagccaaaagtgcaaaagaaaaagtagacttaaaagacttcgcaaaaattttattaacaatcaacaaaaaaagaggatataaatcatcccgaaaagtaaattctgacgaagacggtttagcaatagacggaatggcagtggcaaaacatctatacgagcaaaacctcactccaggccaatacgtgctcaatctactacaaaaaaacaaaaaatacgtacctgatttttaccgttccgacctacaagaagaattcaaaaatatctggaacaaccagaaaacatactacttcgacatactaacagataccctatttgaagaattgaaagacaaaaacaagtcacaaacttgggctatatgtaaaaagccattcgacattgcaggaataaaacaaattggcaaagcaagtgacaaacgacttgaacggtataaatggaggacagaaggcctaacccagaaattaaatctagaatatctagcaatcgctcttcaagaaataaataacgacataaacaaaagctcgggatatttaggtgcaatatcagaccgatcaaaagaactattttttaataaggagacggttggcgaaaatttatacaggcaactggtaaaaaccccacatacaagcttacgaaaccaagtattctatcgtcaagattacctagacgaatttgaaaccatatgggaaacacaggcaaagttctacccacaactaacgcatacattaaaagaagaaataagagacgtaataatattttaccagcgaaaattaaaaagccaaaaatccctaatctcattctgtcaatttgaatcatgggaacagacctacatagaaaaggaaactggtaaaagcaaaacacgaaccgtaggccggaaagtaatcccgaaatcttcaccattatttcaagaatttaaaatttggcaaaacctaaactccttagaatttcgaaactcagacgaaggcgagataatagagttcattaaactagatgaggacataaggcaaacggtattcgaagaacttaatttacgaggaaatttaaaaccaaacgatgtattgaagatactaggcaactacataagtttaggaaaagtaagccaatggaaatgcaattttgaagaaatagaagggaatcgcaccaacgccgccctatacaatgtctatcaaataatagcagaaaacgaaggatacggtttcgattgggccaaaaaaaccgcatccgagataaataaagagctcaagaacatctttccacaactgggcatagatgcatcaattttagacttcgacttcacacaagctaactttgacaaacaaacatcctatcaactctggcaccttttatattcagctgaagaagactttaaaatctccgaagaagacaaagtactttatggtaattcatcagtaagcttaaaaaaaaaacttcaccaaaaatatggcttcaaacccgaatatacaaaactacttactaatatttccttacagccagactacggtaatctctcagccaaggcaatatgtaatatactaccttatctgaaagaaaacaacgtttactccgaggcctgcgacctaactggatacaaccatagcaactttctaacagccgaagaacaagccaaaagacccctcaaaccaattttagaacttctaaaaaaaaacagcttgcgaaatccagttgttgaaaaaatacttaaccaaatggttaacgttgtcaaccaagtaatagaaacttacggaaaaccagacgagataagaatagaactaaccagagaattaaaaaaaagcgcaaaagaaagagcgaacatgaccaaatcaattgccgatgccacaagacgaaatgacgattacagaaagacaataatcaaagaatttggtatcccaaaccccacaaaatcagatgtggtacgatatcgcctctggcaagaactagcctcaagaggatataaagacatatttacagacacagaaataaaaccacaagaactctttagcaataaaatagacatagaacatataatccccaaagccctactctttgacgattcattctcaaacaaaaccttagccttcaaaaaagacaacttaaagaaggcaaatcgcacagcatacgattttatagcaaacgattacgcacccaacctagaaaactatatagagagagtggaatccctgcataaagataggaaaataacacgagctaaaagaaacaaattattgatgcttcaatcaaaattaccagacggatttattgaaagggacctaagaaatagccaatatataactaaagaggccaaaaaaatgctttacgaagtatgcagaacagttgtatctacctcgggctctataaccgataaactacgtgaagactgggatctcataaatgttatgaaagaactaaacttcccaaaatacaaggcattagggctaacagaaaagatagaacgatatgacatcggagcagaaaaaatgaaagaagtcgaaattattgaagactggaataagcgtaatgaccatagacatcacgccatcgatgcacttacagtagccttcagtacacacagtcacattcaatatcttaatcacctcaacgccagacgagacgaagggcataaaaaacacgctgcaatcattgccatcgaatcaaccataacagaaaaagagggaaacaaaaaaaggagatttatagctccactacccaactttagattacaggctaaagaacacattgaaagcatactagtatcattcaaaaacaaaaataaagtagttactaacaatataaataaaactaagagaattaaaaaagacaaattcaacaccaaagtccaattaacaccaagaggccagcttcacaaagaaacaatatacggaaaaatcaaacaaccactagaaaaacacatcaaactcaataaatcctttacacttgaacaggccaaacttatcatagacaaacgtcaaagggaaaaagttctcaaccacctagaaaaatatgcacataattccgacattgcattcaacagcaaaacactaaaaaaaaaccccttactcatatcagacgaacctctcaaagaagtactctgcttcgaagaggtattcaccatccgtaaagatataagctatgacaactttaaaaacgaaaaacaattagataaagttatagacgaaaaagtaaaacaagcactcaaagaaagaataaatcaatataacggcgacttcagagaagcctttagcgatattgagcgtaacccaatatggctaaacaaagcaaaaggaatctgcgttaaacgagcaacaatcaaaggagtatccaacgcagaacccctccatacagccaaaaatcatcttggtgaagaagtcctaactgaaaataaagaacaaatacccgtagattatgtaagcacaggaaacaatcaccacgtcgccatctacgaggacgaagatggaaaccttcaagaaaaagtagtatcattttatgaagcagttatacgagtcaacgaaggcttacccattatagacaaggaatataacaagtctttaggatggacttttaaatttactatgaaacaaaatgaaatgttcgttttcccatcagaagatttcaatccaactgaaatagaccttctagaccaaaaaaacgcctcgttaatatcacccaacttatttcgagttcaaaaattcactatcaaagactatttcttccgacatcatctagagaccaccgtagaaaataacaatactctcaaaaacacaacttggcgaagggagggattaagtgggatatacggcataatcaagattagactaaaccatcttggagaaatagtacaagtaggagaatattga

SEQ ID NO: 5601 - RNA, 4194 nt, synthetic construct
  misc_feature 1..4194: note = Cas9 variant
  source 1..4194: mol_type = other RNA
atgaatgaaaacaaagaatggttcttagggctagatataggaactgcatcagtcggatgggcagcgacagacacaaactacaacctattgaaattaaaaggcaagaaatcatggggagtacgattatttgacgaagctcaaacagcaaaagaacgacgagactgtagatctaaaagacgcagactcgctcgaagaaaatggcggctgggactactcgaagaacttttcgcagaagaaataaacaaaatagatccaaacttctttatgcgactcagagaaagcaaatacaaagtgtctgacaaaacaggaaacgtgccatccatacttttcaatgagaaaaactatacagacaaagaatactaccgcaactacaaaacaatctaccatctacgagcagacctcatccacaaaaacaaccccgacattagagaattatttttagcaatacaccacatcttaaaatatagaggacattttctattcgcaggacaacaattcaaaggcagtgaaatcaaagacaacataagagaattacttcaatataattcattaaatatcaaaattgacattacagatgaactaataaacaacattgcagaaatactactgaaaaagaaaaactctacggataaaataatcgaatttaagaaactattcgcagacgaaaaacaattgatagaagccttgcgtttagctctgggtaacaaaacacaactagcaaaactattcgacatagaagcatacaaagaacttgatatatcaataaaaacaatttcattcaaagagaaaatatatgaagacgtccgatccaactatgaagaaattctcggagaatacatcatagtattagatacagcaaaactaatttatgacgccatcatcctctctaaaataaaaattaaaaacatgacaataagtgaaagcaaagtagtctcatacgaaaaacacggcaaagacttaaaacagttaaaacatctcataaaagaagactgcaaactcagtaagaaagagaaacgacaactattcgaaaacatatttgtaaaagaagacgaaaaaggcgcaaactatgtgaattatataggcaaaaacaacgctggttcctcaaaaagttcatgctcatatgaagacttcaagaaattcctaaccaaagaactaaaatgttgcgaagaaagcaaattaaaacaagatatactagcagaactcgaattagaaacttttcttccacgtcaacgaacaaaagataacagtgttatactatatcaaatacacaaagaagaactcgagaaaatactaaacaacgcagttcaatatcatccgttcttaaataacacggatgaatacggtatatctataaaagagaaaatcatacaactactagaatttcgtatcccgtattacgtaggacccttaaatacctcgcataaagtaggagacggcggattttcttggagcgtacgcaacaaaggttatgaacacatagccgtcactccatggaatttcaacaaagttataaataaagaagaaagcgccaaaaatttcatagaaaacctaacgaaccaatgtacatatctactatatgaagacgtactaccaaaacactcactgctgtacagcgaatttgctcttttaaatgaactgaatagtataaactatggaggaaaacgattaacagtagaacatcgaaacctaatcatagaaagattctttaaacagtcagcaccaaaagcaacagggaaagaattgaagaaattcctaatgtctgaaggagtcattgatggaaaagacgaattatcaggatttgacgtctcaatcaaaaacgatctaaaatcgtatcgagattttaagaaaatcctcggagacaaattcgactccgaaaaagtagagaaaatgataagatggatcacactattcggcgaaagcaaacaactacttgtagacaaaatcactaaagaatacggagacatatattctctcgaagaaatcaagaaaattagcggactcacatataaggattggggacgacttagcgaaaagttattgacagaaattgtaagttcacaactctacgacgaatcgacaggagaatgcttcaacatcataaacgcaatgagaaacaacaccctactcttcatggaactgttaggcacaaactatgactatttcgagaaaataaatatttataacagaagactaagaaaagaaataactgaaatcactccacacattttagatgatttatacgtatcaccagccgtcaaaaggagtatatggcaagtagtccgtattgtcgaagaactaaagaaaattatcggatcagaacccaaaagaatttttgtcgaaactacccgctcaaacaaagagaaaaagggtgatgatggaagaaaagactcacgtaagaaagcattactcgaattatataagaaaatcaaaacatcagatattgtagaattagaaaaagcgctaggacatactgtagatttcgacaagaagaaacaagacctaacagacatagataacaacaaactaaaagctagaaaactatacctctactatacacaattaggaagatgtttatacacaggcaaagctatagacctaaataatctgctctcaagtaattcagaatacgatgtagaccatatatacccccaaagcaaaactaaagatgggtcatggaataacttggtactggtaaacaaaacagaaaacagcaagaaatcaaatggacttatatcagaatccatccaaaggaaaaataaacatttttggagattcctaaaagccaaaaacctaatctctgaagaaaaatataaacgtttaacacgaacggaagattttacggacgacgaactatccggatttatagcaagacaactcatagaaacatcacaatcggtaaaggcagtaagccaaatacttcaaaatcttaatccaacaacagagatctgcttctcaaaagcagaaaacgtacacgactttcgacaagagttcggaaaaataaaagtgggaaaaagaagaaacttaacggaagaacaacaaaaagaggccaaagaaggacaattgataaaggtaagagaccttaatgacttacatcacgcaaaagatgcctacctaaacattgtcgtcggaaacgtctaccacatcaaatttacaaggaatccgaaaaactttataaggaaaaatagtaagaatagagaatacacattaaacactttattctactcagataaaatagaaaggaacggagaagtcgcctgggaaaaaggtaaaactgagaaaatcgtatcttccgtaatgtgcaacaacttgattaacgtaacaagaagaacaagcgaacaaaaaggcgcactatatgatgcaaccatatacaaagcaaacgcagccaaagaaggaagttattatcccgtaaaaaccaaaaataaaaacttaaaagatgtaactcgatatggcggctttacatcaatcaaaatagcatattactcaattttcaaatatgacatacgaaataaagacaaagttaaagaaaacataaagataatcccaatcccaatctacatttcacagaacattaaaacggacttagatttgatcaactttgcagaaaaacaaattaaactaaagaaaggggaaaacatagaaaaccttcaactaatatacaagaaattaaatataggagctcttgttaaaattgattattacccgtattacgtaggaggaaaaactaatgacaacttctacatagacggagcagtccaagtacttctatcatccgacatcgagcgctatctaaaagaagtggtgaaatttgtaaactttcaacgagaaaataaagaagccaaagtatcaaaagaacacataagttccgaagaaaatatcgaactatacaacaccctcttatgtaaaatgactgcaaaaatctttacacataccaaaaataataaatacaacgacttagctcaggataaagccaaaaacacgttcaaaaatttatcattagaagaacagtgcaaagtcctccttgaaatactaaacctgctaacaaataagaaaacaaccttcgacctgagcctaataaacgaaaaagcctcgcgcgtaaaatgtggatttaatctactaaaccaaaaacaatttagtattatagaacaatccgtcacgggtctatacgaaaaagagataaaaataattgaggattga

SEQ ID NO: 5602 - RNA, 4197 nt, synthetic construct
  misc_feature 1..4197: note = Cas9 variant
  source 1..4197: mol_type = other RNA
atggaaacacaagcatctaatcaattaatttcatcacatcttaaaggatatccaataaaagactatttcgtggggcttgatataggaacaagctctgtgggttgggctgtaacaaacaaagcgtatgaacttctgaagttccgctcacataaaatgtggggctcacgtctattcgacgaaggagaatcagccgttgctagaagaggctttcgatccatgaggaggagactagagagaagaaaactaagattaaaactactagaagagttattcgcggacgcaatggcacaagttgatccaacattcttcatgcgtctacgagagagcaagtatcattatgaagacaaaacaacaggacattcatctaaacatattctgttcatagataaaaactataatgatcaagactattttaaagagtatccgaccgtctaccatttaagatcagaactaatgaaatcgggcacagatgatatcagaaaattattcctggctgtccaccatatactcaagtatcgcggtaacttcctttatgaaggcgcaacattcgattcaaatgcctcaactttagacgatgtaattaaacaagcacttgaaaatatcacgttcaattgtttcgactgcaattccgcaatatcatcaataggacaaattttaatggaagccggtaaaacaaaaagtgataaggcaaaagcaattgaacatctcgtagacacatatatcgcaaccgatacagttgacacatcttcaaaaacacaaaaagaccaggtaaaagaagacaaaaaacgacttaaagcctttgccaatcttgtattaggattgaatgcatccctaattgacctctttgggtccgtagaagaacttgaagaagacctaaaaaaactacagataacaggagatacctatgacgataaacgagatgaactagcaaaagcatggagtgatgaaatctatataatagatgattgcaagtccgtatatgatgcaataatattactaagcataaaagagccgggccttacgataagcgaatcgaaagtaaaagcttttaacaaacacaaggacgatctagccatattaaagtcgctactcaaatccgatcgaagtatctacaacacaatgtttaaagtagatgaaaaaggtctacacaactatgtacattatatcaaacaaggaagaacagaagaaacttcatgtaacagagaggatttttacaaatacaccaaaaagatcgtagaaggactgagtgattctaaggacaaagaatacattctgagccaaattgaattacaaatactcttacccttacaaagaataaaagacaacggtgttataccgtatcagttgcacctagaggagctcaaagctatcctagccaaatgcggaccaaaattcccattcctcaatgaagtagcagacgggttcagtgtcgcagaaaaacttataaagatgctcgaattccgaataccgtactatgtcggacctctaaatacacatcacaatgtcgacaatggtggatttgcttgggcagtcagaaaagcctctggaagagtcaccccctggaattttgatgacaaaatcgatagggagaaaagtgctgccgcatttatcaaaaacctaaccaacaaatgtacatatctgttaggtgaagatgttctacctaaatcctccttgttatactctgaattcatgctcttaaatgaattaaataacgtacgtattgacggaaaaccattagaaaaagtagtcaaagaacatctcattgaagctgtattcaaacaagatcacaaaaaaatgacaaaaaatcgcatagaacaattcctaaaagacaacggatatatatccgaaacccataaacacgaaattacaggtctcgacggtgagataaaaaatgacttagcatcatatcgagacatggtacgtattctaggagacggattcgacagatcaatggctgaagaaataataaccgacataacaatatttggcgaatctaaaaagatgcttagagaaacccttagaaaaaaattcgccagttgcctcgacgatgaagccataaagaaactaacgaaactcaggtatagagactggggacgcctatcgcaaaaattattgaatggaatagaaggatgtgacaaagctggggacggaactcccgaaacaataataatactcatgcgaaacttcagctacaatctaatggagttattgggcgataaattttccttcatggaaagaatacaagaaatcaacgcgaaactaactgaaggacagatagttaatccccacgatataatagacgatctagcactatcacctgcagtaaaaagagcagtatggcaagccctacgaatagtagatgaagtagcacacataaaaaaagcactaccagcacgcatattcgtagaagtaacgcgatccaacaagaacgaaaaaaaaaaaaaagactctagacagaaacgcttaagtgacctatatgccgcaattaagaaagatgacgtattactaaacggactaaataacgaaatttttggagaattaaaaagctcactcgcaaaatacgatgatgcagctttgagatcaaaaaaattatacttatattatacacaaatgggacgatgcgcatacacgggcgaaatcatagaactatcattattaaacacggacaactatgacatagatcacatataccctcgatcactcacaaaggatgactcatttgacaacttggtactatgcaaaagaacagcaaacgcacaaaaatcagatgcataccctataagtgaagaaattcagaaaactcaaaaaccattctggacatttctcaaacagcaaggcctaatttccgaaagaaaatacgaaagactaacacgcataacaccattgaccgcagatgatctatcaggatttatagccagacaattagttgagacaaaccagtcagtaaaagcagccactacccttctcagaaggctttatccaggtgttgatgtagtatttgttaaagctgagaacgttacagatttccgccatgacaataactttataaaagtacgttccctaaatcatcaccaccatgccaaagacgcatacttaaatatcgtcgtaggcaacgtttaccacgaacgatttacccgaaacttcagagcattttttaaaaaaaatggagcgaatagaacttataacctcgctaaaatgtttaactacgatgtcaactgtacaaacgcaaaagacggaaaagcctgggatgtcaaaacctcaatggataccgttaaaaaaatgatggattctaatgacgtaagagttacaaaaagattattagaacaaaccggagctctagcagacgcaaccatatacaaagcaacagtggctggaaaggcaaaagacggagcctacataggaatgaagaccaaaagctccgtcttcgccgacgtatcaaaatacggaggaatgacaaaaataaaaaatgcatattccattatcgtgcaatacactggaaaaaaaggcgaagtgataaaagaaatagtacctttacctatatatctaacaaatagaaatacgacagaccaggacctcataaactacgtagcaagtattataccacaagccaaagacataagcatcatctacggaaagctatgtataaaccaactagtgaaagtcaatggattctattattacctaggaggaaaaacaaacagtaaattttgcatagataacgcaatccaagtaatcgtatcaaatgaatggataccctacctaaaagtactagaaaagttcaataatatgcgtaaagacaataaggacttaaaagcaaacgtcgtaagcacacgcgccctagacaataaacataccatagaagtgagaatagttgaagaaaaaaacatagaattttttgactatttagtaagtaaacttaaaatgccaatataccagaaaatgaaaggaaataaagcagcagaattaagtgaaaaaggatatggactattcaaaaaaatgtcactagaggagcagtctatacacctaattgagctacttaatctactaacgaaccaaaaaacaacctttgaggttaaaccgctaggaataacagcatcaaggagtactgtcggttcgaaaatcagcaaccaagatgaatttaaagtaattaatgaatcgataacaggactatactcaaacgaagtaacaatagtctga

SEQ ID NO: 5603 - RNA, 4197 nt, synthetic construct
  misc_feature 1..4197: note = Cas9 variant
  source 1..4197: mol_type = other RNA
atggaaaaatcatactccattggattggacattggaaccaactccgtaggatggtcagtaataactgacgattacaaagtgcctgcaaagaaaatgcgagtattgggaaacacagacaagaaatatatcaagaaaaacttattaggagcattactcttcgattccggagaaactgcagaagccaccagattaaaaagaaccgcaagaagaagatataccagaaggaaaaaccggcttagatatttacaagaaatattcgctaaagagatggcaaaggtagatgaaagtttcttccaaagactagacgaatctttcctaacagacgacgataaaaccttcgactcacatccaatatttggtaataaagccgaggaagacgcataccaccagaaatttcccacaatttatcaccttcgaaaacatcttgcagactctcaagaaaaagcagatctccgactaatatatctagcattagcacacatgatcaaatttcgaggacatttcctctacgataatttcaatgatgacaatttcgactggagaaatatagatatacagaaaagatatgaagagttcatagaaacctacgactcgactctcggagaatcttacctcgccgatatatccgtggacgccgctagcatattggaagaaaaggtaagcaagaccgagcgtttagagaatttactaaaatactacccaactgagaagaaaaccaccttctttggtaacctaattaaactaatccttggccaacaagccaaatttaaagcaatattcaatctagaagacgaaatatcattacaattcgccactccaacatacgacgaagatctcgaagaactacttggaaagatagataacggagacagctattcagaattattcgttgcagcacaaaatctatataatacaatacttcttgcatcattcttaaaaaccgacaacaaaagtgcaaaagctccattgtcaacaagtatgattgaacgatatgaaaatcataagaaagatctagcaaaactaaaagatttcgtcaagaaaaactgtccggaccaatatcacgatatatttcgagataaaagtaaaaatggatatgcaggatacatagacaatggagtatcacaaaacgatttctacacatttatcggtaaatgcctagaagaatcattgaagaaagataaaggcgcacaatacttcttagataaaatcgatagagacgactttcttcgtaaacaaaggacgttcgataacggagcattcccataccagatacatttacaagaaatgcacgcaatacttcgaagacaaggagactattatccattcctgaaagaaaatcaagataaaatagaaaagattcttaccttccgtataccatattatgttggcccccttgcgcgaaaagacagccgatttgcatgggctaattatagaagtgatgaagcaataactccttggaactttgatgaagtagtcgacaaagaaaaatcagcagaaaaatttataacacgcatgacattgaacgatttatacctaccagaagaaaaagtactaccaaaacacagtctcatctatgaaacatttacagtatacaacgaacttaccaacatcaaatacgttaatgaccaaggtaatgctatacacttcgactcagaacttaaagagaaaatatttaaccaattattcaaagaaaacaggaaagtcagtaagaaaacactcatcgacttcttaaataattctgaaggaatatataccgataaattagtaggtatagatgaagaagtcaaatacctaaatgccagcttaggaacatatcacgatctcaagaaaatccttgaatcctttatggacgacgaaataaacgagaaaattattgaagatataattcaaacattaacattatttgaagatatcgaaatgaaaagacaacggctacaaaaatatgatgacatattcaccccaaaacaactgaaagaactcgcgcgacgcaactacacaggatggggacgtctaagctacaaattaataaatggcatccgaaataaagaaaataataaaacaatactagattacctcaaaaacggtaatcgaaatttcatgcaattaataaatgatgatagactatcatttaaacaaatcatcatagacgcaagaaaaatagaaaaactagacaatattgaaagcgtagtttataacttacccggatctccagcgataaagaaaggaatattacaatcaataaaaatagtcgatgaattagttaaagtaatgggacacaatccggacaacatcgtaatcgaaatggcgcgcgaaaatcaaacaacaaaccaaggcaaaaatcgaagccaacaaaggttaaaacgacttcaagacagcatgagtaactttaaagattcgtcaatcagcctaaaagatgtagacaattcagacctacaaaacgaccgcctatttctctactacatacaaaatggtaaagatatgtacacaggggaagaactcgatatagaccacctaagcgactacgacattgaccatataataccacaatcctttataaaagacaacagtatagacaatcgtgtacttacaagcagcgccaaaaatcgtggcaaatcagatgatgtacccggaagagacgtagtgctaaaaatgaaaccattttggaagaaattatatgacgttaaattaatctcaaaacgcaaattcgacaacttaacaaaaagtgaacacggcggtctaacagaatcagataaagcgggcttcataaaacgtcaacttgtcgaaacacgtcaaattacaaaatatgtcgctcaaatactggacggtagatttaatactaagagagacgacaataataaagttattcgagatgtaaaagtaatcaccttaaaatcgagcctagtttcacaattcagaaaggatttcggattctataaagtaagagaaataaacgactatcatcacgcgcacgacgcttatcttaatgcagtagttggtacagcgatactaaagaaatatcctaaacttgcaccagaatttgtatacggagaatataagaaatgtgacgtacgaaagctaattgcaaaatccggagataaatccgaaattggtaaagcgacagcaaaatatttcttttattctaacctcatgaatttcttcaaacgagtcataaggtacagtaacggaatgatcgtggttagaccagtaatagaatatagtaaagatacaggagaaatcgcatgggataaagaaaaagacttcaaaactgtctgtaaagtattgtcatgcccacaagtaaacatagttaagaaagttgaaaaacaaagccacggactagatcgaggaaaaccaaaaggattctataacgcaaacccaagcccaaaacccaagaaaggatccaaagttaatttagtcccaataaaagccaaccttaatcccaaaaactatggaggctacgcaggtatttcaaactcctatgctgtcctagtggacgcaaccatagaaaaaggtgcgaagaagaaactaacacgaatacaagaatttcaaggaatctcaatcatagaccgagaaaaatacgagaaaaacaaagtcgaatttttaaaaggcttgggatataaagagatatactcaatcataacactaccaaaatattcgcttttcgaattggccgacggatccagaagaatgctcgccagtatattatcaaccaacaacaaaagaggagaaatccataaagggaacgaattagtcctgccggcgaaatacatccccctactatatcatgctaatagaatacacaatacctttgaaacaggacaccgagaatatgtcgaaaaacatatagcagagttcaaggaaatagccgaaataatactagagttcaacaataagtatgtaaacgccaaaaagaactcatcaataatagaaaaagcactcgagtctttcgactcattttcactcgatgagatatgcgacagcttcgtaggaaaactaaagaaaaataacaccaagaaaaactcgggattattcgaattagtatcacttggatcagccagtgacttcgagttcttggaaacaaaagtccctcgatatagagactacacaccatcatctttactaaatgccaccctcatacatcaatcaatcacaggattatatgaaacgagaattgatctatcaaaactcggagaagaatga

SEQ ID NO: 5604 - RNA, 4197 nt, synthetic construct
  misc_feature 1..4197: note = Cas9 variant
  source 1..4197: mol_type = other RNA
atggaaacgcaagcatccaaccaattaataagttcccatctgaaagggtacccaataaaagattacttcgtgggactcgatataggaacttcatccgtaggatgggccgtcactaataaagcatatgaactcttaaaatttagaagccataaaatgtggggaagtaggctattcgacgaaggagaaagcgccgtcgcaagacgcgggtttagaagcatgaggagacgcctggaacgacgcaaactaagattgaaactactcgaagaactattcgcagatgcaatggcacaagtggatccgaccttctttatgagattacgagagtcgaaatatcattacgaagacaaaacaactggacactcatcaaaacacatcctatttattgacaaaaactacacagaccaagattactataaagcgtacccaaccatctatcatttaagggctgagttaatgaaagacggcacctacgacataagaaaattatttctggccgtacaccatatcttaaaatacagaggaaattttctttatgaaggtgcttcatttgattccaatgcttctacattagatgatgtcctgaaacaggcactagaaaatataacattcaactgttttgatagctcagcggccataggctctataggacaaatactcatggaaacaggtaaaaccaaatctgataaagcaaagacaatagagcgtctagttgacacatatataataacagacgaagttaacgcttcaggaaaaacacagaaagaccaagtcaaagaagataagaaaagactaaaggccttcgctaacctagtacttggactcaatgcctcactaatcgatctctttggatcagtagaagaactcgaagaagatcttaagaaactacaaatcacgggtgatacatatgacgataagagagacgaactagccaaagcatggtcagacgaaatttatataatagatgattgcaaatcggtttatgatgctataatactgctatcaataaaagaacccggactaacaatatctgaatcaaaagttaaggcattcaacaaacacaaggatgatcttgccatcctaaaatcgctcctaaaaagcgaccgtagcatatataatgcaatgtttaaagtagatgaaaagggcttacataattatgttcactatattaaacaaggccggactgaagaaacaagttgcaatcgcgaagacttttataaatacacaaagaaagtagtggaaggattacctgattctaaagacaaagaatatatcctctcagaaatagaactacaaacacttttaccccttcaaagaataaaggacaatggggttataccataccaacttcacctagaagaactgaaagttatactagctaagtgtggaccaaaattcccattcttaaacgaagtagccgatggtttctcagtcgctgagaaattaattaaaatgttagagttcagaataccgtactatgtcggaccactaaacacttcacacaacgtggacaacggaggtttcgcgtgggctgtccgtaaagcaagtggacgagtgaccccttggaactttgacgacaaaatagatcgtgaaaaatcagctgcagcgttcattaaaaatttgaccaataaatgcacgtatctattaggagaagatgtcttgcctaaatcctcattactatattcagaatttatgttattaaacgaattaaataacgttcgcatagatggcaaaccactagaaaccaaggtaaaagcccatttaattaaagctgtattcaagcaagaccataagaaaatgaccaaaaatagaatagaacaatttttaaaagacaataactacataccagaaaaacataaacctgaaataacaggtctagatggagaaatcaaaaacgatttagctagttatcgtgatatggtgcgcatactcggaaacaactttgacttaagtatggcagaagaaatcataactgatataacaattttcggagaaagcaaaaagatgcttagagaaactttaaggaagaaatttgcaagttgcctagatgacgaagctataaagaaactatcgaaactacgatatcgagactggggtcgactatcgaagaaactcctaaatggaatcgacggatgtgataaagcaggagatggaacttcagtgacaattatcgaagcaatgagagatttcagttataatctaatggaattactaggagaccgtttcctatttatggaaagaatacaagagatcaatgacaaactaacggaaggccaaatagtaaacccacatgacataatcgacgacttagcactaagccccgcagtaaaacgcgcagtctggcaagcactaagaatcgtcgacgaaattgtacatataaagaaagccttacctgcaagaatattcgtagaggtaaccagaagcaataaagccgagaaaaagaagaaagattcccgacagaaacgattatccgatttgtacgcagcaataaagaaagacgatgcattattgagcggactaaccaatgaagaatttggagggctcaaatcagaactagcaaaatacgacgacgcagcacttagaagcaagaaactttatctgtattacacacaaatgggaagatgcgcttacaccggcgaagtaattgatctatcacaattaaacacagacaactatgatattgaccatatttacccaagaagtctcactaaagatgacagcttcgataatctagtactctgtaaacgaaccgccaatgcccaaaaatcagacacatatccaatatcgaaagagatacaaaaagcacaaaaagcattttggattttcctaaaacaacaaggactaattagtgaacggaaatatgaacgtttaaccagaataacgccattaaccgctgacgacttatcaggattcattgctagacaattagtagaaacaaaccaaagtgtaaaagcagcgacaacactcctaagaagactctatccagatatcgatgtagtattcgtaaaagcagaaaacgtaacggattttagacatgataacaatttcataaaagtacgttcattaaaccaccaccaccacgcaaaagatgcttatctaaatatagtcgtgggaaatgtatatcacgaaaaatttaccagaaacttcagggcatttttcaagaaaaatggtgcaaacagaacatataaccttgcaaaaatgtttaactatgatgtaaaatgtacaaacgcaaaagacggaaaagcatgggacgttaaaacgtcaatggacacagtcaacaaaatgatgacaagtaacgacgtaagagtaactaaaagattactcgaacaatcaggggccctagcggacgcaacagtatataaagcaacagttgcagcaaaagcaaaagacggtgcttacatcggtatgaaaacaaaatcctcagtcttcgctgatgtcacgaaatatggaggaatgacaaaaatcaaaaacgcatattcaataatagtgcaatacataggcaagaaaggagaagttgtcaaagaaatagtgcctttaccaatatacctaaccaatcgtaacataacggaccaagacttaattgattacgtcgcaagtataacaccacaggcaaaagatatctcgataatttatcgaaaactctgtataaatcagctagtaaaagtaaatggattttactactatctcggaggaaaaacaaactctaacatttatatagataatgccgtagaagtagttgtgccagcaaacattgcagtatacatcaaagtactagaaaaatttgcacttctacataaagataacaacaacataaaggcttcaacagtaacaacacgtatatataatgaaggcagtacaaatatagtaagtatcacagataaagatggcctaattgtatatgattatttaatgagtaaattaagaacacctctatacatgaaaatgaaaggaaataaagtagacgagctatctacggtaggaagatcaaaatttatgaatatgacattagaagaacaatccatatacctactcgaagtattaaacttactcactaacagcaaaacaacatttgacgtaaaggctttaggaatcacagcatcacgaagcacaatcggcgtaaaaattcatactctcgatgagtttaaaataataaaccaaagcataaccgggttatacagcaacgagataacaatcgtatga

SEQ ID NO: 5605 - RNA, 4197 nt, synthetic construct
  misc_feature 1..4197: note = Cas9 variant
  source 1..4197: mol_type = other RNA
atggaaacacaaacaagtaatcaactaataacaagtcacctaaaagattatcccaaacaagactattttgtgggattagacataggaacaaacagcgttggctgggctgtaacaaacacatcatatgagttactgaaatttcactcccacaaaatgtggggaagtagattatttgaagaaggagaaagtgcagtaacacgaagaggattcagatctatgcgaagaagactagaaagaagaaaattacgtctcaaattattagaagaacttttcgccgacgcgatggcacaagtagactcaaccttctttataaggctccatgaatcaaaatatcattacgaagataaaactacagggcacagctcaaaacacattctttttatagacgaagactatacagaccaagactacttcactgaatacccaacaatataccacttacgaaaagatcttatggagaatgggactgatgatatacgaaaattattcttggcagtacaccacatacttaaatacagaggcaattttctatatgaaggtgcaacgttcaattcaaatgcattcaccttcgaagacgttctaaaacaagccctagtgaacattacattcaattgttttgatacaaatagcgcaataagcagtatttcaaacattctcatggaatctggaaaaaccaaaagcgacaaagcaaaagcaatagagagattagtggacacatacacagttttcgatgaggtcaacacaccggacaaaccacaaaaagaacaagtaaaagaagacaaaaagacacttaaagcattcgcaaatttagtcttaggattgtccgcaaatttaatagacctgttcggttctgtcgaggatatagacgacgatctaaagaaactacaaatagtaggcgacacatacgacgagaaaagagacgaattagcaaaagtttggggagacgaaatacacatcatagatgactgcaaaagtgtatatgatgccataattcttatgagcataaaagaacccggactaaccatcagtcaaagtaaagttaaggcttttgataaacataaagaagacctagtaatccttaaatcactgctgaaactagaccgaaatgtatacaatgaaatgtttaaaagcgacaagaaaggactacacaactacgtccattacataaaacaaggccgaacagaagaaacctcttgctcaagagaagacttctacaaatataccaagaaaatagtcgagggactagccgacagcaaagacaaagagtatatactcaatgagatagaattacagacgctattacccctccaaagaataaaagataatggagtaataccttaccagttacatctagaggaactgaaagtaatactagataaatgcggaccgaaattcccattccttcataccgtatccgatggcttctcagttacggaaaaactaattaaaatgctagagttcagaataccatattatgtaggacccctaaacacacaccacaacatcgacaacgggggattctcatgggcagttagaaaacaagctggaagagtaacaccatggaactttgaagagaaaatagatagggaaaaatccgctgctgcattcatcaaaaacctcactaacaaatgcacatacctattcggtgaagatgtactacctaaaagtagcctcctatattcagaatttatgctactgaatgaactaaacaacgtaagaatagacggaaaagcactagcacaaggagtaaaacaacatttaatagacagcatatttaaacaagaccacaagaaaatgacaaagaataggatagaactcttcttaaaagacaacaactatatcactaagaaacacaaaccggaaatcacaggtctcgatggtgaaatcaaaaatgacctaaccagctatagagacatggtaaggatattaggaaataatttcgatgtctcaatggcagaagacattataactgatatcacaatattcggtgaatcaaagaaaatgctaagacaaaccctaagaaataaatttggctcacaattgaacgatgaaacaataaagaaacttagtaaactaagatacagagactgggggagattaagcaagaaattactgaaaggaatagacggctgcgacaaagcagggaatggagcacccaaaactataatagaactaatgcgaaatgacagttataacctgatggaaatcctaggagacaaatttagctttatggaatgcatagaagaagaaaatgcaaaactagcacaaggccaagtcgtaaatccacatgacataattgatgaacttgccctaagccccgcagtaaaacgagcagtatggcaggcactacgtatagtagatgaagtagcgcacattaagaaagcactaccttcaagaatatttgttgaagtcgcacgaacaaataaatccgagaaaaagaagaaagactccaggcagaaaaggctaagtgacttatacagtgcaataaagaaagacgatgttttacaatctggtttacaagataaagaatttggtgcattaaaaagcgggctagctaattacgacgatgcagcactacgcagcaagaaactatatttatattacacgcaaatgggtaggtgcgcatatacaggcaatattatcgatctcaatcaattaaatacagacaactatgacatcgatcatatatacccaagatcactcacgaaagacgatagtttcgacaacttagtactatgcgaaagaacagccaacgctaagaaatccgacatatatccaatcgataacagaatacaaacaaaacaaaaaccattttgggcgtttctaaaacaccaaggcctaattagcgaaagaaaatacgaacgcctaacccgtatcgcaccactcacagcagacgatctctcaggctttatagcaagacaacttgtcgaaactaatcaaagtgtaaaagccacgactacacttctcagaagattatacccagacatagacgtagtcttcgtcaaagcagaaaatgtatcagatttccggcataacaacaatttcataaaagtaagatcattgaaccaccaccatcatgcaaaagatgcatacctaaacatagtagtaggcaatgtctatcacgaaaaatttacacgaaattttagactattcttcaagaaaaacggagcaaaccgtacatacaatctggcaaaaatgtttaattatgatgtaatctgcacaaatgcacaagacggtaaagcatgggacgtaaaaaccagcatgaacacagtaaagaaaatgatggcttctaacgacgtaagagtaacaaggaggctactagaacaaagcggtgctttagcagacgccaccatctacaaagcatccgtagctgcaaaagccaaagatggagcatacatcggtatgaaaacaaaatactctgtatttgcagatgttacaaagtacggaggcatgacgaaaattaaaaatgcctattcaataatagtacaatacacaggcaaaaagggtgaagaaataaaagaaatagtcccattaccaatttacttaatcaatagaaatgccacagatatagaattaatagactatgttaaaagcgtcattccaaaagccaaggacatttcaattaaatatcgaaaactttgcataaatcaactcgtaaaagtaaatggtttttactactatcttggaggcaaaactaatgataagatctacatagataacgcaattgaattagttgtaccacatgatatagcaacatatataaaactacttgataaatacgatctactaagaaaagaaaacaaaactctaaaagcatcaagtataacaacaagtatatacaatatcaatacttccacggttgtatcattatcaaataaagtaggaatagacgtcttcgattacttcatgagcaaactaaggactccactatatatgaaaatgaagggtaacaaagtagacgagctatcatcaacaggacgatccaaatttataaaaatgactttagaggaacaaagtatatacctattggaagtattgaaccttttgacaaatagtaaaaccacattcgacgtaaaaccactaggtataacaggatcacgaagtactattggcgtaaaaatccacaacttagacgaatttaaaataataaacgaaagcattacaggtctatatagcaacgaagtcacaatagtatga

SEQ ID NO: 5606 - RNA, 4200 nt, synthetic construct
  misc_feature 1..4200: note = Cas9 variant
  source 1..4200: mol_type = other RNA
atgaaaacaatcttaggactggacctaggtacaacaagtataggatgggctttggtaaaagaagcggaacctttttcagacgaaaaatccgaaatcgtaagactaggagtcagagtaataccattaacagtagatgaaagaacgagttttgaaaatggcaagtcaataactacaaacgcactaagaacacagaaaaggggtatgcgcagaaacctgcaacgatataagctaagaaggcaagccctaatagaagaattaaaaagtacaggttggataggcaatgattttatattttcagaaaccggcccaggatccacatttcgtacattaagactaagggcaaaatcagcctcagaagaagtgactctgggtgacttggcacgaatccttctacaaataaacaagaaacgtggatacaaatcatcgcgaaaaatggtgagcagcgatgacggccaagccatagatggaatggcagttgcgaaagaaatgtacgataagggacttacaccaggagaatatgtctaccaaagaatgctggaaggaaaatacgcaattccggagttctacaaaagtgatttgcaagaagaatttgatagaatctgggctttacaaaagagctttcacatagaactaacagacgaactctaccgaaaactttctgacagaaacaaatcccaaacttgggccatatgtcgtgatgaattaggaatacaagggctcaaatcaagtttcataggaaaagagagacttaaagaggcttatagataccgtcatctcgctgctactcaagaagtaaatatggaagtactaacttgtgcactacaagaaataaacgggcaaaaggcatcgctaagtggactattatctaaaataagtgataggagtaaagaattatacctaaataatctaactgtaggacaaatgctgcttaaaagaatagaagataatccaaacaattcgcttaaaaatatagtcttttatagacaagactatttggatgaatttgaaagaatatggaccgtacagagcaaatatcacacagaactaactcacgaattgaagaaaaggctacgagacataataatcttctaccaaagacccttaaaatcgcaaaaaggcctaatctcactatgtgaactagaaacaaaagatatcgaagtagctattgatggagtaaagaaaatgaaaaacataggaccaagggtatgtccacgatcatcaccattatttcaggagttcaaaatttggcaaacaataaataacatatttgtgaatggcgcagcattagacgatgaagacaaaagcgtcattgcaaaagaactaatgtttaaagacaaattaaaagattcggacctgctaaaactcttatttaaaactacaaaaggccaatcagtgaatttcaaagaggtcgatggaaacagaacaatggccacacttatgaaagcatgttttaaaattgctgaaaatttaggatatgacgacataggactatccaaactgtccagtgaggatcaaatggtaagaatagaaggaatattcaaagaacaaggatttaaaaccggattcttacacttcgatagctcattagcttcaccagaatttgaaaaccaagatagttacaggttatggcatctactgtacagctacgagggagataaaagcgcatcaggtaatgaaagtttagtaaaatgcataatggatctatgcagtatggatgaaggaagtgcgaaaatactagcttcatgtacattcctacctgactatggatccctctcagcaaaagcgatgcgcaaaatattgccctacatgaaagacggtctggaatatacagcagcctgcgcaatggcagggtatagacacagcaaacgtagcttaacaaaagaagaacttgatacaaaagaatactctgacagattatcattactacctaaaaattctttaagaaacccagtagtcgagaaaatactaaatcaaatgataaacgtagtaaattcagtaattgatgtttatggaaaacccgatgaaataagaatcgaaatggcaagggagctaaagaaatcagccaaagaaagagaagaagcccaaagagatatagctagctccacggcagaaagccaaaaagtaatagaaatattaaaaggtgaaccattctttcttcaattcccaactagaaacgacataataagatacagattatatcaagaactagctcaaaatggctttaagacactgtactcgaatacgtacatacccaaagacaagttattttccaaagagttcgatatagaacatatcataccacaagcacttatctttaatgattcattcgctaataaaacactagaaagcagacagtgcaatctagaaaaaggcaaagagacagctatggactacgtaaaatcaaaatatgatgaaacaggcgtccaaacatactgcgacagggtaaacggtttaataggtaaagggatatcgaaaacaaaagcgaaatggctacttatggaaggtaaagatataccagaagattttataaaccgagaattaagggactcccaatatattgcaaagaaagcacgtgaaatactagaaagccttgttaaatttgttgtccccacaacgggatccgtgactgcaagactacgtgaagattggcaacttgtaaatgttatgcaagaattaaattgggaaaaatatgcgagattaggtttaacaggagtcagagaagacaaagatggtagacgtataccgtttatacaggattggacaaaacgtaatgatcatagacatcatgctatggatgcattaacaattgcatttactcgaagacaatttatacaatatctaaatcaccttaattcaaaaatagatgtagtaagctgggataaaaaggaccttgatttaagagattacgacctagaagacatcaaatttggaaacttaagtgcaggagatcgctacggaatagtgaaggcattacaagataagtttctatataaagacggaaatgacaaatatagatttgttccgccaataccattggacgaatttaggcgtcaagcaaaagaacaactctctgatatcctaatatctttcaaggcgaaaaataaggtttgcactagaaatgtaaatgtaactaaaaataaaggaggagcaaatagaaaggcacaactaacacccagaggaccactacataacgaaaccatatacggatctagtttagagtatgtaacgaaggagaatgaaaagataggctctagcttcgacacagaaagaataacaacagtttgcaagaagaaatttagagatgcactagcaagaagactagaagaatttggaggggatccgaagaaagcattcacgggcaaaaacagtccagagaaaaacccaatatgggttgatgaacaccactcagaacaagtaccagcaaaagtacgcaccgtgacaatgggacagagatttacaggaagaaaaccaatagacgcaacacttaaaatagaaaaagtcattgataaacgcataagagaaatactacaagcacgtctagacgagttcgatggaaaagcagcaaaagcattttccaatctagatgaaaatccaatctggcttaataaagaaaaaggaatagccattaaaagagttaccgtctctggaccagcaaatcccgtacctgtccgattcaagagggataaagatggtaaacctattatagatgatgcaggtaaaacaataggagcggatttcgttacacctggcaacaaccatcatatcgctatctttagagactcatcaggaaaacttcaagaacatccagtatcatttcttgaagcaacaatcgctaaatcacacggattggacgttatagatagaaactataacaaagacgaaggctgggaatttctcttcacactaaaacaaaacgaatattttgtttttccgaatagtgaaacaggattcaacccacttgattatgaccttaccgacccccgaaactacgctgaaatatcacccaatttatatagagtccaatctatttccactaatgattacttctttcgacaccatctcgaaacaacatcagaaaagaataactccttgtacggtatcacatggaagcgaattagaaatgccagtgcattagaaggtttagtaaaagtaaggatagacaacctaggccgaatagttgccgtcggtgaatacgactga

SEQ ID NO: 5607 - RNA, 4200 nt, synthetic construct
  misc_feature 1..4200: note = Cas9 variant
  source 1..4200: mol_type = other RNA
atggagacccaagcgacagctcaacttatcagtggacatttaaaaggatacccaatttacgattatttcgtaggactagatataggaactaacagcgtaggttgggccgtaacaaaccggatttacgagttactaaaatttagaagccataaaatgtgggggagtagacttttcgaagaaggtcaaactgcagtcgtaagaagaggatttagatcaataagaaggagactagaaaggagaagattaaggctaaaattacttgaagcgttatttgcagacgctatggcacgcgtcgattccacattctttatacgtttaagagaaagcaaatatcactacgaagacaaaacaaccggacataaatcaaaacatatattattcattgacgacaattatactgatcaagattatttcgcagaatatccaacaatttaccatttaagagctgatcttatggaaaacggaaccagcgacatacggaaactttttctagccgtacatcatatattgaaatacagaggaaacttcttatacgaaggtgcgacgtttgacagtaattccagcttagacactgtattaaagagagcactcgaacagattgaatttcacatttttaatgcaacatctgaagacgctttacattctattcttgatatagtcaaattacaggataaaacaaaatctgataaagccaaagcgatagaaagcctagtagacacctacattacagacaaagtagaatcttcttgtactgacaaagaaaaaaaagacctattgaaggccgataaaaaaagattaagggcttttgccaatttaatattaggtctaaatgctaacttaaccgatttattcggaactatagaagaaatcgaagaagacttcgtgaaactacaaataacaggagatacctatgaagaaaaacgagatgattatgcgaaagtatggggggatacaataagaataatagatgactgtaaatcagtatatgatagcataatcctgatgtctataaaagaacccggcctaactatatcccaatcaaaagtaaaagcgtttaacaaacataaagaagatttagcaatcctaaaacgcttactcaaatcagacaaatacatatacaaaaatatgtttaaagcagatgaaaaaggacttgctaattatgtccactacataaagcagggacggaaaaacgaaacagggtgctcttgcgaagacttctataaatataccaaaaaggtagtagaatcactaccagattcttccgataaagcatacattcttaacgagatcgaactacagaagctgttacctctacaaagaataaaagataacggtgtaataccgtaccaacttcatttagaagaacttaaggcaatcttagaaaaatgcaaagacacatttccatttttaaacactgtgtcagatggatttacagtagccgaaaaactaataaaaatgttagaatttaggataccttattatgtaggtccgctcaacccatcacatagcatagacaaaggaggattcgcttgggtggaaagaaaagaacctggccaagtgacgccgtggaacttcgaagacaaaattgatagggagaaaagcgccgaagcatttatcaaaaatctaaccaataaatgcacatacttaatcggtgaagatgtcctaccaaaatcaagtttactctattctgaattcatgttattaaacgaactcaataatctgagaatcgatggtaaacctctagaacaagcggtaaaaatgcatttaattgatgcagtatttaaaaaagaacacaaaaagcaaacaaaaaacagaataattgaatttttaaaagacaacaactatatcctaggtaagcataaaccagaagttgatggtcttgatgaaagcattaaaggagatcttgcttcgtacagagatatgaaaagaatactcggtgacgatttcgacgtctcaatggcagagtcaatcatcacaagcataaccatatttggcgaatcaaagaacatgctaagggaaactctaaggaagaaattcggatcaattttatcagaggaccaaattcgctcactcgcaaaactaaggtacagagactggggaagactgagcaaaaaatttttaataggaatagacggatgtgtcaagggagaagatggtacaccaggtacaataattgatatgatgaggaatacgagccacaacttaatggaactattaggggacactttctcatttatggatgtgatcatagaagaaaacgacaaattgaccaaaggacaagtcgtagatccgcatgaaatcatagaagagctagggctatctcccgcagtcaaaagggcggtatggcaagccttacgaatagtagatgaagtaatacatataaaaaaagctttaccctcaagaatattcgtagaagtagcacgcaccaacaaagacgaaaaaaaaaaaaaagatagcagaaaaaaaagactacaagaactatacaagagcattcaaaaagaatcacccgaatggctatcagttaccagggatgaatcagataaactaatatcaaacttagacagggccgatgatagcagtttgagatcaaaaaaattatacctttactacactcaaatgggacgctgcatgtactccggacgagtcatagacctagatcaactgaacaccgataaatacgatatagaccatatttacccaagatctctaacaaaagacgactcatttgataatctcgtgttatgtgaaaggcaggaaaacgcaaaaaaatctgacaactatccaatagatccagatatccaaaacgccagaaaacccttttggactttcttaaaagaccagaatttgatatcaagccgtaaatacgaacgtcttacaagggtactaccattagaagcagatgatttaacaggcttcatcgccagacagttagtagaaacaaatcaatcagtaaaagcagtgacaacacttctaagacgactatatcccggagttgacgtagtattcgtaaaagccgaaaatgtaaccgactttaggcatgataacgatttcataaaagtaagatcactaaaccaccatcatcacgccaaggatgcatacttgaacatcgtcgttggaaatgtatatcacgaaaaatttacaagaaacttcagaaaattcttgaaaaaaaatggcgctaaaagaacatataatctagcacgtatgttcgacttcgatgtcatgagtacaaatgcaaaagatggaaaagcatgggacataaaaacatcaatgaatatagtaaaaaagatgatggcaagcaatgacgtaagagtaacaaaaagactaatggagcaaaaaggagctttgagtgatgctacagtatacaaagcttcggttgccggcaaggcaaaaggaggagcttatataggaatgaaaaccaaagactcagtattttctgacgtatccaagtacggaggtcgaacgagtatcaaaaacgcttactcaatagtcgttgaatatacagggaaaaaaaatgaaataattaaagaaatcgtaccattgcccgtatatttgataaacaggaacaaaacggatcaggaattaattcactatatcgtatctattattcctcaagccaagaacgtaagtataatatataaaaaactatgtataaatcaactcgtaaaagttaacggcttctattactatctcgggggtaaaaccaataactatttctggatagactctgcaatacaagtcgtaatagctgacgaatggataccatacctcaaggtcttagaaaaatttgacgtaatgcgaaaacaaaataaagaacttaaagtaggcacagtgtcgacttcaattcaaaaccaaggtaaaaaagtagttataaaaatattagaagagcggaatgtggaatttttttcttacctagtcggtaaacttcatagttcaatatattcaaaaatgaaaggtaataaagctggtgaactagccacaaaaagtttggaaattttcgtaaatatgtcgctcgaaaaccaatgtatatatctaatggagttactaaacttactaacaaataaaaaagcccctgacgtaaaacctttaggcattacagcgtccagaggtacaataggatccaaggtatcaaaccaagatgaatttaaaatcatcaatgaatctataaccggtttgtatagcaacgaggtaacaatagtatga

SEQ ID NO: 5608 - RNA, 4200 nt, synthetic construct
  misc_feature 1..4200: note = Cas9 variant
  source 1..4200: mol_type = other RNA
atgaacttaagaaatacaacggatgaatacaatataggactagatatgggaactaattccgtgggttgggcagtaacagacaaagccggagcaatcgcccattttaaaggcaagccgacattgggttccaggttattcgatgcagcacaaacagcagcaggggcacgtattcatagatcacagagaagacgatatgttcgaaggagatggagactagatctattacagagccttttccaagatgaagtatcaaaagttgacagcgagttcttttgcagattaagacagtcaaggttatacgttggcgaccgcgaaaaaggacatgcagattatacatggcctatttttaatgactcagatttcaatgaagtagattactataaaaggtttcccacgatatatcacctaagaaaatggctaatggaaacggatgaaaaggcggatataagactcatttatcttgcaacacataatattgtaaagcatagaggtaacttcctcagagaaaacaataaatcgcttagttcaagagatgcaaacccggctcaagccgtaaagagcttaagactcgcgctaaatgattggtgttcagaaagagattacgaatgcgcttggaaaggcgaagaagatgacggagcaattgatgaagcaattcttaacgtattagcagatggggaaaaaggacgttcggaccaggctaaagaaatcgctaaactaacaggcgtagactgcggagatgccaaacaaagcaaacaatgcaacgaagcaatagctaaagccatagtagggttaaaagtagaaatgaaaaatattttcggcgaatttcctgccgagaaaacatcgtatatttacttaagcagcgacgaagacgtagaagcggttagagaaagttgtcccgacgatagtggagaacttttccaggctttatgcaaattatatagcgcctatatacttcaagaacttctaagttacgccgacccatcaggacaaacaataagtgcaaatatggtagcaaaatataaacaatatgggagagacttacggctacttaaagaacttacaagaacatatgcaccacaaaaatatgatttattctttagaggtgaaacatatgccggttcatcagattatgttgtagatgaagcacgaggttacacaagatataacttaggcacaacaaaagcaaactacgatgatttccagaaaagcgtaaaagaactattcaaaggaacagatgctttacaagacgaaagataccaagaaatgatggtagcattcggggaacaaaaatttctaagaagactcaaaacatcggataatggatcaatctactatcaattacaccttgaagaattacatacaatattagaaaaccaaggaaaacattacccattcttactaagcgaagaagataaaatagaaagtttagtctcatttagaataccttattatgttggacctttaaccagaaagaatgcagctataggccacgatggtaaagaaagatttgcgtggtcgtcgagaaaagacggcatggaacatgctgtcataactccttggaattgggaagaaattatcgatagagacaaaagcgccgaagattttataatgcgaatgactggagattgcacttacctgcaaggggaacccgtcttaccaaaatgtagcctattatatgaagagttttgtgctcttaacgaatttaatggcgcacactggactgtagatggagatgacgaaagaagattcgatgctgcacaaagggaacgtataatgtgtgatctttttagaagaaccaggtcagtaacatacaataaagtaagcgattggttagaaagaaaatacaattttaccggcgctcgcgtaagaggtggacaaggtgagcacggtttcgagtcaaaactaggtagttatatattcttttgcaaagacgtctttaaaactgatggattagatgaagccgactatactatgatagaacaaataatactgtggtcaacactgtttgaagaccgtgatatactaaaaaggaaaatagaagaggcatacggaggagatagactaacatcagagcaaataaaagtaatatgtaagaaacgatttactggatggggacgattatctaaacgtttactcacagatataaaagttaatactgatacaggaaggaaatctataatggacgtgttaagagagggcaaccccaataatggtcagaggtcacgaaccatggtttttatggaagtactcagagatgaagatttaggatttcaaaaagccatagatggtttaaatagagattattttagggaacataataacggtttaatggacgtcaatgacttaccgggatcccccgcaattcgaagaagcataaaccaagcagtgagaattgtcgatgaaatagcatctatagcgagaaaagaaccaacaaatatcttcatagaagtaactcgagaagaagatgaccccagaaagaaaggtaaacgaactaaaagaagatacgatgcaataaaatctgcattggaaaaattcaagaaagatgatcctagtctctggaaagagttgtgtgaaaaagcacccggagatatggatgaaagattgtcattatatttcatgcaaagaggaaaatgtatgtacagcggaagacctataaaaatagaggaactacatacaggaaaatacgaagttgaccatattattccacgaagttatataaaagacgatagttttgagaacaaagtcttagtatacagagaggaaaatcaacacaaaactgatgctttattaattgacagttcaataagacaaaagatgggtggctactggcgtatgttacatgatgcaaaattagtgggcgataagaaatttagaaatctatttcgtaatcatatagatgacaaagcgatgaaaggatttgtagccagacaaatcgtagagacaagccaaatggtcaaattagtacagacattatttgaggcacgatatccaaacacacggatagtaccagtaaaagcaggaatatcacacgacttaagagaagctgcaggattagttaaatgtcgtgaggcgaatgatttccaccatgcccatgatgctttcctagcttgccgtataggattgttcattcaaaaacgtcatccgagcgtctatgacaatccaataggattagctcggataatgagggactatgcaagaatgcaagcaagagaatacaaaaagagtcattgtctagctcatacacaagggtttatagtaaattccttcttatcttctggatttgatgaagaaactggggaaatatttaaagatgattgggacgccaaagccgaagtcgaaggtatccgtagagtgctgaactgccggcaatgttttatctcgagaatgcccgtagaaggagatacccgatacggtggcaggtattggggtgaaacaatatactcaccgaagggaaaacacaaacatgaaataccattaaaacaagggctagacccgaatctatacgggggatactcagatctcttgtatagctacttcttgatctacgaagctagtgatgtgagttcaggagagcgagtcctgcgattcataggtattccgaccagtatagcggcccgtatggcaaaccaaaagcgtcttgaagaatacgtaagcagacttgcgttacaggaaaacctagagcatgttagaatggttcgaaaaattatgaagaaacaattaatcgaagtagacaattgcagattacttgtaaccgctgccgatgcagtaacaaatgccacagaactagctttttcattagacgaaatgaaaataatttctacttgtgctaaatgtataaacggtgcagatccatcagctattgataaaataggcaacgcgcaagattctttctttgataatttaaaacgcagaggtagcgatcggtgcgccctcctatttagtcaattaaaattagataaactatcgcaaaatttttacatgatctcatcagatgataaatctaaaatactaatatcaatattagaccgcataagagcaaaaagcaacagtgtagacttatcattagtcggaggggcaaaacatgctgcgcaaatgaaattcgattttaatgcaaaattgaataaccctgcatcctcattcgtcttaatagatcagtcagtaacaggtatgtttgaaagaagaacacgcataggtttatga

SEQ ID NO: 5609 - RNA, 4203 nt, synthetic construct
  misc_feature 1..4203: note = Cas9 variant
  source 1..4203: mol_type = other RNA
atgaaccttaggaacgccacaggagactactcaattggcttagatctaggaactaattctgttggctgggcggtaaccgactcaaacgggtcaatggcgcatttcaaaggaaagccaactctcggttcaagactatttgacgcagcagaaacggcagctggagccagacaacacagaggtcaaaggagacgttatgttcgcagacgatggcgattagatttattacaggggttattccaagacgaagtaaacaaggtagatagtgagttcttcattagactgagacaaagcaggctacatgttgaagacagagcagaaggacacgcaggatacagatggccattgttcaatgacactgacttcaccgaaaaagattactacaagagatttcctacaatataccatctgcgaaaatggttaatggaaacagacgagaaagccgatatcaggcttatatacttagcagctcacaatattgttaaacacagaggaaactttctcagagaagacaataaaaacctcagttcccacaatgctaatccagcagaagcggtgaggtcattaagacaagcccttgatgattggtgtgccgaaaggggatatgtatgcgcatggacatccgtagatgacctagcagaggcggattcacacatactcgacatattaacaaattctaaagaaagacgtgcagaccaagcgaaagaactcgctaaactcttcggtgtagattgtggagatactaagcaaagtaaatcctgtaatagcgcactagcaaaagcagtagtcggtcttaaaacagaattaaaagacgtttttggagaattttgtgcagagaaaacagctatacacttatcatctgacgatgatgtagaagctatcagggacgcaataccggatgattcaggagaactattccaagtattgtgcgcggtatattccgcttatgtactacaagagttactaagttatgctccaggacaaactatctccgctaatatggtagcaaagtatgatcaatatgggaaagacttgaaattattgaaaaatctagcaagaacatatgtctcacgcgaaaattatgacgcattctttcgaggacaaacttatgaagatagtaatgattataatgtagataaagcccaagggtacacacgatataacctaggaaccacgaaagcatcatatgatgacttcaagaaaagcgttgaaaagctatttaaaggcacacaagctgaacaagataagcgttatcaaggaatgatgaaacgcttcgctgaagaaaaatttctaaggaggttgaaaacaagcgacaatggtagtatatattatcaattacaccttgaagaattgagagccatcctaaagaaccagggcaaacatcatcccttcctattagaagaagaaaagaaaattgaaagtttagtttcctttagaataccctattacgttggaccactttcaagtaaaaacgcgtcacttgaccacaaaggaaaacaaagatttgcttggtctgaaagaagacccggtatgaaagacacagtaataacaccatggaattgggaccaaatcattgattgcgaccaaagcgcagaaaaattcatactaagaatgacaggagactgtacttatttacaaggtgaaccggtattaccgaaatgcagtctactgtatgaagaatattgcgtattaaacgagctaaatggtgctagatggacaattgatggggatgactggagaagattcgatgtagcacagagagaaggcatattgcatgatctatttcgtaaaactagatccgtggcatacaataaagttgctgactggcttgaaagagaagaaaattgggcgaatgctcatgttagaggtggacaaggcgaaaattcttttgaatcgaagttgggatcatacatatttttctgcaaagatgtatttaaaacagcggcactagatgaagcagattacccaatgattgaacaaataatattatggaacaccttattcgaagaccgagcaatattgaaaagaaaaatagaacaggcatacggagaacaccatggagggaaactaactgatgaacagatcaaagtcatatgtaagaaaagattcacagggtggggacgattaagtagaaaattgctaacaggaataaaggtggatgccgatacaggaagagtaagtatcatggacgttttgcgagaaggaaaccccaatgaaggtcaacggtctcgaaccatggtgctaatggaagtgctaagagacgaagacttaggttttcagaaaaagatagatgactttaacaaagcatattttgccggacaaggtgaaggtctaatgagtgtaaatgacttaccaggtagtccagcaatacgccgatctataaatcaagcaatcagaatcgttgacgaaatagcgagcatagcaggaaaggctcctagtaacgttttcatagaggtaacccgggaagaagatgatccgcgcaagaaagggagaagaacaaatagacgttatgaagatattaaaaatgctttagaaaattttaaaacagaagatcaagaattatggtcagaattattagggaaagctcccaatgatcttgacgaaagactatcgctatacttcatgcaaaggggtaagtgtatgtattctggtagacctataaagttggaagaattacatacaggaaaatatgaagtagaccacataattccaagaagttacattaaggacgatagttttgaaaataaagtattagtgtgtagagaagaaaatcaacgcaaaacaaatgaaatgcttatagaccctgcaataagacgaagaatgggagattattggaggatgttacataaagcaaaattaataggagataagaaatttaataatctttttatgcgggaccgaattgatgataaaacattaaaagggttcgtggcaagacaattagtagagacatcccaatcggtgaaactggtacaaacacttttagaagtacgatacccaaataccaaaatcgtacctgttaaagcaaatattagccatgatcttagagaagcagccgacttagtcaaatgtagagaagcaaacgatttccatcatgcacatgatgcctatttagcctgtagggtaggtttatttattcaaaaacggcatcctagcgtgtatgcaaatcccataggactatcaagagtaatgagagactacgcaagaaaacaagctggcgaatttaataaaactcatagtatggcacatactaaaggattcattgtcaacagttttatgacgagcgagttcgataaagaaacaggtgaaatattctgggatgcagaagcagcggttgaagatatacgcagagtactcaattatcgacaatgcttcatctcaagaatgccagtcgaagacacaggcgctttttgggatcagactatatactcccctagatctaacaagcgattagaattacccttaaaagacgacttagacccgaataaatacggtagctacagcagagaacaatttgcgtatttcttcatatacgaagcaagagatgcgaagaaatctaaaacagtattaagattcgcgcaagtaccagtaagagtgacatcagctatcgcaagagattcaagcaagctagacgaatatgcatcaggtctagccgtacaagaaggattagagttcacaaaaatcataaggcgaagaattttaaagaaacaacttttagaattaaatggggacagattagtaataacaggtgcaaaggaagtccgaaacgcgaccgaatttgcatttactctagaagaaactgcacttgtagctatgtgttcagagattgctagagaaggagttccatctgaaattgcttctgacgtacaaagtatatccagccaactatcagacctatttctagcactaatagaaagagggctaacaataggagtaagacttcatggtcagctcaaactaggccagtatttacgacaattcgaagatgcagcacttagagacaaggcaaaagtaatcataggaataataagtataaccaatggcgcaactaatacattagatctaagcagcctaaatggtagtaaaaatgttggacaagtaagaataacccataataaacttttaaacgataagagtacaagttacgtcttaatagatcagagtgttaccggtatgtttgaacgacgaacaaggattggcttatga

SEQ ID NO: 5610 - RNA, 4203 nt, synthetic construct
  misc_feature 1..4203: note = Cas9 variant
  source 1..4203: mol_type = other RNA
atgaaaacaatcaccgaagattacatactaggtttagatataggaacaaattcatgcggttgggccgtaatggacaaaaaaaaccgtttattaagattacgagggaaaagagcaatcggcagccatctctttgaagaaggacatagcgcagctgaccgacgatcttttagaacaacgcgacgaagactaaaacgacgcaaatggcggctgagacttctcgaagaatttttcgctgaaccaatggccaaagtcgaccccgcattctttgtaagacttcatcaatcctgggtgtccccactagacaaagacaggaaaaaatatcatgcgatcgtattcccgacagcaaaagaagaccatgaattctaccatgactaccctacaatatatcatcttcgagacgcattaatgagagaggatagacaattcgacttaagagaaatattcctagccattcatcatatagtgaaatacagaggaaactttttacaggatacaccagtaaattcattcgtagcctcgaaaatagacgtagctagctttctaaccaacgtaaaccaagcatacgcggataaatacggggaagagcagaattttatagaactaaacgaaaacaacgcagcagctatagaagcggtaataagaggaaaagacaaagacaaaactaccaaacaacttgataaagcaaaaaaaatcacaaaactactacaatcttcaacaaacaaatatgaaaaaaacgttacaaggcaaattgctaatgcaataattggttacaagactcagtttgaaaccatcttaggaaaagatatagacaaaaacgataaagcggattgggaattcaaactcagtgatggagacgccgacgataaactagaaaatttgctgccagaatttgacgacaacgaccaatacatcgtcgccgaaataaaaaaactattcggttcaattgcgctatcgcaaatcgtttatgaaaacatgactttaagccaatccatgaaatgcaaatacaaagatcatggcgaagactacgacttattaaaacaatacatagctacgctatctgaccatagtcaagtacgaaaactattactggcatatgacttgtatgtaaataatagacacggacgcctactagaggccaagaaagagttcaaacaagacaaagcactaacccaagatgagttttataaaatagtaaaagaaaacttagacgactcacaattagcccaaaaaatccttcaaaaaatcgacgaaggtaaattcatgccaaagcaaagagtgaataaaaacggatacattccgtatcagctacaccaaatagagttagaccaaataatagctaaccaaagtaagtattatccctttctggcagaagaaaaccctgtcaaagaacacagaaaacaagcaccttataaactagatgaattagtacgatttagagttccatactacgtaggaccacttatctctccagatgacaaaagaaaagatgaacagcaaaataaaaaccacgaaatgttcaaatttgcatggatgaagagaaaagatgacaatggagcaataacaccttggaactttgcccaaaaagtcgaccgtgaaacatcagctaacagatttataaaaagaatgactgttaaggatacatacctcatcggcgaggatgtacttccggcccgatctctattataccaaaaatttgaagtactgaatgaattgaacaacatacgagttaatggtaaaagattagaaccaaaatttaaacaaaaagtattcaacgaactgttcaaacaaaaaaacaaagtaacaaaaaaagcattcaaagaattcatactacaaaatacaggaatgaagacagctgaaatagacggcttagcagacccaactaaattcaactcctctttgtcgtcatattatcacttaaaatccactaaggtttttgataaacaactagacgacccacagtaccaagcagattttgaaaagataatcgaatattcaagcatcttcgaagatgccgaaatctaccaagaaaaactacacaaagaaataaagtggctaaccccagcacaattcaaagcaatagcaaattggagacttcaaggctggggcagactctcacgcaaattactcgttgaattaaaaggaaaaggaggagagaatatcatctatcagctctggacaacacaaaaaaatttcatgcaaatagtaaacgaaccagaattaaaaaaagctatcgtaaaagaaaaccatcaagcaacggaagaaaaaggaatagagaaaatactagacgattcattcacatcgccagcaaataaaaaagccatcaggcaagttataaaagtagtcgacgacgtagtaaaggctgcagggggcaaaaaacccgcacaatttgctatagaatttacaagagaaccaaagtggaacccacatttaagcaatattagaggaacaaaacttctacaagtatatgaagatacagcaaaaaaattagtcgaccaaagtcttacagattcactccgtgaaaatatgaccaacagaaatctactgaaagatgaatacttcctatactttatacagggaggaagagatgcgtacactggaaagaaaattgacatagatgacataccaaaaaaatatcaaatcgaccatatcctaccgcaaagctttataactgatgattccttagacaatagagtgcttacagaaatagaaataaatcagaaaaaagggaaaaaatacgctagccacttattcgctcccaaaccagcttttggtctcaaccaatccatctcagaaatgtggaaaacttggcaaaaggcaggccttatttcacaaagaaaactaaacaatctattattcgatcccgaccttgtgaaggacaaacaaaaaaaaggcttcataaatcgacaattagtagaaacatcacaaatcatcaaactggtttcaattatcctacaagataaatttcccgatacggaaataataacggtaaaagcgggatataatactgctctgcgaaaagaactgaaactttacaaaagtcgcgaagcaaacgactatcaccacgcaattgatgcctatttgacagccatatgcgacaactttctctaccaagtgtatcctaactttaggccttttttcgtatacggccaattcaaaaaattctcacaagacaccgacaagcaaaaaaaagctgtcaaatactatggcttaaaaaacttcctattaccacttttagacgattctacaggagacgaagtcatggtaaaccatacaaaacacgtcgtattccataaacaacgtgatatattcaacagactaatccaagcctacaattacaaatatatgttagtttctagagaaactacaacagagaactcaaacatgtttaatatgacaatatatccacgtggggaaagagatcgaaaaaaaacacgcaaattaataccaaaaggaaaagatttagatcctgctatatatggaggctattcggggaatactgatgcctatatggtaatagtcaaaatagagaaaacaaaagaaactttgtataaagtagtaggagtccccatgcgtgcattagcatccctcaaaaaagctcaaaaagaaggaaattacgaccaagaattaaataaagtactcgagccactcataatgttcaacaaaaatggaaaaagtaaagctggtataaaaggattcaccgtagttaaggatcatgtacacttcaaacaagtagtgatagacggagactccaagtttatgttatactcagctcagtacagagcaaacgcaaagcaactcactctatcccaagaaacaatgaaagtagttaccgacaatacagacgatatggaccaaaaaaacgcagacaaagatcaactattactcaacgcttacgacgaaatactagaaaaggtcgaccaatacctaccattatttgatataaacggcttccgtcagggactacacgatggtcgagcaaagtttgccgcactaaaaacaagtgaaaaaaaatataccctaaaaaacgtactgaacggactacatgacaatctagtaacaccaaacctcaagaatataggcataaagaccccctttggacttatgcaaagcagttctggaataacattatcaccaaacgcaaaactcgtatttcaaagcccaacaggattatttgaaaaacgtgtcaaattaacaaatttatga

SEQ ID NO: 5611 - RNA, 4203 nt, synthetic construct
  misc_feature 1..4203: note = Cas9 variant
  source 1..4203: mol_type = other RNA
atgggtaaacaaaaatttaacgactattacttgggatttgacataggaacaaactcagcagggtgggcagtcacagatctgcaatacaaactgttacgcttcaataagaaagatatgtggggatcaagactttttgatgaagcacaaacatccaaggaaagacgagtatatagaaacagtcgtaggcgactcgacagaagaaaaaagaggctaaaactattagaggaactatttctagacgaaatttcaaaaatagacaatacgttcttcaaaagactgaaagagtcaaatctttataacgaagataaatcaataaaatttaattaccccttattcaatgacaaagactatactgatattgacttctataatgaatacaaaacaatttaccatctaagaaaagatctaatattcgaggataaaaaatttgacatcagattagtattcattgcactacatcatatcttaaaatatcgaggacatttcatatttgaaggtcagtcgtttgaagagatcaaaagctttgacagtatcttcacgcaactatcttcctatttcctcgaaaacttcgactttaacatagacgtttctatcaaagaaaaactagaagaaatcatattgagcgacaacactaaaagcatcaaaaaaacagaatttaaaaaaatattcagtgacaataaagtactatccgtcctcaacatggctatagggtcaaaagtatcattaaaagacgtattcaacaatgaagaattaaaagaacaaaagattagtttttcagagatagattatgaaaatgaaaaaagagatgagttttaccagttactcggcgaagatatatttttaatcgatctcgcaaaaaaaatttatgacttcatggtactaaaaaaaatcctaaaaaatacagacagcttctccgcatcgaaagtagcattatattgcgaacataaaaaagacctagacgacctgaagtacatatttaaaaaatatctcacgaaagaagactattttaaattcttcagatccaatgtcgaaaaaatcaactatccaagctatataggactaaataaaatcaaatcaaaaaaaataataaaagaaaataaatgctcaatcagtgatatcaacaaagaactcaagaacaagtacttaaaagatatcaaattagaagcgaaagacaaagaattatttaatcgcatattcaacaaactagatgaattcaaatttctagaaaaactaaaatcttcagaaaattcaacagttccctatcaagtacatgagatagagctaaaaaaaatactagataaccaaagaaaatattacccttttttgaatgaaaaaattgacggaaagtcggtctatgaaaagataatacagcttttcgaattcaaaatcccatactatatcggccctctaaatacagatccaaatgtaaaaggaaagaatacatgggtagtgcgaaaagatgaaaacaacaaaacgccgataaccccctggaacttcgaacaaaaagtagatatgcaaaaatccgccgaagaattcatcaaaaggatgacaaatcgttgtacatacctaaaagccgaagacgtcatagcaaaaaacagtctcctttatgaagaatttatcctcctaaatgaattaaataaagttacagtagataatgaaattctacatccaacattgaaaaccgaaataatcaacgaattatttaaaacaacagtcaaagtaactaaaaaaaaattcatagaatttctgaaaaaaaaacaagcagttaatgacgtagaatcaattactggaatcggtgtcgagttcaactgcaaacttcaagggtacaatacattccgcaagatactaggaaaaaaaattgaaaatgtaaacgtgaaaaactttgtcgaaaaatgcattgaactaaagtgtctatatgggtcagataaaaagctgttcgaaaacgcaattggaaagatatacagggaatacaatataacagacgaagaattcaataaaattaaccgccttaacttcaataaatgggcaagactaagcaaaaagtttctaactgaaatatcattcgaaaagaccgatggtacaaaaaggtttgaatctgttatagaagcattgcgctctacaaactataacctaatggaactactatcagacaaatttaacctacaatcaaaaatagatgaaataaatggagaagatgacttctcaaacatagacattaaagaatacgtagacaaattatatgtctcacctagcgtaaaaagaagtataatacaaacatacaagatagcaatggaaattaaaaaaataacaaagaaagatcctaagaaaatattcatagaaatggcaaaggataaaggagagaaaggaaaaacaacagaaaaacgaaaagacaaaataaaaaaactgtacaaaaacataaaagatacattatccgactactgcaacaatctgcaggacctcactctacaagtagaaaaatatgacgacaacagactgcggcaaaagaaactctttttatacttcatgcaaatgggaaaatctatgtacacaggcagatgcatcgatctagaagacctcttcaataataatgtctatgatatagaccacatctacccacagagtaaagtaaaagatgattcgttcgataatattgtcttagttgagaaagaagaaaaccatcgaaaatcaaatgaactcctaaaagaagaaatccaatcaagaatgaataattactggatattcttacgcgaaaataaatttatctcaaaagaaaaatacaaccgacttacaagaaaaaaagactttaccgacgaggaactgggtgatttcgttgccagacaattggtaaccactcgacaatcaacaaaagaaatagcaaaattcttcgaaaaaatattcgaaaaaacaaccgtagtatacagcaaagcaagcctagtgagtgaattcagggaaaagtacgacataataaaagtacgagaagttaacgacgctcatcacgcacaagacgcatacttaaatatcgtagtaggaaacgtattcaacacaaaatttacaaaaaactactggaaatttaccaaagatataaaaagacaaaatgaagaaaatccaaatgagaagaagggatacaacctaagaaaaatatacgaatcagacgtattctgtaacgattcagtagcatgggtctactcgaaagagaacccaaagtacaatacaataaacacagtgaaagatatggtctaccgaaaaacagccaatataacaagaatgctagtcgaaggaaagggtcaactctttaatctaactataaaagataaaacacaacttaaaaaaaacgtgggaaacatagtcgcaaacacaccaatctcactaaaaaaccgcaagctacacttaaactcagtagaaatcgcaaaaaaatatggttatttcgacagtctgaacaacgcatacttcgttctcttcaaatatgaagaaaaaggcaaagaaaaaattggattcgatagcataaccattgcatacaaagaacgattaaaaaagaacttggatatcgaaaaatttctagaaaacaaaggatacaaaaacagtaaactcatccgcaaaatatttaaaaaccaaaaggtactcataaacggatacccctacttgctcaaatcattcaataaacaaagccaaatcaaatttaacaacttcaaaatattatatcttaatgaaaataatctaaaatttgccaaagatgcaataaagttcgaaaaaaacaatgcaaatgtcgatctaaaaaagcaaaagtatatagtctcattcctaaaaaaaaagaaacaaaatgaaattaatgaaacatacgaagaatgcatcgacagactaaacgacgaattcgataccctattcttaaaactttgcgacatacaaaagtcctccatttataccaattacaaactacaagacttttcaagtaataaaaaaagcattgaaatcaaagataaatttgatatctttaagagcttagatctgtataagaagtctaaactaataaaagaatttctcaactattacaaatatgaaaaaaacgatctagacttctccctaatagacattgataaaaaggctaactgcatacaaaagcacttcactgaagaccttgtaaaagacttcgttatagttgatgaatctgttacagggctattcgttaaaaaagaacgactaaaatga

SEQ ID NO: 5612 - RNA, 4203 nt, synthetic construct
  misc_feature 1..4203: note = Cas9 variant
  source 1..4203: mol_type = other RNA
atgaaaactattaccgaagattacatactaggattagatatagggactaacagttgtgggtgggcggtcatggacaaaaagaatagacttctacgtctacgcggaaaaagagctataggctcacacctttttgaagagggacactcagcagctgacagacgatcatttcgaacaactagaagaagactaaaacggagaaaatggcgacttcggctattagaggagatcttcgcagaacctatggctaaagtagacccagccttctttgtaagactacatcaatcctgggtctccccattagataaagacagaaaaaaataccacgctatcgtattcccaactgcaaaagaagaccacgaattctatcatgattaccctacaatctaccacctacgcgatgccctcatgagagaggacagacaatttgatctaagagaaatattcttagccatacatcatattgtaaaatatagaggaaattttctgcaagatacacctgtcaactcattcgtagcatctaaaatagatgtcgcttcttttcttacgaacgttaatcaagcttacgccgataaatacggagaagaacaaaactttatagagctcaacgaaaacaatgcagctgccatagaagcagtcataaggggcaaagacaaagataaaaccactaaacagttagataaagcaaagaaaataacgaaacttttacaatcctcaaccaacaaatacgaaaaaaacgtaacaagacagatagcaaatgccattataggttacaaaacacaattcgaaaccatattagggaaagacatagacaaaaacgacaaagcagactgggagtttaaattatccgatggagatgccgacgataaactcgaaaatctgttgcctgaatttgatgataacgaccaatacatagtagcagaaatcaaaaaactgttcggctcaatagcactatcacaaattgtttacgaaaacatgacactgtctcaatccatgaagtgcaaatacaaagatcacggcgatgactaccatttactaaaacagtatattgccacacttagtgaccatggacaagtaagaaaattacttctagcatacgatctatatgtcaataacagacatggaagattattggaagcaaaaaaagagttcaagcaagacaaagcacttactcaagatgaattctataaaatagtacgtgaaaatttagacaactcacaattagctcaaaaaatactacaaaaaatagaagaagagaaattcatgcctaaacaaagagttaataagaacggctttataccttatcaactgcatcaaatagaattagatcaaatcatagctaaccaatcaaaatactatccgttcttagcagaagaaaatccggtcaaagaacaccgtaaacaagccccttataaactcgatgaactcgtcagattcagagttccttactacgtagggcctttaatatccccagatgacaaaagaaaagataagcaacaaaataaaaaccacgaaatgtttaaatttgcatggatgaaacgaaaggataataatggtgccatcacgccgtggaacttcgcccagaaagtagaccgagaaacatctgcaaacagatttatcaaaaggatgactgtaaaagatacatatttaataggcgaagacgtgttacctgcgcgaagcctactctaccaaaaatttgaagtacttaacgaacttaataatataagagtcaacggtaaaagactagaacccaaattcaaacaaaaagtatttaacgaactctttaaacaaaaaaacaaagttacaaaaaaagctttcaaagaattcatcttacaaaatacaggcatgaaaaccgcagaaatagatggacttgctgatccaacaaaattcaattcatccctatcatcttactatcatttaaaaagtacgaaagtttttgacaaacaattagacgatcccgaatatcaagccgacttcgaaaaaattatcgaatatagctcgatctttgaagacgctgagatatatcaagagaaactacataaagaaataaaatggctaataccagcacaattcaaagcaattgcaaactggagactacaaggctggggtcgtctgagccgaaaattactagtagagttgaaaggaaaaggaggtgaaaatataatttaccaactttggacaacacaaaaaaactttatgcaaattgtcaacgaacctgagttaaaaaaagcaattgtaaaagaaaatcaccaagcaaccgaagaaaaaggaatagaaaaaatattagatgactcttttacttcccccgccaataaaaaagcaatccgtcaagtcatcaaagtcgtggacgacgtagtcaaggctgcaggaggaaaaaaaccagctcaatttgctatcgagtttacaagagaaccaaaatggaaccctcaattatcccacatcagaggcacaaaactgttacaagtatatgaagatacagccaaaaaactggtcgatcaaagtctaactgattcattaaaagaaaatatgacaaacagaaacttattaaaggacgaatatttcctatacttcatccaatgcggacgagacgcatataccggcaaaaaaatagatatagctgatatacacaaaaaatatcaaatagaccatatactgccacagagtttcataacagacgactcacttgataaccgagtactaacagaaattgaaataaaccaaaaaaaacataaaaaatacgcaagccatctattcgcaacgaaaccagcattcggtttgaatcaaagcatcagcgaaatgtggaaaacatggcaaaaggcaggactaataagccaacgcaaactcaataatctcctttttgaccccgacctagtcaaagacaaacaaaaaaaaggattcatcaacagacaactagtagaaacatcccagataatcaaactcgtgagtataatcctgcaagacaaatttccagacacagaaatcattacagtcaaagcaggctacaacaccgcactgcgcaaagaattaaaactttataaatcgagagaagcaaatgactatcaccatgcaatagatgcatatcttacagcaatcaacgacaattttttatatcaagtatatccaaacttcagacctttctttgtatatggacaattcaagaaattttcacaagatactgataaacagaaagaagctatcaaatactacggattaaagaactttttagaaccgttactagacgactccacaggagacgaagttatggttaatcacaccaaacacgtagtcttccacaaacaacgagacatatttaacagattgatacaggcatacaactataaatacatgctagtatcgcgagaaacaacaaccgaaaattcaaatatgttcaacatgacaatatacccgaggggagagagagacagaaaaaaaacaagaaaattaataccaaaaggtaaagatttagacccagcaatatatggaggatactcaggaaatacagacgcatatatggttattgtcaaaattgaaaaaacaaaagaaacactatacaaagtcgttggtgtaccaatgcgtgcattagccagcctaaaaaaagcacaaaaagaaggaaactacgaccaagaacttaacaaagtattagaacctttaataatgtttaacaaaaacggaaaatcaaaagcaggtataaaaggtttcacagtcgtaaaagaccacgtccatttcaaacaagtcgtaatcgacggagattcaaaatttatgctttactccgctcagtaccgcgcaaacgcgaaacaactcacactttcacaagaaacgatgaaagtagtaacagataatactgatgatatggatcaaaagaatgctgacaaagaccaactattgctaaacgcttacgacgaaatcctcgaaaaggtagatcaatatctaccactctttgacatcaatggtttcagacaaggccttcatgacggacgagcaaaattcgccgctctgaaaaccagcgaaaaaaaatacacgctaaaaaatattttaaacggcctgcacgataacctggtaaccccaaatctcaagaacataggaataaaaacccctttcggccttatgcaatcgtcatccggaataacattatcacctaacgcaaaacttgtttttcaatcacctacaggtctatttgaaaaaagggttaaactaacaaatttatga

SEQ ID NO: 5613 - RNA, 4203 nt, synthetic construct
  misc_feature 1..4203: note = Cas9 variant
  source 1..4203: mol_type = other RNA
atgaaaacaatactaggtttggatctaggaacaaattcaatagggtgggccctagtaaaagaaacagaaaactccaatgagaaaagcgaaataataaaactaggagtacgtgtaaacccactaactgtcgacgagaaaacaaacttcgaagcaggacgaccactttcaacaaacgctgatagaacagcaaaaagaagcgcgagacgcaatttacaacgatacaaactaaggagaaagaacttgatagatttgctaatcaaacatagactaatagataaagacacaccacttacagaaataggcaaaaacacgacccatcaaactctagaattaagggcaaaagcagcaagagaacgcatagaactagaagaccttgcgagagtctttttagcaattaacaagaaaagaggatacagatcatcaagaaaagtaaacaacgaagaagaaggacaagtagtagatggaatggcagttgccaagaaactatacgatgaaaatctaacacccggccaatatgcgtatgaactactatccaaaggtaagaaatacgtacctgacttttatcgctccgatctacaagcagagttcgactctatatgggaatatcaaaaacagttttatgcggacatactagatgatgaactctataacgcattaaaaggacaaggacaacaaaatagccgaaaacgattcctagctataaaaggcgtttacacagctgaaaataaaggcaaacgagacgaagtaaaattacaacattacaaatggcgaagtgaagcaataacacaaaaactcagtattgaagaagtagcatatgtacttgtagaaataaataacgatctaaataaatcaagcggctatcttggagcaatatccgacagatctaaagaattatacttcaataaagaaacagtaggcgaaaatctatggaaacaaattcagaaaaaccctcacaccagcttgaaaaatcaagtgttttatcgccaagattatctcgatgaatttgaacaaatttgggaaacacaagcacaattccatccccaactaactctagctttaaaagaacaaataagagatgttgtcatattctatcaacgtaaactaaaaagccaaaaaggcttactcagcttctgccaatttgaaagctgggaaatagaaagaaaagacgagaatggcaacgtaatcctaaataaaaccacacaattaccaaaaagacaaacggtcggtagaagagtagcacccaaaagctctccattgtttcaagaatttaaaatatggcaaaatatcaacaacctggagatagctaaaatatccgacggaaattcgaaaaacaagaaagaaacagaagcactatccgacgatgaacgaaaactcttgttcgaagagttaaacttgagaggaaatctgtcacaaaaagaagttctacaaatattaggactgaaagacaaagaatataaaactaattttccagagggtttggaaggaaaccgaacaaatgcagctttattcaatatataccaacaaatcgcagaaaacgaaggatacggcgattggaccaagaaatcagcgcaagaaataaaagaagaattaaaagcagtattccctcagattggcatacaagctgatatactagattttaatgcagaactagacggaaaagaatttgaaaatcaggcaagctatcaactatggcacttattgtattcagcagaagaagatgataaaataaacgaagaagaccaaataatatacggaaacagtgcagtgagtctcaaaaagaaattatgcgaaaaattcggttttacacctgaatacgcaaaatggatagcaaacgtgagcttacaagacgattatggcaatttatcaactaaagcaatgaggaaaataataccatacctaattgatggaaacgactattcagaagcatgcgcattagcaggttacaatcactcgaatagtttaacaaaagaagaaaatgataatcgagaacgacttaacaaattggagctcctacccaaaaacagcttacgaaacccagtcgtagagaaaattctaaaccaaatggtgaacgttgtcaaccaggttatagaaacttacggaaaacctgatgaagtaagaatagaactagcaagagaactcaagaaaagcgcagaagaaagagcagagatgaccaaaggaataaacgaagcaacaagaaggaatgaagacatcaagaaattaataactaagaactttggaatccctaatccaacaaagaacgatgtagtacgatataggctctgggaagaactagcaccgttagcatacaaagacgtgtttactggacgccaaatcaagaaagaagatctatttagctcgaagatagacatagaacacataataccaaaagcgctgttatttgacgatagcttctctaataaaactctggccttcagggaaactaacctcaagaaagcagaccgtacagcttacggtttcatagaatctgactacaatgcaacactcgatgactatatacaacgagtggaaacactatataacaatgccaagggcacaatctcaaagggcaaaaggaataaattactaatggcccagaaaaacctaccagatgggttcattgaaagagacttaagaaactcacaatacatagcaaagaaagctaaaagcatgattgaaaaagtgttcaacgatgtcaatgttacgagtggatcaataacagaccgattaagagaagattgggacctaataaacgtaatgaaagaattaaatttcccaaaatacaaagcattaggactcactgaaatagaagaacgttatgatataggacaagagaaaactaagaaagtggaagtaattacagattggacaaaaagaaacgaccatagacaccatgctatggatgctcttactgttgcatttactacaaaatcacatgtacaatatctaaataatctcaacacaatacactctttaaaaggagacgaagtagacctagaattaagtaaactctatggtctgaaaaataccatcacagaagtcgtaaataagaaaaggaagtttattccgccaatgccaaattttcgtgaagaagccaagaaacatatagagacaatactggtaagtatcaaaaataaaaataaagtatatactaaaaacatcaacaaaaccaagaaagagtcaggataccacaccaaagagcaactgacccctcgaggacaattacacaaagagacagtatacggtaaatctaaacggcctatgaacaaaccaacgaaaattaacaagaactttagtttagaacaagcacaattaattataaatgtacaagaaaaagagctagtattaagacacttagcccaattcgacaacaaccccgcagtagctttcgatacaaagactttaaagaaaatgccgcttctcaaaaacggagaaccattgaaagaagtattatgcttcgaggaaatctttacaatacgaaaagacataacaccagacttaaagattgaaaaagtcgtcgacgagaaaataaaagcaattctggaacaaaggaaaaaggattttggtggcaatgctaaagaagccttttccgacttagacaaaaacccaatatggcttaataaggaaaaaggtatatgcataaagcgagtaactataacaggcgtcagcaatgctgaagcattgcatcaccaaaaagaccacctaggtcgcgaaatactagatgacaacggaaatccaatacccgctgattttgtatcaacaggaaacaatcatcacgtcgctatatacgaagacgaaaaaggtaagttacaagaaaaagtagtaagtttatatgaagccgtagcaagagcaaatcaaggtttgcccgtagtcgataaaggacttaacgaagatttaggatggaaattcttattcacaatgaaacaaaacgaaatgtttgtatttcccaatgacgactttgatgtaaacgatattgatttactagatgaaaacaatgccaaaattatatcacaacatctattccgcgtccaaaaactagcaactaagaactatatgttcaggcaccatctggaaacgaacgttcaggaagtaaaagaactaaatgacatcgcatataaaagtatcagatcaaccgaacccctcaaaaatatcaagaaagtaaggataaaccacattggcaaaattgtgcaggtaggtgaatattga

SEQ ID NO: 5614 - RNA, 4209 nt, synthetic construct
  misc_feature 1..4209: note = Cas9 variant
  source 1..4209: mol_type = other RNA
atggcaaagaaagactacacaataggtctcgacatcggtaccaactctgtcgggtgggcaataattgacgacaacctaaaactactaaaaagaaacatgaccataaaaggcaataccgataaaaaatcagtcaagcgggacctatggggaagcctactatacagtggaaatagcgacaaaactacttcagcagcagatgcccgaagcaaaagaggacttagaagaagattacgacgaagaaaatatagattggatcgccttaaacaaatattcagtgaaataatcaatgataaagcccctaatttcttcgacaaactaaacgaatcatttctgaatcccaaagataagaaatacggtaagtatcaaatatttgacacagaaaaagaagaaaaagactactatcgacgttatcctacaatttaccacctaagaaaagatttgatagaaagctcaaaaaaacaagatattagactcgtgtacctcgcattagcacacatactaaaatcacgcggaaacttcttattcgaaggcaacatagacgacttaaaaaacgactttgctggtatatatgaagaagtagtagaactatgtatgaccattaatgccgaagacgtagatctcgaattcgaagaagtcgacaaacaatcactcaattcaattataaaaaacgaggacataagcgaaatcgaacaaggactagagaattttgccgacgaacatgttatcttcaaagaacaaaataaaaagaaaaatgatttattctcaaattgttgtaaaataatttgcggccataccgtcaaagcaaataaattcgcatcagaactcgactcagaattatttataagcttcaaatcagacgattatgtcgacgtgatcgatgttatacaatctggaaatgaaaacatagcaaatctactactggcttgtaggaaagcatacgattacatcatgttcaaccgacttgttgacttaaatatagatagcccagcaaaattaagcagcaacatggtaagtctatacaaccaacacgagaaagatctaaaagcatataaaaaattaattaaagagtttaataagttcaaaagatcaaatggatgcaaggatctagaaatgattatcttaacagctgacgacatagacagctttagaaaaaaagtagacaagaaggaagggaaattaaatggcataaataaaaaaattacacacgaacaagcattaaagaaacaattaaaagacatgaaaaaaatattagaggacaaaaatacagaagcagaagacaaacaaataaatgatatattaaaaatgatcacaagtatagaagaacgtgtaaataaaagctgttttctaaaaaacctcagaagcaccgacaacgcctcaataccaaatcaaatacagagacaagaaatggaagccatacttgacaaacaagctaaattctacccttttctaaacgaacacaaagacgaattgctacaactcttgtcctttagaataccctattacgttggaccattagtcaataaaaaatatagccgatttgcatggctggtacgaaaagaaggccaggtgcagaaaataacaccaactaacttcgatggtgtcgttgataagcacaaaactgcagaaaagtttatggaaagactcatcggaaaagatgtatacctaccaaacgaaagagtcctacctaaagccagcttattgtatcaagagtactgcatcttcaacgaactgaccaaggtagcgtatatagactcaacaggaaaaaagaacaatttttcaagcgaagaaaaactcaacatatttgaaaaactattcaaaacaaaaagagaggtaacgaaaacagacttatgcaaatgcctaaataacgtgtgcaaactcaaggaaaaagtaaaagaaacagaaataataggaataaaagccaaatttaacgccaaatattcaacataccatgatcttaaaaaaataaacggcatggaacaattgatagcggacgaagaaggaaaacccctgtgtgaggatattatatctattttaaccatctttgaggacaaagacatcagattagtaagactaaaagaactcctttgccaaaataaagacttaataaacaaatttagccttagtgccgaaaaactcgcaaaagtattatctaccaagcactacaaaggattcggcaatgttagcgcaaagctaattaacggaataagagataaaaactgcaaaacaattcttgactacctaatagaggacgataaagaggcatattacggaagaaataatcctaaccgaaatttgatgcaactggtaaatgattcacgcctagcgtttaaaggacagatagatagagagcaaaatacacatttagaggacctttccctagatgaattccttgatgatttatatgtttctccatcgattagaagagggattagactaacaataagactagtagatgaactagtagaaatcatgggctacctcccaaaaaatatagtgatagaaatgcctagagaagatggggaaaaaggaaaaattgcagacaccagatatagtaaattagaaaagatgttaaaaaaagatgcagcactagaagatctatatagagtattaaaaacatatgagaaaaataaaaaagcactggctaacgacgccttatatctatatttcttacaaaatggaagagatatgtatactggaaaagaaattaatctatcagaattacattcatatgatatagatcacattatcccaaagtccttcaaatacgacgattcccttgacaacaaggtactgacagcaaaaaaaatgaacatggacaaaagaacaggagccttagatcacaatataatcgagaaccagtgtgggttttggagagtattactacaacaggataaaatatcattagagaaatatacaaacctaatgaaaacagaattcacagaagcagacaaagcaggattcataatgagacaactagtagaaacaaggcagataacaaagtttgtagcaaggtatctagacaacaaatttaatggactgatcagcgatcctaatgataaagtgaacatattgcttccacgtgccagtctttgtcaccaatttagagaaacattcggattttacaaagtccgagaattaaacgatatgcatcacgctcacgatgcttacttgaacgccgttatcgcaaacacacttaacaaaaacgcgtacctatcggacctcctaaaatatggcgcatactcaaaatacaaaaaaaatggctttaacaacagtaacggcataatggattatttcggcaatacacaatttaattgccttttcgtggtggaaagaacactcgacaaatgtagagttaatatagtaaaacacccagaaactgcaagcggtgaattctacaatgaaacgatccaaaaaaacaaagtaaacggaggaagtagtactaggagcttgaaaagtagcgtaaaagtcctccaaaacacagaacaatacggaggatttacaaacgtcaataatgcatattttatactcttcgattataaagctaaatcgaaactaaaaagaaagctcataggagtacctatagtagatagacaaaaattcgaacaagatccggtaacatatctggaagcaaaaggctttgatgaacccaaactggtgcaaaaactactaaagtacacgttacttgaatacgaagatggaaaaagaagataccttacaggggtaacaggaaaaagatgtgaactagttagagccaaccaattgctattaccacgaaatatgatggcattattacatcatttacaggagtggcaaaaacacgactttggaataaaggaaatgaccaaagtaataaaaaatacaaacaacatagaagcgaaatttgataaattatttgaacatatgatgaaattcatcgacaagtacagtgaaccacctaaaatagtttcatctaaaatatcggaagaataccacaaattaagagaatcattgtgccaagacgataataaaatcaaaatatatgcagaaataggtaaagccctattaagcttattacacttagtcgactctaagtcggcatgcgttttcaaattcagtggactagaaataaacagaatacgatatcaatccatcaatgaaaaaaaagaaccagtaataatattccaatcgctaagcggactccgcgagtctagatacaaatacaatcaatga

SEQ ID NO: 5615 - RNA, 4209 nt, synthetic construct
  misc_feature 1..4209: note = Cas9 variant
  source 1..4209: mol_type = other RNA
atgaaattgagaaatgcaaaagactacagcataggattagacgttggtactggctcaactgggtgggcagtaacaactttagacggggacttattcactttcaaccatagacccacattaggtagccgattattcgaatcagccagcacagcccaagaaacacgagaagcacgtggagctcgaaggcgtttaaaaagacgaagatggaggatatcactacttcaagagcaattcgcagcagaaatggaatcatgcgattccaactttttcatcagactaaatcaatccagactatggcaagaagaccggacagagcaaggaaaaggatacctattcggaggaaaacctatattatgcggagcacaaatttttgcaaatgaacaagaatactaccaacaatttccaacaatctttcacctaagaaaattcctagtcgagtgctccgaacaagtagatctaagactgatatacttagccttacataacatagtgaaataccgagggaacttcctttaccaagacaacaaaacactaaacgttaggaattttaacttagatagccaaattgctgactttttggatcaactacaattatggtgcgaaaataacgacctatgtttccatgaaatagatggaactacaacactagcatcacaactaaatacctgtttccaccaacaaagcaatcaacaaaagaaagacactttaaaaactttctttgcaacatgcatagagaatgacaaaattgctggtgaactaaccaaagcattacttggttacaaaacagacttcaaaataatctttaatatcgaaggtgaaaaagatgaatacaaagcaaaatgcaacgaagaggagaaaatactaaaactgcaggaaacaatagacgatgccaatcaagtattactacaaagcatactaaacctatatagcggaatcatcgtagaaaagatcctaaataacacagcagttaaaaatgaatccgcccaatgcacactatcagcatatcattgctactcctacgcactatactcaaaacaattacgaaccttaaagaaattagtaagaaaatataacccacaaagatacaatgaatgcttcaacctaagtgcggaagaccccaaagcaaagaaacaactatgtacatatgcaagatataatgcccaacattctaccgactacgacgagttcaagaaatatatcaaagatttatttgaaaacaccgacgctgtaaacgatgcagcctaccaacaaatgaaacaagactttgatgaagagaaatttctcaggagacagaaaacaagtgataacggcgtatacccatatcaattccaccttgaggagatgcaactaatcattgaaaaccaagcccaacattacccctttttaaccaaaattaaacccaaactagaatctctagtaactttcaggataccatactacgttggcccactaacacaaaaaggaatacaacgcaatggcagaaaattcgcatggtctaaacgcaataaagatgcagaaaaccaaagaatttatccatggaactgggattctattatcgacaaatcagcaagtgcagaagcattcatcctaagaatgactggtaaatgcacttacctatacggcgaagacgtacttccaaaagaaagtttactatatcaagaattttgcgtcttaaatgaactaaacggagcaagatggaattgtgatggcgaaagaagaatgccgctgtcgaacaaagactgtaaagcaatttatagacaactatttctaaagaaacaaaaagtttcatatgccgatgtatcaaactacctcaaagcccaaggacacatcaacaattccgtcgccggtggacaaggagaacacgggttcgaatctactttatcatcacatcacttcttcagaaaattatttaacgtcgacgccgccaacgacttaacagcccaacaaatagaaactgctgaacaactcatattgtggggaacaatatttgaagataaagaaatattcgaacagaaaataaaagaacgattcggagatatgttttccaaagacgaaattaaaacaatagcacgcagaaaatttagcggatggggtaaatgttcaaaacaactactatccggtctcacagtggaaaccccacgtggaagagagtcaatcatagacgttcttcgtaacgggcaccccgaaaacggccgaaccctcgtttttatgcaagtaataactgacaagaaactcgaatttgataagaaaatagaggaatacaacaacgaacacttagcgaaaacaaatgaatctgtcctcgacacagcaataatgtcaccagcaataaaaagaggcgtaaatcaagcattacatatagtaggagaaatcagaagaatcaccaaacatgatccaacatgcatttacatagagaccactagagacgaaaaagatggaaaacataacacacgtacttcatcacgttattcatcgctgaagaaaaacctcgaaaccttaaaatcaatcgacaaagcaaacgctcctgcaataaaacacagtttagaactcctagaaacatataagaaacaaaacattgacgacaaattattcctatattttacgcaaaatggtaaatgtatgtactcaggaaaaagtctcgacattaataatctctcatcctaccaaattgaccacgttatcccccagtcatacataaccgataatagcttcgacaatagagtactcgtatatgcatctgaaaaccaacgaaaaagcgattcattactactctcatcagtaatacaggcaaaacaagaaccattctggacatcattggaaaaagcaggccttatatccgaaaagaaacataacaatttaaaacgcaaaagtctatcagacgctcaaataaaaggctttattaacagacagctagtagaaacgagccaaattgtaaaagtgcttagggacgaactcagtagaatactaccagatacaaaaataataccagtcaaagcctcactctcacatgacgttagaatcgcttgtaatttgtacaaatccagaacagcaaactcttttcaccacgcacatgatgcactattagcatctactatgggaaggttcgttcaaacacgatttcccgacatgtatgaaaaccctgtaagatatgtgaagattctaagagcatatatagcccaatcaaaactccaacattctgctcaaacaagaaattttgactccagatcatttatggcccactccttcttctgtgattacagtaatgaaaatggagacaccatatggaactccgcatccgaaatagaaagactacgtagagcattgagttataaaaatctttacctaacaagaagaccattcatagacgcaggacaattttgggatcaaacaatatacagtccacatgacaagaagaaaacaccagactcattaataccactaaagaaaaatctcgacacacaaaaatatgggggctactcaggtaaagactatgcccactttttcatttactcagtcttaaataaacaaggagacgtcgaatacaggttcgatggcgtcccactatacatagcagcgaacatcaaccgtgacgatagaggtgcactggcacaatatgcaaaacaactcgtagaacacgaaaacgtaccgaatgctaaacgaaaaactaaagacctagtgtttcaacgaatagaaagggcttgcgttcccaaataccagttaatctgtataagccaatgtagtggagactcagaccgctcagtatctgactactattatataacgggcaagaaagaagttagaaatgcacttcaactcgcattcccaatgcatttatatggcgctattaacgcaatagaagacaagaaagaactagatgattcagcacttgaagaactggttgtatacatactacgaaacgctccccgtatagcaccagacgtttttagaagactaaatctcactgaaaaactagcagactgtctggatatcccagaccgcattgaattacaaaactccatttacggattattcaacttaataaacgcagaatcaaatgtagtaaacctacaaatttttgggggagccaaaactgctggtgtaaaattaattaacctaaacagcttattgaatgaccccgcaaccacagtaaccttcatagatcaatcagtcactggaatgtttgaacgtaaagaaacgatcggaataagttga

SEQ ID NO: 5616 - RNA, 4209 nt, synthetic construct
  misc_feature 1..4209: note = Cas9 variant
  source 1..4209: mol_type = other RNA
atgggcaaacaagaattcaatgactactacctaggcttcgatataggaacaaatagcgttggctgggcagtaacagatcagcaatacaaactcctgagattcaacaaaaaagacatgtggggatcaagattattcgaggaagccaagacagccaaagaaagacgagtatatagaaacagcagaagaagattggaccgacgcaaacgaagactaaaactattagaagaattattcttagacgaaattttaaaagtagacagtaccttcttcaaaaggcttgaagaatcaaacttatacaatgaagacaaatccatcaaattcaactaccctctctttaatgacaaagactacaccgatatcgacttttacaaagaatacaaaactatatatcatcttcggaaagcattagtatttgaagatcgaaaattcgatatacgattgctcttcatagcattacaccacatattaaaatatagaggccacttcatattcgaaggtcaatcatttgaagacataaagagctttgactacatattcactgaaatccaagactggattttagaaaacttcgagatcaatatagatataaacctaaaagagaaactagaagaaatcatactaagcaacaacaccaaaagcataaaaaaaatagaatttaaaaaaattttcagcgacaatagaattctagctatactaaacatgggggtgggttgcaaagtagatttaaaagacgtctttaacaacgaagaactcaaagaccaaaaaatctcctttaccgaaatagactacgaaaacgaaaaacgagacgaattctaccaactattaggagaaggaatattcatcgtagatttagcaaaaaaaatctacgatttcatggttctaaaaaaaatactaaaaaactcggactatttctccgaatcaaaggtagcactctacgaagagcacaaagaagacctaaatcgcctaaaatatatctttaagaaatatttaaaatctagtgactattacaaattcttcagatcaaattcagagaaaaccaattatccatcttacattggtctaaacaaaattaaaacaaaaagactaatagaaaataacaaatgctccatcagcgatataaacaaagagctgaaaaacaagtacctgaaagatatccaggtagaagcagaagacgaagaattatttaataggatcctacacaaaataaacgaaaacaaattcctagaaaaattaaaatcatccgaaaatagtaccgtaccataccaagtacacgaaatagaactgaaaaaaatattagacaatcaaagaaaatatcactcttttctcaacgaaaaaagtgacggcatgaccctttgtgaaaaaataataaaattattcgaatttagaataccttattatgtaggaccattaaacacaaacccaaacatgaacaaaaaaaacaaaaacacatgggtagtgaaaaaggaagaaaacagcaaaagctcaataacgccatggaattttgaaaaaaaagtcgacgaacagaaaagtgcagaagaattcataaaaaggatgacgaacagatgtacatatctacgaggtgaagacgttataccaaaaaacagtcttttatacgaagaatttgtgctcctgaatgaactaaataaagtaacagtagacaacgaattgctacatcctacactgaaaaacgaaataatagacgaactattcaagaccacagttaaagttacgaaaaaaaaaattacagaattccttaaaaaaaaacaagctatatcagatgtagaatcaataacgggaattgacgtagaattcaacggaaaattacaaggatataacacatttagaaaaatactaggtgaaaaaatagaaaacctcaacattaaaaaattcgtcgaacgatgcatagaactaaaatgtctatacggcagcgacaaaaaactcttcaagaacgccgtaggcaaactttataaagaatacaacgtaactgacgaagaattcacaaaaattaataagctgaattttaacaagtggggcaggttatccaaagaatttttaacaggaattagatttgaaaagactgacggcaccgaaaggtttgaaagcgtcatagcagcgttacgatccacgaattacaatttaatggaattattatctgacaaattcaacttacaaagtaaaatcgacgagataaacggtgaagacgatttttcgaacatagacataaaggaatacgtcaatgaactttacgtttcaccaagcgtaaaacgatctataatacaaacatataaaatagcgatggaaatcaaaaaaataacgggaaaaaacccaaagaaggtattcatcgaaatggcgaaagggggaggagaaaaaggaaaaaggacagaacgaagaaaagacaaaataaaggaactctacaaaaacatgaaagactcactatctgactactgcaacaacctacaagatcttagctcacaggttgaaaaatatgacgacaatagactccgacaaaaaaaactttttttgtatttcatgcaaatgggtaaatcaatgtatacaggcaacgatatcgacctttcagaactcttcaataataacatatatgatatagaccacatatacccacaatcaaaagttaaagacgactcgttcgacaacatcgtattagtagaaaaacaagaaaatcactccaagagcaacgaactactaaaacctgaaatccaaagcaaaatgaacaactactggatatttctacgagaaaataagttcatttcaaaggaaaaatataatagactgacaagaaaaaaaaacttcacagacgaagagctcggagacttcgtagcgcgtcaactagtcactacacgtcagtctactaaggaagtggcaaaactatttgaaaagatattcgacggtaccgaagttgtttactcaaaagcctccttagtaagtgattttcgggaaagatttgatataatcaaagtacgtgaagtaaatgatgcgcaccacgcacaggacgcatatttaaatatagtggtcggaaacgtctttaatactaagtttacaaaaaattactggaaatttatcaaagaaaacaatagaaaaaacgaagaaaacccaaacaagaaagaaggatataatttcaagaacatctacgagagcgatgttttccgcaatgaggacgttgcctgggtattctcaaaagaaaacaaagaaataaacactataaaaacagtaaacaaaatggtatacagaaaaactgtcaacatcacagagatgctagtcgaaggtaaaggacaattatttaacttaactataaaagacaggacacagctaaaaaaaaaagtaggaaacatagttgccaacattcccaaatcactcaaaaaccgaaatactaaattaaagagcgacgaactagccaagaaatatggatactttgacagcctaaacaattcatacttcgtacttttcaagtacgtcgaaaaagaaaaggagaaaattggcttcgacggaataacaatagtggataaagaaaagctaaaaaaaaattcggacatagaacgctttttagaaaacaaaggcaacaaaaacgccaaactaatccggaagatattcaaaaatcaaaaagtcttaatagacggctatccctacctcctaaaatcatgcaacaaggataaagcaatcagattcgacaactttaagagcttatatctagatgaaaacgacctgaaattcactagagatgcaataaaattcgaaaaaaacaacgcagacatagacttgaaaaaacaaaagtacataatctccttcctaaaaaaaaaaaaacaaaacgaaatcaacgagacgtatgaagaatgtatcgaaagactcaacaacgaattcgacacactcttcctgaacctatgcgacatacaaaaaagtcccatatacaaaaattataaattaccagacttcatatccaagaaaaacgtcgtagaggtaaaagacaaattcgaagtcttcaaaaatctagaattatacaataaaagtaaactaataaaaaactttttaaactatttcaaatacgacaataataaattagacttaatagccataggtatagacagcaaagcaaactgtattcaaaaacactttacagaagatttaataaaagatttcgtaatagtcgacgaaagcgtcacgggtttatttgccaaaaaagaacgactagaatga

SEQ ID NO: 5617 - RNA, 4209 nt, synthetic construct
  misc_feature 1..4209: note = Cas9 variant
  source 1..4209: mol_type = other RNA
atgacatatcgaaattatcatataggattagacataggaacatcatcagtaggatttgcagtgcgatatgataatggtgagctagtccataagaaaggatcaaacctagttggagcacgtttattcaaagaaggtgaaacggctgaagaaaggagactaaacagaggagcaagaagaagatacaaccgcagaaaatggcgcctgaacctactaaatcagatttttaaaccattaatagaagtaaacgaccccaccttcttcaaacgactcgaacaatccaatctagtaaattacgacaagtccgagagcttcagtctactcaataatcaaagcgatgataagctgcatcaacaatttccgactatctatcacctccgagactacctcatgaaaagtacagaaaaggctgacattcgtttaatctacctcgcagtccaccatatagtaaagtacagaggaaacttccttgatgccagccctgttgatagcttcgaagcaagtaatctcaaagttgatgaaattctgacacaaataaacctattactagacaacctcaccgatgatctaagacttaacactcaatatgttacagacatagaacaaacattactatccaataccgaaagcaacaaagataaggaaaaggtaatccaaaaacttctattacacaaggaagccatcaagatagataaagaccgaactgcacaaatcgcaaaacttgtactcggatacaaagcagacatagcaaaactgtttggcataaccgaaaaattacaaactccaaaactagaactaagtgcggctaacagtgacgatgcccttatggaactttcagcagaactaaacgaagaccaaattggaatactcctccaacttaagaccctatattcaagagtaagactcaatcaaatcatacctagtggaacttccctctccaagagcatgatagaaaaatacgaactacaccacacacaattaaagagctttaaagaaaatattctcctcaaattgagaagaaacacagcagtacgccgcaatttagaactagcctatgcactctatgtaggcaacgcacaaacaaaacaggaagtattcgaaccaaagaaagcgcgctttacctccgatgactttgcatcactcaaagcaaacgcgaaatcagcatcttcagtaaaagaagcccccaaaaacacaaaaacaaaactaacaactgacgatttttacaacatcttaacagaattatttgcaaccttcgaaagcgaactgagtgcagacgaagatatgataaaagaggtagaacaaattaagaaagcaataaccggagacaattaccttcccaaacaacgaacagaccaaaacggaaacatcccacaccaattacatcagatagaactacgccaaatattacaaaaccaattaccacattatccagaaatggacaaaatcaatgaacaaaaaccaatagagaaattagtaacctttcgagtaccctattacataggaccacttataactccagaggaccaacaaaaatccagcgctgcaaactttgcctggatgaaaagaaaagagcagggagcaataacgccatggaactttgacgataaagtcgatagaatgcaatctgctaccaattttattaaacgaatgactgtcaaagatacttatctaataaacgaggacgttttaccagatagatccctcctataccaacgtttcaaagttttaaacgagttaaatctagtaaaagtaaataaccaactcttgtccataggagaaaaacaagcaatttaccacgatctatttgagaaacagaaaactgttagcaccaagaaactgcaatcatacctacaaagcgaacaaggttatggagacaacatcgaaatatccggattgtcaaacccagacaaatttaataacggacttaccacctacatagactttaagaacatatttggtgatttagtagaagatacaacaaaacaaaaagagttcgaacaaattatcgaatggagtactgtatttgaagatcgagccatattcaaagcaaaactacaagaagttaactggctcacagaagaacaaatcaaagccttagtagctaaacgatactcaggatggggaagattaagttaccgactactagctgaattagttaatgacaacggagaaagaattattgacatcttatggaacaataaaggaagcaacctcatgagcatagtatcacaagatgagttccaacaacaaatagccaggatcaactcacacgaagtacaggaattagggatggagtcagtattagcaaacgcatacacttccccacaaaataagaaagcaataagacaagtaatgaaagtcgtagacgacatccagttagccatgaacggacaagctcccacatcaataagtatcgaatttaccagaaaaccagaagaaaacagtgaaatctcaaaaagcagatatgaaaccatcacatcaatttaccaatcgctttcgaaagatatagaaaaagaagtaaaagataacttaaacaaaaacaaatcaagcctaaagaaaaatctttcagataaatattacctatactttacgcaacttggccgagatatctacacgaatcaaccaattccattcaatgaaataccttattatgacatcgaccatatcgtaccacggtccgtggaaatgaatgactcattaaacaacagggtcttagtagcgaaaagcataaaccaaataaagaaaaacaatgcacctatcgattcatcactaaaaattaccagcgaaactcgacaactatggaagaaattattagattctggcttaattactaaacagaaatattataaactatcatcttcaatcaaaaatactgtatccccttatgtaaaacaaggcttcattaacagacaattggtcgaaacatctcaagttatcaagctagtagcgaacatcttaggaacaaaataccaaaatgatgatacggaaataatagaagtcaaagcacatctaaactcagaaataagaaaaactttcgaattttacaaattacgagagctcaacgactaccatcacggattcgatgcatacctaaccacgttagtcggaggatatttatataacagatacccaaaactacgatcgtattttgtctatggagatcacaaacggctagataaagcccaattaagtgaactaaagaattttaatttcctacatggtttaacaaatcctaaatcaggaagcgatggattaataaccgcgagcggatcacaacaagtagttctagaccgtaatgaaaccataaaaagactaaataaaatataccgctataaatacatgctaataagtagggaagtattcactaaacaaggacagttctataacgaaacaatctaccccgccaagccgaataccgccaaaatgataccactcaaagacaataagccgtcagaagtctacggaggatactcctcctctaacgtatcaaaaatagcgctaataaaagagaaaaatacagacaactatcaatttataggaatcccaattaggagcatcgccaaactcaaacaagcaaaagcaaatagcaaaacagtttatcaaacagaattaaaccgggttatcaaaagcgtactagccagccaaaagacaaagaaacaaaaagaatttgaagttatactagataatgtaaaatacaaccaagtagtagttgatcaaggagaaaaatattatctaggatccccttattataagaaaaatgccaaacagctagttatcagccccgaatctgtcaaaatattggcagataaagcaacagcagatctacccgaacaagaagcgcacaacaaattaatgacagtttaccaggaaatagtcgacgtcctcaacaaacatttcgccttatatgacattaataacgttcgtaagaaattaaacgacggcctaataaaattttcacaactccctaactatgacgaaacatctaaaaatcgattcgatatatccaaatctattaaaacaaaatatgcagtcataatgcgtatattatcaggaatcaaaaaccaaacatcagaagttcccgaattaggcttgaaatcacctttaaacaaaatgcaaactaaaggaggaataaaaatatccccggaagcaaaaatatactactcatccccaactggaatatttagtcactttaaacaagtcaaaaatctctga

SEQ ID NO: 5618 - RNA, 4209 nt, synthetic construct
  misc_feature 1..4209: note = Cas9 variant
  source 1..4209: mol_type = other RNA
atggaacgcatattaggattagatctaggagtgtcatcaataggatgggcactcgtagaagaagatgttaaaaatcccgaaaataataaaatcataaaactcggcgtaagagttaaccccttaacaatagacgagaaaaccaattttgaaaaaggcaaatcaataaccaccaatgcaggaagaacaagtgcacggtcagcacgccgaaacttacaaagattcaaactgcgacgaaagaaacttctcgaaatcctaatacattacaaaataattaaaaatgacgcagtactggccgaaactggcaaaaacacgaccttccaaacccaatacttgcgagcaaaagcagcacgagagaaaatagaactagatgaactagctagagtcctactactaataaacaagaaaagaggctataaaagcagcagaaaggtacagaacgatgacgacggtaaagcaatagatggactatcagttgctaaagaactatacgaaaagaactatacgccaggacaatacgcatatgacttattaaaaagaggtaaaaagcaaatacccgacttctaccggtcggacctacaaaatgaattagatcgaatatgggaatttcaaaaacaatatcaccccgacatattaacagacgaatttaagaaagaactcgagggaaagggccagagagcaacagcagcaattttcttaaacagatataaaatctacacagcagataataaaggtacccgagaggaaaagaagattcaagcctaccaatggcgagtagaagcactatcacaacccttagatgtaaaggaggttgcttatgttatagcagaaataaataataacctcaataatagttctggatatctaggagccataagtgatagaagtaaaaagctctacttcaacggacagacaatcggagaatacctattcgaagaattaagcgcaaatcctcacaccagattaaagaatcaggtattctatagacaagactaccaagacgagttcgagaaaatatggaaaatacaaacaaaatttcatcctgaattaacaaaagaattaaaagaacaggtaagggatattgtaatattttatcaaagaaaactaaaaagccaaaaaggcctcatttcgttctgtgaatttgaatcacgagagatcgagatcgaagaaaacggtaaaagaaaaagaaagaaagtaggtctcaaagtggcaccaaaatcaagcccactatttcaagaatttaaaatatggcaagtactaaacaatatcgaaattaaaaacgaggacgaaagaagatatcttgaaccagaagagaaagagctcctttttaatgagctaaactgcaaaggaaatctgacatcccaaaaatgtttagaattactcggatttaaaagtaaagatgcaaagctcaatttcaaggtagtcgaaggtaaccgaacgaatgaaaaattatacgatgcattcttgaaaatactagaattacagggatataacgtattcgaactattgaaaataaaagaagataaagacgaagcaaaactttcagagttaaaagcaagtgcggacgaaataaaaggaatgattaaagagatattcaacgccaatctaatcaatacaagtatattagatttcaatgctgaactagaaggaaaagacttcgaaaatcaagcatcttatcaattttggcatttgatgtatagctatgaaggggacaattcaccatccggtaatgaaaaactatatgaacttctcgaaaagaaattcggatttaagaaagaacattccaaaatcctatcaacaatagttttcagtcaagaatacggcagtctatcaacaaaagcaatgagacgtatatatccctatataaaagacaacaaatacagcgaggcctgtcttcttgcggggtacaatcatagtaaacattccctgacaaaagaagaactagaaaataggaaactaaaagaacaattggaagtactgcccaaaaattcattacgaaatccagtagtagagaaaatcctgaaccaaatgataaacttagttaatgctaccatatcagaatacgggaagctagacggcgtcagaatcgaactggcacgagaactcaaaaagtccgcacaagaaagagaagacatggcaaaaagcattaacgaggcaacacttctacatcaaaaatacgctaccatactaaaacaggagttcggcgttgtgaatccaagtcgcaatgatattataagatacaaactctatatggaacttactgtcaatggatacaaggatttatacactaatactaagatagaaaaagaaaatctatttaccgacaaatatgacatagaccacataataccgcaatccagattctttgatgacagcttcagtaataaagtattagtgccacgtcaatctaatcttgataaaggaaatctcacagcgtatgacttcatgagcaacaaaggatcagaacgagaggaacacttcttaaatgtaataaaggaattactggacaaaggaagcataagtaaagcgaaatatgaaaaactcaaaaagaaaggattagaaatcggagatggttttatagagcgagacttaagagacactcaatacatagctaagaaagcaaaagaaatcctattcgaaataactaattcggtagtaacaacatcaggtagaattacagacaaattgcgaaaagactgggacttagtaaatataatgaaagaattaaatttagacaattatagacgactcggactaacagaaattgtaagaaactccaaaggcgaagaaaaagaacttataccagactggacgaaaaggaacgaccacagacaccatgctatggacgcgttaacggttgcatttacaaccagaaaccacattcaatatctgaactacttaaacgcacgaaaagacgaaaaacataaagaacaccaaaatatttatgcaatagaaaacatcataactgaagtaatagagaagaaaaatggtagtaaaacaaggcgatttaaagccccaatgaactcattcagacacgaagcaaaacaacatttaaaagaaatcctagtaagccataaaactaaaaataaagtagtgacaagtaatataaacaaaaccaaaaagaaaggaggaatccacaagaaaacagaactgacaccaaggggtcagttacacaaagaaacagtatatggtagtaagaaatttttacaaagtagggaagaaaaagtatcggcgaaattcgattatgaaacgatactcatggtggtgaaccccatacacagaaacgctctattaaatagactcaaagaatatggtaacgaccccaagaaagcgttttccggcaaaaatgcaattaataaaaatccagtatacttagatgatagtaaaaccgacatcttatccgaaaaagttacactatcttggtacgagaccggctacacgataagaaaatcagttacacctgataacttcaaagattacaaaaaccttgagaaaattaccgatttaggcataaagaaaattctaaaagaacgcctagaccaattcaaaggtaacgcaaaagaagcattttctaatttagataaagatcccatatggttgaacgaagaaaaagggatagctataaaaacagtaactataacgggggttagcaatgccgaatcactacactttaagaaagaccatctaggaaaagaaatactagatgaaaacggtaacaaaattccaggggacttcgtatccacaggaaacaatcaccacttagctatctacctagatgaagaagaaaaactagacgacaaaatggttactttctacgaagcagtccttagagtcaatcagggattacctgtaattgacaaagattacaacaaggaaaaaggatacaaattcttaatgaccttgaaacagaacgaaatgttcgtatttcctaatgaagatttcgatcccaacgaaatcgacctactcgatgaacgaaacttagaaagaatatctaaacatctttttcgggtacagaaaataagtaaagtcggatatggcaactcattcgtacgagacttcgtattccgtcaccatttggaaacaaccgtcgaagaacgaaaagaattaagaaacatcacgtatatacaattaaaaagcctcgagggtctaaggaatatcatcaaagtgagacttaatcatttaggaaagatagtacaaataggggaatattga

SEQ ID NO: 5619 - RNA, 4215 nt, synthetic construct
  misc_feature 1..4215: note = Cas9 variant
  source 1..4215: mol_type = other RNA
atgacgaaaaatattctgggtctggacttaggagtatcatcaatagggtgggcattagtccaggaagacagcaaaaacccagaaaataatagaattgtaaaattaggggtacgtgtcaatccacttacagtcgacgaacagataaattttgaaaaaggaaaacctataacaacaaatgcttcccgaaccttagcaagaagcgctaggcgaaatcttcagcgcttcaaattcagaagggcgaacttaatagacgtgcttaagaaatgcaatatactaaaacagggagatttgctaacagaaataggcaaaaattcaacattccaaacccaagaactccgagcaaaatccgcgaaagaaaaagtagaattatcagatttcgtacgagtcctattactcatgaacaagaaaagaggatatcgatcatcccggaaagccaaaaatgaagatgaaggtcagataatagacggaatgtcagtagcaaagaaactatacgaagaaaacctaaccccaggagaatattcataccaattattaatagaaaataagaaacaactaccagacttttaccggagtgaccttcaaagcgagttcgacagagtatggaaattccaaaaacaatttaatcctgaaatactaacagatgatttatacaaagaattacaaggcaaaaacaaaaatgccacatgggcagttcttaaagagcctttctcacttgtgggaattaaacaaataggaactatacaagagaagaaagcagaaaaatacttttggagatcagaggcagttaaaagacaactagactttgaatccctcgcagtcgtattccaagaaatcaatagtaatctaaataactcatctggatacctcggggcaatatcggatcgaagtaaagagttgtacttcaataaccaaacagttggagaatacctattccaacaattaaaagaaaacagtcataccaaactcaaaaaccaagtattctaccgacaagattacttggacgaatttgagaaaatatgggaaacgcaaagtaaatactacaaagaattaactaaagaactaaaagaagaaatcagagatataataatcttttatcagagaaaacttaaatcacaaaaaggattaatatctatttgcgagttcgaaaatcgcgaaatagaaataaccgaaaacggtaaaatcaaaaagaaaacagtaggcttaaaagttgccccaaaaagtagccccctgtttcaagaatttaaaatatggcaagtcctgaataacttagtatttcaaagcatagaaagtaaagaactctttcccctggacctagacattaaagaatcaatattcaatgaagtcaacatcaaaggaaatctatcggccaaaaacgtcttggatttaatgggatacagtggcaaagaatggaaaacaaatttcaaaaacatagagggcaacagaacgaatgagaacctatacacagcttttctgaaaataatcgcatcagaaggaatagagttcccaaaagaatttaaactatccattgatgatgacataaaagtcagcaaaatagacatatcatcagagaaaataaaagaatttataaaagaaaatttccttaaactgggaataaatacgtcaatactagacttcaacccagaactcgacggaaaagacttcgaaaaacaagaatcctatcaactatggcatctattatacagctacgaaggcgacgattctgctagcggtaatgtaaaactttatgaactcctggaaaagaaatttggctttaaaaaggaacacagtaaaatacttgcagacgtaggatttagcccagactacggatcactaagttctaaagcaatgcgcaaaatctacccatatataaaagaaaataaatattcagacgcttgccaccttgctggttataatcacagtaaaaatagctttacgaaagatcaattagcaaatagaatattgaaagaacaactggaaatattacccaaaaatgcattacgtaaccccgtagtagagaaaatactaaatcagatgataaatttggtaaatgaagtaataaaggcttatggtaaaccagacgaaattagaatagaactagctagagaactaaagaaaaatgcagaagaaagagcaaacatgacttcagatatatcaaaagccacactgctgcatcagaaatacgcagaagttctacagaaagagttcggtatcaaggcacctagtcgaaatgacataataagatacaaactctaccttgaactagagaaaaatttattcaaagatttatataccgacgtacaaataaaacgagaagaattattcacggataaatatgatatcgaccacattataccccaatcacgattctttgacgactctttttcaaacaaagtattagttccacgaggggcaaaccttaagaaaggcaacttcactgccctcgattatatggaaatagaagggaaagaaaaactcgaaaaattcctcaatataataaaagaattatttgataaaggcgccataagtaaagcaaaattcgaaaaattacaaaagaaaggttcagaaatcggagaaggatttatagaacgagatctacgcgatacacaatacattgcgaagaaagcaaaagaaatactattcggaataacaaattcagtcatatctacaagtggaagaataacagacaaactacgagaagactggaatctagtaaacacaatgaaagaattaaatttagaaaaataccgaaaactcggtctaacagaactaattgtgaactctaaaggcgaagaaaaagaaagaatcatagactggacaaaacgtaatgatcacagacatcacgcgatggacgctctaaccgtagcatttacaacacacaaccatatccaatatctaaattatttaaatgctagaaaagatgaaaaacataaagaacaccaaaatatatttgcaatagaaaatactattacagaaattgtcgagaagaaaaacggcagcaaagaacgacggttcaaacttccaatcaaaaactttagaacagaagcaaagaaacaactggaagaggtcttaataagccataaagccaaaaataaggtcgtaaccaaaaacataaacaaaatcaagaagaaaggctcgataatagcaaaaactgagctcacaccacgtggacagttacataaagaaacaatctacggttcctcaaaatttctgaaaactaaagaagagaaaatatcaggcaaatttgacctcgagatgatacaaaaagtacaaaatgaaaaatacagaaacgcgctgcttaaacgattacaagaatttggaggagacagtaagaaagcattcactggtaaaaacgtcataagcaaaaatccaatcttcttaaatgcagagaaaacagaacagcttcccgaaaccgtcaccctagcatggtacgaaacaggatatactatacgaaaagtcgtaaacccggataattttaaagatttcaaaaacattgaaaaagtaatagataaaggcgtacgcgatatactaactgaaagactgaaagagttcaacggaaattccaaagaggctttttccaacctagagaaaaatccaatatggctaaacaaatcaaagggaatcagcataaaaaccgtcacaataactggcataaacaacgccgaagcactacattacaagaaagaccacctaggcaaagaaatacttgatgaaaatggacaacgaatagcagtagattttgtatcaacaggaaacaatcaccacgtagcaatctacgaagacgacaacgggaacctgcaagaaaaagtagtaagtttctacgaagcggtagaacgtgtcaaccagaatttaccaattataaacaaagaatacaacttcgaattaggatggaaatttttgttcacaatgaaacaaaacgaaatgtttttattccctagcgatgacttcgatccaaaagaagtagacctatttgacgataagtacctttccctaataagcaaaaatctcttcagagtacaaagtatatctatagtccaatacggcaatagtgtaataagagatttcaagttccggcaccatctagagacatctgtcagcgacgaaaagaaacttcaaggagtaacataccaacagatcaaatcattacaaccactaaaagacataattaaaataagacttaataatctcggaaagatagtacaaatcggcgaatattga

SEQ ID NO: 5620 - RNA, 4215 nt, synthetic construct
  misc_feature 1..4215: note = Cas9 variant
  source 1..4215: mol_type = other RNA
atgaaagggaacattgagaaaaagaaacaagagttcaacgactactacctcggctttgatataggaaccaactcagtaggatgggctgtaagcgatctaagttataacttactacgatttaataagaaagacatgtggggagccagactcttcgacgaagccaaaacagctaaagaccgaagagtaaaaagaaacagtagaagaagacttgaaagaagatctaaaagattaaaatacctagaagaaatattcgaaacagaaatatgcaaaatagacaaaaacttctttagaagactagaagaatcaacactccacaacgaagacaaaacatttgacttcagattcccaatattcaacgacgaaaactacactgataaagaatactataaagacttcccaacagtgtatcacctcaggaatgaactgatcaaaaatgaaaacaagaaattcgacataagacttatttacctagcaattcacaatatattaaaatatagaggacatttcattttcgaaggacaagatttcgactctgtaacagatttcaaagaagtattctcagaactttctgcgtacctatcagaaaatctagaagaaaatcttgacattaacttatgcgataatattaaagacataatatgctccaaagaaaataaaacgagtaaaggaaaatcgttcgtctcactgatagacagtaaagtaatacaatcagtattaagatgttgcataggataccgagtaaaattcaaagacattttcataaattacgaagaaaaagagaaaaacgaaggaattaacctatcagaaatagaatacgacgaaaaacgagatgaaatcgcactcagcttaggtgaaaatatacttctaatagatatttgtaagaaagtgtatgacttcatgatattgaacaatatactcaaaggaaataaatatataagcgaaagcaaagtcaacttatatgatgaacataaatgtgatctatgtaacctaaaatatatatttaagaaatatctacccaagaaagattatttcgaatttttcagaaacgaaaacaaagagaaaaattatgtttcatacattagcagctcccttaataacggtaaaaagaaaaatacctgcacgcaagaagaccttaacaaagaaataaaagaatatatcgcaaaaataaaagaatacgaagaaaatgatgcagtattagagaaaatcaacttaaaattaaatgaaaataaattacttcctaaactaaaaaccaacgacaatggagtaataccctaccagatccataaaattgaactagagaaaatacttcaaaatcaaagtaaatactatgacttcctactagagaaaatagacggaataacgaacatagaaagaattgaaaaactctttacctttaggattccctactatataggaactctcaaaggaaaattttcatgggcaaaactaaaagaaaataagaaaataaccccctggaactttgagaaaatagtagacatggaagaaagtgccaaagccttcatagaaagaatgtcaaatcgatgctcatacttaaaaacagaaaacgtactacctaaaaactcattattatactccgaatatgaactgctaaatgaactcaacaaagtaaaaatcaaaaatgaatttatcaatgttgtacttaaaaacgaaataatagacgaactattcaaaacaacgtctaaagtcaccaaaaagaaattcgtagattacctcaaaaccaaacaaatattcgtagaaaaagaagatatatccggcttagacaacgaatttaaatctaaactcgattcctacataaaattcaagaaagtcataggagacaaaatagacaccctaagaggttataattttgttgaaaaatgcattgaatttaagtgcttctacggtgacgacaaaaagttattcaaaaatgcaataaataatactgaatttaaagactacgtcagtgatgatgaactaaagaaaataaataaaatgaaattcaacaagtggggaaggctaagtaaaagattactaacagaaatatgcttcgaaaacgtaatagaaagcgaatcattcgaaaacatcatagtagccctacgctcaactaattacaacttcatggagttcaccagtaagaaattcaacctaagtgaaaaggttgccgaagaaaaccaagaaaacacattagaaaaattcaacatcaacgaatacgtagatgaactatacgtctctccatctgtcaaaagatcgataatacaaacgtacaaaatcgcaatggaaatcaagaaaataacaggcaaaaaccccaagaaaatattcatagaaatggctcgaggcggcggcgaaaagggtaagaaaaccgaaaaacgcaaagaaagaataaaaaccctatacgctaacatgaaagacagtaacgaagaatttctcaacaacttagacaatttaaaactctcagtggacaattatgatgacaacagactacgtgaaaagaaactattcctatattttatgcaactaggaaaaagcatgtatacaggcaaaaatattgaccttaatgaactgttattcgcaaacacatacgacatagatcatataataccacaatcaaaactaaaagacgactccttcgataacatagtactcgtcgagaaaacaataaacaaagataaagataatcgagactacttagatgaatcgataagactacgaatgaacaaattttggaactttctgagagaaaaaggcttcatcaccattgaaaaatacaacagactaagaagaaacacttacttcagtgatgacgaactatctggctttatctcacgacaattagtaacaactagacaaagcacattagaagtcaagaaactcttcgagttcatattccaaaacacagacgttgtatgcagcaaagcaaacctagtatcagatttcagagaaaaatatgggataatcaaagtccgagatctaaacgatgcacaccacgcacaagatgcctacctaaatatagtagttggtaatgtattcgatacaaaattcactaaaaattactggaagttcatagaagaccgtcgaaaggtagacaacataagggagacatacaatttcaagaaaatcttcgattatgacgttagccgaggtgaaaacgtagcatggctgaaagactacagcatcaacacaatatctgaaatgataaacaagaaaacagccaacataacacaaatgattacagaaggaaaaggacaacttttcgacctaaccattctaaagaaatccaaaatagacaagaaattaacagtcataccaaatacaccaaaaatattaaaatcatcactaaaagattcatgtaaaatagcagaaaaatatggatatttctcaactcttatgcccgcatacttcgtagtattcaaatacatagataaaaacaaagaagtcttcggcttcgatcgaatcttcatattcgacagagagaaaataaacagtaatgaagatattgaaaaatacctggaggataaaggttacaactcccccaaattcatccggaaagtaaacctcaaacagaaaattttattaaacggatacccatacagaatcgtcggattcactgataacaagctagaaatcaaaaactcaaaacaattttattctgatggagaacaccttaaatacataaaacacttatccgcgttctataataataataataacgtgaaaaatggcgaataccgcatcaacttcttaaagaaaacatccgaaaacgacagaaatgagacgaccgacgaagcaaaagaacgcctcaatatagagttcataaaattatacgagtacttctgtgaacgcctaaactctaaaatctacgccaactattacaattcaaagaaatacgacgaactcatagaagtgttcgactgcttcaaaaacttaaacctactcgacaaagcaaaactcctcttagagttcttaaaaatatttaagaaagatacttacggaaattttaaacttctagaaaaaccagaactagataaaaacggcaagcaaaaactagacaaaaacggcaacttaagtttcgaagggctcagtatggcattcggaaaattaaatggcaagaaatttaaacagctagtagaaaaggatatacagttcgtcgacgagtcagtaacaggtctatttgaaaagaaagaaggactagaaaaatggcaagatggtgaacagtga

SEQ ID NO: 5621 - RNA, 4215 nt, synthetic construct
  misc_feature 1..4215: note = Cas9 variant
  source 1..4215: mol_type = other RNA
atggccaagaaaattctaggactcgacctcggcgttagttcgatagggtgggcaatagtcgaagaagatgcagaaaacgttatgaataataaaatcgtaaaactaggagtaagagttaatcctttaacagtagatgaacaaattaacttcgaaaaaggaaaaccaataacaacaaacgcaggaagaacactcgttagaggtgcaagaagaaatctccaaaggttcaaattgagaagattacacctaattgatatactacagaaaagaaatatcctaaaacaagcagatttactggccgaaagtggcagaaacagcacgttccaaacacaagaaatccgagctaaaagcgcaaaacaaaaagtagaattgagtgaactagcacgagtacttttactaattaacaagaaaagaggatataaaagtagtagaaaagctaaaaatgaagatgaaggccaaatagtagacggcatgagtgtagcaaagaaactttatgaagaaaataccactccgggagaatattcctacgaactactcaaatcaggcaagaaacaactaagcgatttttaccgttcagatctacaagcagaatttgatcgcgtatggaatttccaaaaacaattttaccctgaaatcttttcagataatctatataaagaactccaaggcaaaaacaaaaatgcaacatggaaaatactagaaattccatttagcctcgttggcataaaacaagtaggcacaacccaagagaagaaaatagaaaaatacttctggaggtcagaagcggtaaagaaacaactagattttgagagcttagcggtagtctttcaagaaataaactctaacctaaacaatagtagcggctatctaggcgcaatttccgaccgatcgaaagaattatactttaacaaccaaactgtaggcgaatatctacactgccaactaaaagaaaatccccacacaaaactcaaaaatcaggtgttttatcgacaagattatttagacgagttcgagaaaatctgggaaatacaatcaaaatatcacaccgtcctgactaaagaactcaaagaagaaataagagatgtaattatattttaccaaagaaaactaaaatcccaaaaaggtttaatatcaatatgcgaatttgaaaatcgggaaatcgaaataacagaaaacggtaaaatcaaaaagaaagaagtcggactcaaagtagcaccaaaatcttcactactcttccaagaatttaaaatatggcaagttctcaacaacctacaattccaaaacatagaaagtaaagaaatttttcccctagacctagactgtaaagaaagcatttttaacgaagtaaatataaaaggtagaataagcgcaaaagcagtcctagacgtattaggatactcggggaaagaatggaaaaccaattttaaagacatagaaggaaataattcaaacgaaaacctatataacgcctatctaaaaataattgcaaacgaaggaatagaatttccaaaagagttcaaatgcaatctagatgacgatatcaatgtgtccaaaataatttgcagcgctggaaaaataattgagttcgtaagggaaaaattctccgagctgggcatcaacaccagtatattagactttaattcagaactagaaggaacaaatttcgaaaaacagaaaagttatcagttatggcacttgttatatagttatgatggagatgattcacccagcggcaatcaaaaattatacgaattgttggagaagaaatttggattcaaaaaggaacactccataattctagccgatatcggattcccccaagaatacgggtcacttagtaccaaagcaatgcgaaaaataataccccatctaaaaacaggattaccattcgccaagaaatcggataatgatacaatactttcggcgactgcgatggcgggatacaatcactcaaaatcactgacaactgaagaactaaccaagcgagtacttaaagaacaccttgaaattttacccaaaaactctctacgtaatccggtagtagagaaaatactaaatcagatgattaacgttgtaaatgaagtcataaaagaatatggaaaaccggatgaaatcagaatagaactagcaagagaactcaagaaaaacgcagaagaaagagcaaacatgacaagtgaaataggaaaagccaccattcaacaccaaaaatacagtgagatattacaaaaagagttcggaatcaagagtccatcgagaaatgacatcataaggtacaagttatatctcgaactttcgaacaacggattcaaagacctatatacagatatacaaataaaaagggaagaactcttcacagacaaatatgatatagatcacataatcccacaaagtcgatttttcgatgattcatttagtaataaggtcctagtaccaagaggggcaaacttgaagaaaggaaaccttacagcgttcgattatctcgaatccgaaggcaaagacacgttagaaaaattcataaataccataacggagttctatgataaaggcattatcacaaaagccaaatatgaaaaactacagaagaaaggtacagaaatcggagacggatttatagaaagggacttaagggatactcaatacattgctaagaaagcgaaagaaatactattcggcataacaaacagtgtagtttccacatccggaagaataacagataaactcagagaagattggaacctagtcaacacgatgaaagaaatgaacctcgaaaaatataggaaacgtggactaactgaaactgttataaatagcaagggcgaagaaaaggagaaaataatcgattggagtaagagaaatgatcacagacatcacgctatggatgccctaacagtcgcattcacaacacacaaccacatacagtatttaaactatttaaatgcaaggaaaaatgaagatcacaaacaacacaaagtaatatccaatatagaaaacttaatcacaaaagtttttgagaaaaagaatggatcaaaacaacgaaggtttttagaaccaatacacaatttcagaatcgacgcgaagaaacatctagaagaaatcctaatatcacataaagccaaaaacaaagtcgtaaccaaaaatataaacaaaatcaaaaagaaagggtctataatagcaaaaattgaactaactccaagaggccagctccataaagaaacaatctatggcagctcaaaatacctaaagacaaaagatgaaaaattgtcaggaaaattcgatctagaaaccataaacaaagtccaaaatgaaagatacaagaacgcactactcgaacgtctaaaagtatttggttacgattctaagaaagccttcaccggcaaaaacatcctagctaaaaacccaattttcttaaatatcgaaaagacagaacaacttccagaagttcttactttagcatggtatgaaacaatatataccatacggaaaagtattaacagcgataatttcaaagactacaaaaatatcgacaaagtaacagataaaaaggtgcataacatactcacagacagactacgagaatttaacggaaattcaaaagaagcattcagcgatctagagaaaaatccgatctggttaaataaaccaaaaggaatagcaataaagaccgtaacaataacaggcgtcaacaatgtcgaagcattacattacaagaaagaccactttggaaaagagttcctcgatgaaaaagggcataaaataccagttgactttgtctccactggaaacaatcaccacgtagctatttacgaagatacggccggaaatttacaagaacgggtactttccttttatgaagcagttgaacgagtaaaccaaggattatcggtaatagataaagaatataatagtagtctaggatggaaatttttatttacaatgaaacaaaatgaaatgtttctatttcacagcgaagacttcaacccacaagaaatagacctatatgacgagaaaaacctaagactcataagcaagaacctatttagagtccaaaaattcacagtaaaagactactttttcagacatcacctagaaacaaacgtggaagataattctaaactcaaaggagatacctggaagcgagaaggcctaaacggaatacgcggcatattgaaagtacgcctaaaccatttaggaaaaatagtacaagtaggagagtattga

SEQ ID NO: 5622 - RNA, 4215 nt, synthetic construct
  misc_feature 1..4215: note = Cas9 variant
  source 1..4215: mol_type = other RNA
atgagcaagaaaatattaggactggacctcggcacaacaagcataggatgggcgtttgtacgcgaagcagaagattttcaagaagaatcatctatagaacgtataggagtaagagttaacccgctcactacagacgaacaaataaatttcgaaaaaggaaaacccatttcagtaaatgcagatagaacgctcaaaagaggagcacgtcgcaaccttcaacgatataaacaaagaagaacaaaccttatccaactattaaaacaatataaaataataaatgaaaatactatactagcagaagacgacaaaaatacgacgcacagcacatacgcgttacgggcaaaagcagtcagcgagaaaattagcaaagaagcattcgctagagtcctgttaatgataaataagaaaagagggtacaaaagcagtagaaaagctaaaaatgaagacgaaggacaagccatcgacggaatgtcagttgccaaacgattatatgaagaagacataacaccaggacaattatgcctacaactactaaaagaaggcaaaaagaaactgcctgacttttatctaagtgatttacaagcggaactcgagaaaatatggaactttcaaaagaaattttacccagaaattctaacagacgaatttaagaaagaaattgaaggtaaaggacaaagagctacatctgccagtttctgggcaaaatacaaattcaacacagcggaaaataaaggctcacgcgatgagaagaaaatgcaagcctgggaatggcgaagcaaagccataaacacacaactaacaagagaagaagtagcatatgttataacagaaatcaataacaatatcaataattcctcggggtacttaggagccatctcagaccgatcaaaagaattatacttcaataaagaaactgtaggagaatacttattccgacaattacgctattcaccccacacgagagtcaaaaatcaggtattctacagacaagattacttagacgagttcgaaactatatgggaaaatcaatcaagatatcataatgagctcacaaacgaactcaaatctgaaatacgagacgtcgtgatattctatcaaagaaaactaaaaagtcaaaaaggacttatatcattctgcgaatttgaatcaaaacaaatcgaaatccagaaagacggaaaaatagtaaagaaaataataggactaaaagtctcgccgaaatcaagccccctgttccaagagttcaaaatatggcagatactacagaatttagagttcacaaataaagaaactaaagagaagaaagtaccagatttcgaagcgaaaaatctgttattcgaagaattaaatataaaaggaaacctaaaaggcgaaaaagccatagaaatattgggctacaaaccaaaagaatggctcgtcaactataaagaattagatggaaacaggactaatcaagtactatacgaaggttacttaaaaatactcgaagtcgaaggttacgacataaaagacttattgaaaataaaatccaacaaagatgaagttaatttatctgaactcagtaaaccagtatccgagataaaagacctaattaaaagcatattcgaatctctgaatatcaacacagcaatattggatttcaatcccgaattagaaggtaaagactttgaacgacaggcttcatatcaactatggcacttactgtactcttacgaaggtgacaattccaacactggaaacgacgagttataccgcttattatatcagaaattcggcttcgggaaagaacacgcacaaatacttgctaacctatcattttcccaagattatggctcactctcagccaaagcaatgagaaaaatatacccatttataaaagaaaattcctactcagaagcatgttcactcgctggatataatcacagcagcagtataactaaagaggaaaatgacaaacgcgaattaaaagaaaaattagagttactccccaaaaattcactgagaaaccccgttgtagagaaaattctaaaccaaatggtaaatgtaataaatgcaattatagccgaccctagcatgggcaggccagatgaaataagaatagaactggcccgagaactaaagaaaaatgcagccgaaagagcagagatgacaatacatatcaacaaagcaaaaagtgagcacgataattaccggaaaatcctaacgacggagtttggaatacccaatccaacacgaaatgacattatacgctacaaattgtatgaggaattaaaagtaaatggatataaaacattatacagcaatacatatatccccagggaaaaattattttcaaaagaatttgatgtagaacatatcataccgaaagcacttctatttgatgattcatttagtaataaaacaatatgcgcaagacaagaaaacctagacaaaggcaataaaacagcatttgactttatccagtctttctacggtaaagaaaaatttgaagagtacttacaacgaatagaaagtctagctaaaattaaagaaggagatacatttgtaataagtaaagcaaaatacaagaaattattacttccagaaatagagataggcgagggattcatagaacgcgacctaagaaactcacaatatatcgctaagaaagcaaaaagcatgcttctagatatttgcaaaacagttgttccgactactggtagtataacagacagacttcgagaagactggggattaataaatattatgcaagaactaaattttgagaaatacaagaaacttggacttatagaaatggtagagaagaaagatggaagtttcaaagaacgaataacagattggacaaaacggaacgatcaccgacatcacgcaatggatgcactaactgtagctttcaccaaacacaatcatatccaatatttaaactacttaaatgctaggaaaaacgaaaaccataaaatgcacggtaacgtaatagccatagaacaaaaagaaactgaattactggtagacagtgtaggcaaacgtaaacgaaaattcaaattaccgataagtaatttccgtgaggtagcaaaaatgcatctagaaaatatcctagtatcatataaagccaaaaataaagttgctaccaaaaataaaaacagattcaaaaccaaaaacggtgaaaaagtaaaaatagaattaactccacggggccagttacacaaagaaacggtctatggtaaaatgaagaaatacgaaactaaagaagagataataggatcaaaattcgacgaggcaaccatactaaaagtagcaaatttagagcaaagaaacgcactcctacaacgtttgaaagaaaacaataatgatcctaagaaagcattttccggaaagaacagcctaaaatctaacccgctttactatggagtagattcaaaaccaataccagaaagaataaaaatagtatggctcgaagacgattacacaatacgaaaagagattacaccagatctgaaaatagataaagttatcgatattggaataagacgaatactagaaaacagactagcagaatttaatggaaacgcaaaagaagcgttcagtaacctagagaaaaaccccatatggttaaacgaaggtaaaagaattgccataaaaagagttacaatatcaggagttaaaaacgcagaaacattacactataaaaaggatcatcttggacatgaaatgcttgacaaacaagggaaaagaatacctgtcgacttcgttagtacgggtaataaccatcatgtagcgatatacaaagatgataaaagcgaccttcaagaaaaagttgtatccttttatgaagccgtagaacgaatcaaccaagaactacccataatcgataaaagtttcaaccatgacctaggttggcaattcctatttaccatgaaacaaaacgaatacttcgtgttccctcgcgatggattcgacccgtacgaaatagatttactaaatccagacaattataaaataatatcacccaacttattcagggtacagaaaatagccacgaaaaactacgttttcaatcaccacctagaaactaaagcagtcgacggggaactactaaaaacgaagaaagatttaagcgatataacatataggtttatacaaacaccagtaaatttgaaaaatataataaaggtacggataaaccatataggacaaatagtgaaaataggagaatattga

SEQ ID NO: 5623 - RNA, 4218 nt, synthetic construct
  misc_feature 1..4218: note = Cas9 variant
  source 1..4218: mol_type = other RNA
atgaaaaccattctaggactagacctagggacaaatagcataggatgggccctagttaaagaagcagaaaatagcaacgaaaaatcagaaataataaaattaggtgtgagagttaatccactgactgtagacgagaaaactaacttcgaagccggaagacccttaagcacaaatgccgatcgaacggccaaaagatcagcacgtcgtaacctccaaagatacaaactacggaggaaaaatcttatagatttactaatcaaaaatcaactaatcgacaaagatactccactaaccgaaataggcaaaaatacaacacatcaaacacttgaattaagagccaaagcagcacgagaacgcatagaactagaagacctagcacgagtatttctagctatcaataagaaaaggggatatcgatcctctagaaaagtcaataacgaagaagaaggtcaagcagtagacggcatggcagtagctaagaaactgtatgacgaaaatttaacaccaggacaatacgcatacgaactattatctaaaggcaagaaatatgtgcctgatttctacaggagtgatctccaagctgagttcaacgcaatatgggaataccaaaaacaattttatgcagatattctagacgatgaattgtacaacgcattaaaaggacaaggacaacaaaatagtagaaaaagattcctagcaattaaaggagtatacactgccgaaaataaaggaaaacgcgatgacgttaaattgagacactataaatggagatctgaagcaataagcaagaaaattaacattgaagaagtagcatacgtcttagtggaaataaataacgatttaaataaatcaagcggatatctaggcgcaatctctgataggagtaaagaactttacttcaacaaagaaaccgtaggtgaaaacttatggaaacaaatacagaaaaacccacacacatctcttaaaaaccaagtcttctaccggcaagattatctagatgaatttgaacaaatatgggaaactcaagcacaatttcacccacaattaacactagcattaaaagaacaaataagagatgttataattttctaccaacgaaaactaaaaagtcaaaaaggactattaagtttctgccaatttgaatcatgggaaatagaaagaaaagacgaaaacgggaatgtaatattaaacaaaacaactcaactgccaaaaagacaaaccgttggaagaagagtagcacccaaaagctcaccgctgtttcaagaatttaaaatttggcaaaacatcaataatctagaagtgactaaaatatccgaaggagctagcaaaaacaagaaagaaacggaaacattatcagatgacgaacgaaaacttttattcgaagaactcaacttaagaggtaatctatctcaaaaagaagtactacaaattttggggcttaaagacaaagagtacaaaacaaacttcagcgaaggtctagaaggaaatagaacaaatgctgcactattcaacatataccaacaaatagctgaaaatgaaggctatggtttcgattggtcaaagaaatcagcacaagaaatcaaagaagaacttaaagcagtctttcctcaaataggtatacaagcagacatactcgactttaatgctaatctagacggaaaagagttcgagaaccaagcctcatatcaactatggcacttactatactcagcggaagaggacgataaaatcaacgaggaagaccaaataatatatggcaatagtgcagtgagtctcaaaaagaaattatgtgaaaagtttggcttcacaccggaatacgctaaatggatagcaaatgtatccttacaagatgactatggtaatctatccacaaaagcaatgagaaaaataatcccatacttaatagacggaaacgattattcagaggcatgcgcattagctggatacaaccacagcaactccttaacaaaagaagaaaatgataatcgagaattactagacaaattggaactactacccaaaaattctctaagaaatcctgttgtcgagaaaatccttaaccaaatggtaaatgtagtaaatcaagtgattgaaacatacggcaagccagacgaagtcaggatagaactggcacgagaattaaagaaaagcgccgagaaaagagcagaaatgaccaaatctataaatgaagcaactaggagaaacgaagacataaagaaactaataacaaaagattttggaataccaaacccaacgaaaagcgatgtagtgcgatatcgattatgggaagaactagctccactagcatacaaagatgtcttcacaggcaaacagataaagaaagaagatttattcagcagcaaaattgacatcgaacacatcataccaaaagcattgctattcgatgacagcttttcaaataagacattagtttttcgcgaaacaaacctaaagaaagctgacagaacagcgtatgattttattgaatctgactataatgcaacactagatgactatatacaaagagtggaaacactatacaacaataccaaaggcactataagcaagggaaaaagaaacaaactattaatggcccagaaaaaccttccagacggattcatagaacgtgacttaaggaatagccaatacatcgccaaaaaggcaaaagcaatgctatatcaagtattcaaagatgtcaacgttacaagtgggtcgattacagatagactacgggaagattgggatcttatcaatgtaatgaaggagttgaactttcccaagtacaaagcattaggacttactgaaattgaagaacgttacgatatcgggcaggagaaaacaaaacgcgtcgaggtaatcacagattggacgaagagaaatgaccatagacatcatgcaatgaacgcactaacggtagccttcaccacatcttcccacatccaatacttaaattatctaaatgctaggaaaaatgaaagccacaaggaacataaaaacatcaaaggaatagaaaacaaaataacccacaagcaaaaagataaaagaaaatttataccaccaatgccaaatttcagagaagaagccaagaaacacatagaaaccattcttgtgagcatcaaaaacaagaacaaagtttatacgaagaacataaacaaaactaagaagaaaagcggacataacacaaaagaacaattaactccacgaggccaattacataaagaaacagtttacggtaaatcaaagcgccctatgagtaaaccaactaagataaacaaaaattttagcctagaacaagcccaattaataataaacgttcaagaaaaagagttagtacttcgacacctagctcagtttgataacaatcctgctgttgcatttgacacgaagacattaaagaaaatgccactgctgaaaaatggggaaccactaaaagaggttctttgttttgaggaaattttcactataagaaaagatataacacccgacctgaaaatagagaaagtcgtagacgagaaaataaaagcaattttagaacaaaggaagaaagattttggcggaaatgcaaaagaagcattttccgacctagataaaaacccaatatggttaaacaagaagaaagggatatgcatcaaacgtgttactataacaggcgtatccaatgccgaagcactacaccatcaaaaagaccatttaggacgagaaattctagacgataacggtaatcccattcccgcagactttgtatcaacgggtaacaatcatcacttggcagtctatctggattcggaaggcaaactacaagataacatcgtgtcattctatgaagcggtagttagaacatcacagggtttaccagtagtagacaaagggttaaacaaagatctaggatggaagttcttattcagtctgaaacaaaacgaaatgttcgtttttcctaacgacgattttgacatcaacgactttgacttattagatgacaagaaagcagaactcatttcaaaacatttatacagagtacagaaaatatctaaagtttcagccggaaacagtttcgtccgagatatcgtattcagacatcatttagaaacaacagtcaaagaagtaaaagaattaaaagacattagttatatacaactaaaatccttagaaggattaagaaatattaagaaagtacgtataaatcacataggcaaaatagtacaagtaggagaatattga

SEQ ID NO: 5624 - RNA, 4221 nt, synthetic construct
  misc_feature 1..4221: note = Cas9 variant
  source 1..4221: mol_type = other RNA
atggaaaagaaaataattggaatagatttaggggtcacgtctatcggttgggcatatgtaattgaggatgaaaacggccattccagaatcttgagaatcggcactagagtaaacccattaacaacagaagaactcaaaaattttgaacaaggaaaaccgattacagaaacggcagaaagaactctaaagagaagtatgagacgaaacctacaaagatacaaacagagaaggacaaacttaatcaacgttctcctgaaaaacaaactaataactgaaacgactgcactcgcggaagacggtaaaggcacaacacatctaacacacgcactacgcgccaaagcagcatacgcccaaattcctctagaagatttcgcacgagttctattgatgttaaacaagaaaagaggatatcggagctccagaaaagtcaaaacggaggcagatggtcaagctatagacggtatggcagtagcaaagaaactctacgaagaaaatataacacctggacaactatgctacactctactactacaggggaagaaaaccttaccggatttctatagatctgatctccaagtagaaatggaaaaagtatggacgtttcagaaacaatttcaccaagcaatcttaaccgacgaatttcgtaaatatatagccggaaaaggacaacgagcaaccgccgcatccttttggggaaaatatggatttaatacggctgagttcaaaggtagcagagaagaaaagaaactaaaaagctatgaatggagatcacaagccattacaactcccttatctcaagaagaagtcgcagccgtaataactgatataaatagcaatatagcgaacagtagcgggtatttgggcgcaatatccgacaggagtaaagaactcttctttaacaaacaaacagtcggacaatatcaatacaatttgctgcaacaaaatcctcatacaaacttatcaggtcaagtattttacagacaagactatttagacgagttcgaaactatatgggaaacacaagcgactttccacaccatgctaacgccttcccttaaagaagaaatcagagacatagttatattttaccaaagaaaactaaaatctcaaaagaaacttgtcagcatatgtgaatttgaaaaacgtattttagaaccccttcaaggcgacaaagtagtaggctacaaagtggctcccaaaagttcaccgttattccaagagttcaaaatttggcaggctttaggacgaatggaaatccaacacaaagtaacaaaagaaagacacttcctagatctagatgcaaaacaattattatttgatgaactaaacgtaaaaggagatcttacgaaagaaaacgctttaacgatattgggatttaaaccaaaagaatgggaatgcaacctactaaaattggaagggaacagaaccaatcaagccctttacgaggcttatctcaaaattctcgaactagaaggctacgaggttaaagatctgttagggttaaaacttgataaagacgatataaaattatcagaactaccagtagacgcagcagacatcaagaaaatggtacgagaaatattcgaaactcttaatatcaaaactagcttactagactttaatgctactctaccaggtaaaagttttgaacaacagcacgcctaccaattatggcacttactatacagttatgaaggagacaattcaccaagtgggaataagaaactgcaagatctcctacaggcaaaatttggcttcacaaatgcacacgggcaaatacttgcaaacgtatcattagaaactgattatggttcattatcagcaaaagcaatacgcaaaatctttacacatattaaagaaaatcactattcggcagcttgcgcattagccggctacaaccattctagttacctttccaaagaagaaaacgagcaaagaatcctaaaagatcgtctgacaattttacccaaaaactcgctaagaaatccagtcgtagagaaaattttaaatcaattaataaatctacttaataccatattcgatgacccctatctaggcaaacccgatgaaatcagaatcgaattggcacgagaactgaagaaaaacgtacaagaaagacaacgactaaacacagaaataaccaaaaacaatacagaacatgaaagaataacaaaaatattaattaaagaagataatatcaaaaacccaacaagaaatgacataatacgatataaattataccaagaattgaaacataacggatacaaaaccctatatagtaatacctacataccaagagaggaactctttggcaaaaactttgatatcgaacacataataccacaatccatcttattcgacgattccttctccaataaaacattgtgcgtcagaaaagagaatatcgataaagcagaccgtactgcaatggatttcataggaccatattttggagaagataaagtgcaagaatatataaatcgggtagaaatgcttcaccaaataaacctcaaaaacccagaagaaggcattgggaaaggaaaatacaagaaacttttaatgaaagcaagcgaaataggacaaggatttattgagagggacctaagagatactcaatacattgcgaagaaagctagacaaatgttattagaagtcacaagaaccgtggtggcaaccacaggttcaataacaaaacgattaagagaggactggggactggtcaacgtaatgcaagagctaaacatggacaaatatcgacaacaaggcttaacggaacttattgaaaagaaagacggtagcacaaaagaacgcattacagattggacaaaacgaaacgatcatagacatcatgctatggatgcactaactatagcatttacgaaacattcacatatacaatatttaaacaatttgaatgcacgaaaaagtgatgacaagaaaggaaaagaaattttcggaatagaacaaaaagaaacagaaaaagtcaaagacgatactggacaaacccagagaagatttaaactccccatgcctgactttcgacaagcagcaaaacaccacctagaacatttattaatctccttcaaagccaaaaataaagtatttaccaaaaacaaaaacaaatataaaacgaaaaatggagaacaagttaaacttgaattaacacctcgaggccagctacataaagaaacaatatacggtcgtattaagaaatatgtaacacacgaagaaaaagtatcaagtaaatttaacgcacagctcattcaaacagtagcaaactctaaatacagatacgcgctgttaaaacgccttgaagaaaatggaaatgacccaaagaaagcattcacaggcaaaaacagtctagacaaaactccactctttgtagatgctacccaacaagagaaaattccaccagtcgtcaaacttgtatctattgagcaaggatatacaatccgaaaagatataacgccagagaactttaaagacgcaaaaagtatagagaaaatagtagatgtaggaataaggaaccttctacaccataggttagaaacatataacggcaacgaaaaagaagcattctacaacctagataaaaatcccatatgggtcaatgaatcaaaaggaatatgcataaaacgagttacaataacaggcgtgacaaacgctgaaccactacattacaaaagagaccaccatggaaaaccgatactcgataataatggaaacagaacaccagcggattttgtctcaacaggaaacaatcatcacgccgccatatatagagacgccgcaggaaatctacaagataacgtcgtttcattttatgaagctgtggcacgagtaaatcaaggcctccccatcattgataaatccttaaacaaagaacttggatggcagttcttattctctctgaaacagaacgaatgttttgttttcccaaatgaaggcttcgacccactagaaatagatctctacaatccagctaataacaaactaatagctgcaaacttatttcgagtacaaaatttctcacgattacaatacggaaataatattatcagggattacaattttagacatatatatgaaacatctgtggaaaatcgaaaagaactaaaagacatcgcatacaaacaagtcaaatcacttcctatcttcgagaaaataataaaagtaagaataaaccatatcggccaaatagtcaaaacgggcgaatactga

SEQ ID NO: 5625 - RNA, 4224 nt, synthetic construct
  misc_feature 1..4224: note = Cas9 variant
  source 1..4224: mol_type = other RNA
atgataagaaacatactaggacttgatttaggagtgtcatctattggttgggcttatgtgcaagaagacagtaaaaattcagaaaacaatcgtataataaaactaggagtaagagttaaccctctaactgtagatgaacaacttaattttgaaaaaggcaaaccaatcacaacgaatgctggaagaacacttgcacgatccgcccgccgaaacttacaaagatttaaattaagaagatctaacctaatggacgtacttaagaaaaacaacatattgaaagaaacagatttactggcagaagtaggtaaaaattcaactttccagacacaagaactacgagcaaaatctgcaaaagagaaaattgaattatcagaatttgccagagtgttattattaatcaataagaaaaggggttataaatcatcaaggaaagctaaaaacgatgaagatggtcaaattgtagacggaatggctgtagctaagaaattattcgaagaaaacttaacacctggcgaatattcataccaactgctacaacaaggcaagaaacaactaccggatttctacaggagtgatctacaagcagaatttgacaaaatttgggacttccaaaaacagttcaatccagaaatatttacaaatgaattatacgaaaaattacaaggcaaaaatagaaatgctacatggaaagaactagagttcccattctcattagttggcataaaacagacaggaacaatgcaagagaagaaagtagagaaatatttctggaggtccgaagccgtgaagaaacaactcgacttcgaaagcctagcagtagtatttcaagaaattaacagcaatttaaacaactcatcagggtatcttggtgcaataagtgacagatcaaaagaattatacttctataaccaaacagtaggggaatacctcttccaacaacttaaaacaaacccacatacaaaacttaaaaaccaagtcttctacagacaagactatctagacgagttcgagaaaatctgggaaacacaaagtaaataccacaaagaactaacaaaagaactaaaagaagaaatccgagacataactatattctaccaaagaaaactaaaatcacaaaaaggactaattagtatctgcgagttcgagaatcgagagatcgaaatcacagaaaatggaaaaaccaaaaagaaaacagtaggactaaaagttgcaccaaaatcctcccctcttttccaagagttcaaaatctggcaggtattaaacaatttacaattccaaaacatcgaaacaaaagaagtgttcccaatagatttagattttaaacaaagcatattcgacgaagtcaatataaaaggcaaactaagcgctaaagacgtacttgacttagtaggctactcaggaaaagagtggaaaacaaactttaaagaaatagaagggaattacacgaacgaaaacttatacacggccttcttaaaaataatagcatctaaagaaattgaatttcccaaagaatttaaaatcacaatagatgatgaaataaaagtatcaaaaataaacgcaagtgccgaaataattaaattattcgtgcgagaaaaattctccgaactaggtatagacacgagcatactagattttaatcctgaattagaaggaagtgattttgaaaaacaagcctcataccagttatggcatctactatactcatacgaaggtgacgactcaagttcaggtaacgaaaaattatatgaactactcgaaaataaattcggatttaagaaagaaaattctaaaattttagccgaaataggcttctcacaagactacgggagcttatctagcaaagccatgagaaaaatatacccttacataaaagagcataaatattcagtcgcatgcagctatgctggttacaaccattcgaaaaattcactcacaaaagaacaacttgaaaaccgaatactcaaagaaagactggacattctacccaaaaactctctaagaaacccggtcgtagagaaaatcctaaaccaaatgatcaacttagtaaattgtctcatagatgaatatagcgaaaaagataaagatggacagatcgtcaaatatttcaaatttgatgaaataagaatagaactagcaagagaactcaaacttaacgcggaagaaagagcgaccatgacctcagaaattaacaaagcaaccatacaacaccagaaatacgctgaagtcctccaaagagaatttggccttaaagcgccctcgcgaaacgacataataaggtataaattatatctagaactagccaacaatggatttaaagatctctatacagacgcaaaaattgaaagagaaaacttattcaccgacaaatacgatatcgatcatataataccccaaagcagatttttcgatgactctttctcaaacaaagtattagtaccaagaaatgcaaatctcaagaaaggtaacttcaccgccttcgactacctagaaatagaaggaaaagaaaaactagaaaaattcctcaacataattaaagacctctatgataaaggagcaatcacaaaggcgaaatatgaaaaacttcagaagaaagattttgaaatcggagacggatttatagaacgagacctacgcaatacacaatatatagccaagaaatctaaagagatcttattcggaatcactaactccgtagtaacaacctccggccgtataaccgataaactgagagaagattggaatttaataaacactatgaaagaactaaatctagaaaaatacagaaagctcggcttaacagaaactgtaataaactcaaaaggtgaagaaaaacaaagaataattgactggacgaaacgaaacgatcacaggcatcacgctatggacgcgctaacagtagctttcacaacccataaccatatacagtatctaaattacctaaacgcacgaaaagatgaaaaacacaaagaacatcaaaatatctttgcaattgagaatctaattaccgagataatcgataagaaaaacggatccaaagagcgaagatttaaagagccagtaaagaacctaagagccgaagcgcgtaaacatttagacgaaattctaataagtcacaaagtcaaaaacaaagtggtcaccaaaaatataaataagatcaaaaagaaaggctcagtaatagcaaaaacagaactcacccccagaggacaactccacaaagaaacaatatatggttcatctaaattcctcaaaacaaaagaagagaaaatctctggaaaattcgacgttgaaacaattcaaaaagtacaaaacgagaggtaccggaacgctttactcaaaagactacaagagttcggtggcgatagcaagaaagcctttactggtaaaaacgtaatcagtaagaaccctatattcttaaataatgagaaaacggaacaacttccagaaacagtaactctggcttggtacgaaatgggatatacaatcagaaaggcagtaaatcccgacaattttaaagatttcaaaaacattgagaaaaccatagacaaaggaataagagacatactaaccaaacgactgaaagagtttaacggaaacagcaaagaagcattctcagacttagacaaaaaccctatatggttgaacaaatcaaaaggaataagtataaaggcagttacaataacgggcataaacaatgcagaagcgttgcattataagaaagaccacctaggaaaagatttcctcgatgaaaacggaaaaagaatagccgtcgattttgtttcgacaggtaacaatcaccacgttgctatatatgaagacgaaaacggaaatctccaagaaaaagttgtatccttctacgaagcagtagagagggtaaaccaaaacttgcccataatcgataaagagtataactcagaatcaggctggaaattccttttcaccatgaaacaaaacgaaatgttcctcttcccgagtgaagacttcaatcctaaggaaatggatctattcgacgagaaaaacgtaaacctaattagcaaaaacttattcagagttcaaaagtttacaatcaaagactacttctttagacatcatttagagacaaatgtagaggactccagcccacttaaaggaataacgtggaaaagagaaggattaaatggaatcgaaaatatactaaaagtaagactcaaccatttaggaaaaatcgtgcaaataggtgaatactga

SEQ ID NO: 5626 - RNA, 4227 nt, synthetic construct
  misc_feature 1..4227: note = Cas9 variant
  source 1..4227: mol_type = other RNA
atgacaaaaaatattttaggtctagacgtgggcgtgagtagtatagggtgggcactaataaacgaagacatcgaaaatcctaaaaataataaaataatcaaactaggcgtgagagtgaatccactaaccgttgacgaacaaataaatttcgaaaaaggtaagccaataactacaaatgctggtagaaccctcgcaaggggggcacgacggaatttgcaacgctttaagctcagaagattccatctaattgatatactacaaaaaaacaatattctaaaacaagcagacctcctagccgaagtgggaaaaaattctacattccaaacacaagaaataagagcaaaatcagccaaacaaaaagtcgaactaagcgaactagcaagaattttcctactaataaacaaaaaaaggggatacaaatctagccgaaaggctaaaaacgaagacgaaggacaaataatagacggtatgttcatagctaagaaactatacgacgaaaaactaacccccggtgaatacagctaccaactgttgaaagaaagcaagaaacagttaccagacttctatagatccgatctacaaagtgaatttgacaaaatatggaacttccaaaaacaattctatcctgagaacttctctgacaacctctacaaagaactacaaggtaaaaataaaaacgccacatggaaaacacttgaaatcccatttagtctagtgggaataaaacaaaccggtactcttcaagaaaagaaacttgaaaaatactcttggcgaagcgacgcggtaaaaaaacaactcgattacgaaaaactagccgtagtcttccaagagataaattcaaatatctataacagctcaggatacttaggtgcaatatctgatcgctcgaaagaactttatttcaataatcaaacggtgggtgaatacctctataaccaaataaaagaaaacccacataccaaattgaaaaaccaagtattttacagacaagactacttagacgaattcgaaaaaatatgggaaactcaatcaaaatatcacacaactctgaccaaggaattaaaagaagaaataagagatattataattttctaccaaaggaaactaaaaagtcaaaaaggacttataagcatttgcgagttcgaaaatagggagatcgaaataaaggaaaacggtaaaatcaaaaaaaaaaccgttggtctcaaagttgcacccaaatcatcgccactattccaagagtttaaaatatggcagatattaaacaatctacaatttcagaatattgaaagcaaggagatatttcccatagacttagacttcaaggaaagcatatttaacgaagtaaatattaaaggaagaatatcggctaaagcagttcttgacctactaggttattcgggaaaagaatggaatccgaactttaaagacatagaaggaaacaacacaaatgaaaacctctataacgcttatctaaaaatcatagcagacgaagaattcgagctaccaaaagaatttaaattaaacggcgacgatgacctctacgtctcaaagatagcatgcagcgcatctaaaataaaagatttcgtaaaagaaaagttctcggaaataggaatcaatacgtcgatactggacttcaatccagagttagagggcaaagactttgaaaaacaagcatcatatcaattctggcacttactatattcttatgaaggcgatgactcccaatcaggaaacgaaaaattatacgagcttttggaaaaaaaatttggatttaagaaagaacactcaaaaattctaagtaacataggctttcccctagattatgggaacttgtcaacgaaagcaatgcgtaaaatcataccacatttgaaagcaggcctatcgtttgctaaaaaaagcaaagaagataatatactctcagcaaccgcaatggcaggatataaccactcaaacagttacacaaaagaagatctagctaaaagagtactaaaagagaaattagaagttttcccgaaaaactcactcagaaaccccgtcgtagaaaaaatactgaaccaaatgataaacctagtaaacgaagcagttgaagagtacgggacaatagacgaagtgagaatcgaactagccagagaactaaaaaaaaacgccgaagagagagccaatatgacatcagaaatagggaaagccacactgttgcaccaaaaatacgcagagatattaaaaaaagaattcgacatccctgtacctagcaggaacgacataatacgatacaaactgtatctagagctcgcaaataacggctataaagatttatatacagacgttcaaataaaaagggaagaactatttaccaataagtacgacatagatcacataataccacaaagccgctttttcgatgacagcttttcgaataaagtcctagttccaagaggagcaaacctgaaaaaagccaaccaaaccgcctttgactatctagagaacgaagacaaacaaaaattagagaaatttttaaacatcattaaaaatctatatgataaaggagaaataacaaaagcgaaatacgaaaaattacaaaaaaagggaagtgacataggtgaaggcttcatagaaagagatctgagagacactcaatacatagcaaagaaagctaaagaaatactgttcggtatcacccacagtgtaatctcgacctcaggcaaaatcaccgacaaattgagagaagactggaacctagttaatacaatgaaagagctaaacttagacaaatataaaaaacttggattgacagaaactctactcaattcgaaaggggaagaaaaagaaagaattatcgactggagcaaaagaaacgaccatcggcatcatgctatggatgcactaacagttgcttttaccacacataaccacattcaatatttaaactaccttaatgccaggaaagacgaagaccacaaacaacacaaggtaatatctaacatagaaaacctaatcactaaagtattcgaaaaaaaaaatggtgcaaagcaacgacgattcattgaacccataaataactttagagtagatgctaaaaaacatctagacgaaatattaataagtcacaaagcaaagaacaaagttgtaacgaagaatataaataaaataaaaaaaaaaggttccgtagtggccaaaactgaactcacgcccagaggacaactacacaaagaaacaatatacggaagctcgaaattcctaaaaacaaaagatgagaaaatatcaggcaaattcgatctcgaaacaataaacaaagttcaaaacgaaaaatataaaaatgcattattacaaagactacgagaattcggtgaagacagcaaaaaagcatttaccggaaaaaacgttataagcaaaaatccaatctatctagacgaggaaaagaccctacaaataccagaatctgtaacactagcatggtacgaaatgatatacactataaggaaacccgtaaatcccgacaacttcaaagattataagaacatagataaagtcaccgatgaaaagatccgtgccgtacttacagatagattacgcaagttcaatgggaattctaaagaagccttctcggatctagagaaaaacccaatatggttaaacaaaagcaaaggaatcgcaataaaaacggtaaccataacaggcatgtcgaatgtggaagccttacattataaaaaagaccacttaggcaaagagatccttgacaaaaaaggagaccgtatgcctgtcgatttcgttagtacaggcaacaatcaccacgcagcaatatacgaagatgcgaaaggtaacttacaagaacgagtagtatctttttatgaagcagtggaaagagtcaaccaaggacttagcgtagtaaacaaagactataacgcaggcctagggtggaaattcctgtttacaatgaaacaaaacgaaatgtttctattcccatcagaagacttcaacccaaaggaaatcgatctatacgacgaaaaaaatttaaaattaattgctaaaaatttatttagggtacaaaaattcggtgagctatccaaaagcggattttggttccgacaccatctcgagacctctgtcgatgtaaagaaagaattacgtaattactcctatttggacttttattccaaagatttcatgaaaactattgtcaaagtacgcctcaatcacttaggaaaaatagtacaagtaggcgaatactga

SEQ ID NO: 5627 - RNA, 4230 nt, synthetic construct
  misc_feature 1..4230: note = Cas9 variant
  source 1..4230: mol_type = other RNA
atgtctatcatcaattttcaacgaagaggactaatggaaacacaggcatccaaccagttaataagctcacacttgaaaggataccccattaaagactacttcgtaggattagatataggaacaagctcagtaggatgggcagttacaaacaaggcttatgaactcttaaaatttcgttctcataaaatgtggggctcacgactattcgatgaaggtgaatcagctgtagcaagacgcggatttagatctatgcgaaggcgcctagaacgaaggaaattaagacttaaactcctagaagaactgtttgcagacgctatggcacaagtagatcctacatttttcatgcgattacgagaatcgaaatatcattacgaagacaaaaccacaggacattcaagcaaacacatactatttatagataaaaattatacagaccaagactactacaaagcctacccgacaatataccatcttcgagcagaactaatgaaagatggcaccgacgacataagaaaactatttcttgcagtacaccatatcttaaaatataggggcaattttctctacgaaggcgcaacattcgatagcaatgctagtacactagacgatgttataaaacaggcgttagaaaacattaccttcaattgtttcgattgtaattcagcgataagttcaattggacaaatcttaatggaagccggcaaaacaaaatcagacaaagctaaagctatagagcacttagtagatacttatatcgcaacagacacagtagacacaagttccaaaacacaaaaagatcaagtaaaagaggataagaaaagactaaaagcgtttgccaatctcgtactcggactaaacgcaagcctaatagacctttttggatccgtagaagaactagaagaagacttaaagaaactgcagataacaggagacacctacgatgacaaaagggacgaactagcaaaagcatggagtgatgaaatttatatcatagatgattgtaaatcagtatatgatgcaataatattactctcaatcaaagaaccaggcttaacaatatccgaatcaaaagtaaaagcgtttaacaaacataaagatgaccttgccattcttaaatcattattgaaatccgatagatccatatataacacaatgttcaaagtcgacgaaaaaggattacacaattacgttcactacatcaaacagggaagaacagaggagacgtcatgtaatcgagaggacttttacaaatatacgaagaaagtcgtggaaggattacctgattccaaagacaaagaatacatattatctgaaatagaattgcaaaccctactgccattacagcgaataaaagacaacggagtcataccataccaattacacctcgaagaactcaaagtaatattagccaaatgtggtccaaaattcccgttcttaaatgaagtagcagacggatttagtgttgcggaaaaactcatcaaaatgctagaatttagaataccatattatgtaggaccactcaacacacatcataacgtagataacggaggttttgcatgggcagttagaaaagctagcggccgagtgacaccatggaacttcgatgataaaattgatcgcgaaaagagcgcagcagcttttatcaaaaatctgacaaacaaatgcacatatctcctaggagaggacgtcctgccaaaatcatcattgttatatagcgagttcatgttactaaatgaactcaacaatgttagaatcgacgggaaaccactagaaaaagcagtcaaagaacatctaatagaagcagtctttaaacaggatcacaagaaaatgactaaaaatcgaatagaacaatttttaaaagacaacaactatataccagaaaaacacaaacccgaaattacgggactagacggagaaattaaaaacgatcttgccagttatagggatatggtacgcatattagggaacaactttgatttatcaatggctgaagaaatcataacagatatcaccatattcggagaaagcaagaaaatgctgagagaaacgctccgaaataaattttcgagcagattagacgacgaagctataaagaaactatcgaaattaagatatagggattggggccgattaagtcgaaaactattaaatgtcatagaaggatgcgacaaagcaggagacggaacaccagaaacaataataatattaatgaggaatttttcatacaatcttatggaattacttggagataaattcagttttatggagagaatacaagaaattaacgcaaaattgatagagggacaaatcgtaaacccacacgacattattgatgatttagctctatcgcctgcagtaaaaagagctgtctggcaagcactacgcattgttgacgaaattgtacatattaagaaaaccctacccgctagaatatttgtcgaagtcacaagatcaaacaaagcagaaaagaaaaagaaagactcacgccaaaaacgcctctctgatttatacgccgcaatcaagaaagacgacgcactcttatccggccttacgaacgaagagttcggaggtcttaaaagcggcctcgcgaaatatgatgacgctgcacttcgaagcaagaaactatatctatattacacccaaatgggacgatgcgcgtatacaggtgaagtaatcgacttatcacaattaaatacagataattatgatatagatcatatttatcccagatcattaactaaagacgactcctttgacaatctagttttatgcaaaaggacggccaacgcccagaaaagcgatacatacccaatatcaaaagaaatacaaaaagctcaaaaagcattctggatattccttaaacaacaaggcctaatcagtgaaagaaaatatgaacgtctaacccgaattacacctctgacagcggatgatctcagcggtttcatagcaagacagctagtagaaactaaccaaagtgtcaaagctgcaactacacttcttcgaaggctatatcctggagtagatgtagtctttgtcaaagccgaaaatgtcacagattttagacacgataatgacttcataaaagtaagatcattgaatcatcaccaccacgctaaagatgcataccttaacatagtcgtaggaaacgtatatcacgaacggtttacaagaaactttagggcattctttaagaaaaatggagccaacagaacatataatttggcaaaaatgttcaattacgacgtaaattgtactaatgcaaaagacggaaaagcatgggacgtaaaaacatctatggacactgtaaagaaaatgatggcatcaaacgatgttagggtaacaaaacgtctattagaacaaagcggcgctctagcagatgcaacagtatataaagcggcagtcgcagagaaagctaaagacggagcatatataggaatgaaaacaaaatcatctgtctttgcggacgtttcaaaatatggcggcatgacaaaaattaaaaatgcctattcaataatagttcaatacgcaggaaagaaaggagaagttgtcaaagaaatagtccccctccctatttacttgacaaatagaaatacaacggatcaagacctcattgactacgttgcaagtataatacctcaagcaaaagatataagcatcatctacagaaaactatgtataaatcaactggtcaaagtaaacggattctactactatctaggcggaaaaacaaactcaaaattttgcatagataacgccattcaagttatagtaagtaatgaatggataccatacttaaaagtactagaaaaattcaacaatatgcgaaaagataataaagatttaaaagcaaatgtcatcagcactagagcactagacaataaacacacaattgaagttagaatcgtagaggagaaaaacattgagttctttgattatttagtttcaaaactaaaaatgcccatttatcagaaaatgaaaggaaacaaagctgccgaactatcagaaaaaggatacggactatttaagaaaatgagtctcgaagaacaaagcattcacttaatcgaactgttaaacttactaaccaatcagaaaacgacttttgaagtaaagccattaggaatcacagcttcaagatcaactgtgggctccaaaatatcaaaccaagacgaatttaaagttataaatgaatctataaccggcctttattcaaacgaagtaacaatcgtatga

SEQ ID NO: 5628 - RNA, 4233 nt, synthetic construct
  misc_feature 1..4233: note = Cas9 variant
  source 1..4233: mol_type = other RNA
atgactaaaaacatactaggattagaccttggcgtctcatctatcggttgggctttagtacaggaaaactcaaaaaatcccgaaaacaataaaatcgtaaaactaggagtaagagtaaatccattaacagtagatgaacaaatcaactttgaaaaaggaaaacctatcaccaccaacgctagcagaacactagcgcgaagtgccagacgaaacctccaacgatttaaactaagaagagccaacttaatagatgttttaaaaaaaggaaatatacttaaacaaggagatctccttacagaaataggaaaaaacagtacctttcaaacacaagaactacgtgcaaaatctgccaaagaaaaagtcgagttatctgacttcgtcagaatactcttgctgataaataaaaaacgcggatacaaatcaagcagaaaagccaaaaatgaagacgagggacaaatcatagatggaatggcagtagcaaaaaaactctacgaggaaaacataacaccaggagaatatagttataaactattacaagaaggaaggaagcaactaccagacttttatagaagtgaccttcaagcagagttcgataagatatggaattttcagaaacaattcaacccagagatcttcactaacgaactatataaaagactacaaggcaaaaacagaaatgcaacatggaaagagttagaaatacccttttaccttgtaggaattaaacagataggaacaatgcaggaaaagaaaatcgaaagatatttttggagatctgaagcagtaaaaaaacaactcgactttgaatcccttgctgttgttttccaagaaataaattcaaatcttaacaattcaagcggatacttaggagcaatatcagaccgatcaaaagaactatattttaacaaccaaaccgttggcgaatatctttataaccaactcaaaataaatccacatacaaagttaaaaaaccaagtattctatagacaggactacctcgacgaattcgaaaaaatatgggaaacacaagctaaataccataaaaagctaacaaaggaattaaaagaagaaatcagagatattgtaatcttctatcaaagaaaattaaaatcacaaaaaggactaataagtttctgcgaatttgaaaacagagaaatagaaatcaccgtaaacggaaaaaccaagaagaaaacagtaggactcaaagtcgtgcctaggtcatccccactattccaagaattcaaaatctggcaaagattaaatgatcttgaattcaaaaatgtagagacgaaagaaatctttcctttagaattagaacataaggaaattctgttcggaaacctaaatattaaaggaaatcttagttcaaaagaattaatagaacaattaggatacccaagcaaagaatggaaatgtaactttaaagaaatagatggaaacaaaacacacgaaaacctctacaccgctttcttaaagattatagcaaacgaagggatcgaatttccaaaggaatttaaattgagtatcgacgatgatataaaggtttcaaaaatagatgtatccagtgaaaaaattaaagaatttatcaaagaaaacttcttaaagttagggattaacacatcaatattggactttaatccagaattagacggtaaagatttcgagaaacaagaatcataccaactctggcacttattatattcatatgaaggcgatgacagtgcttcaggtaacgaaaaactatacgaactgcttgaaaaaaaattcggttttaagcgagaatacagcaaaatactcgcagatgtgggattctctcaagattacggatcgctgagctctaaagcaatgagaaagatatttacatatattaaagaaaacaaatatagtgaagcttgccaccttgccggttacaatcatagcaaaaactcacttacgaaagaacaactagccaatagaatcctgaaagaacaattagaaattctgccaaaaaacgctctaagaaatcccgtggtggaaaaaatacttaatcaaatgattaacttagtaaatgaagtaataaaagaatacggaaaacctgacgaaatcagaatagaattggctcgagaactcaaaaaaaacgccgaagaaagagcaaacatgacatcagatatatcaaaagccaccctattacaccaaaaatacgccgaggtactacaaaaagaatttggtatcaaagcaccaagtaggaatgacattatccgctacaaactatacctcgaattagcaaataatggctacaaagacctatacacaaatcaaaaaatcgaaaaagaaaatatatttacagacaagtatgatatagaccatattattccacaaagtagattctttgacgattcatttagtaataaggtactagtgccaagatgcgccaaccaagacaaggataactacacagcagtagactacatagagaaaaaatacggcgaaagaggaaaggaagacttcctgaaccgaatacacctagtttttaagtcaaaagaagcaatcgccggtaaaagtgaaagtcagatctcttctatgaataccaaatttctgaaattacaaaaaaaagggtcagaaataggagaaggatttatagaacgagacctaagagacacacagtacatagccaaaaaagcaaaagagatattgttcggcattacaaacagtgtaatctccacaagtggacgcataactgacaaactaagggaagactggaaccttgtcaacactatgaaagaactgaacctagaaaaatacagaaaattaggactcactgaactaatcgctaactcaaaaggtgaagaaaaggaaagaataatagactggacaaagagaaacgaccaccgtcaccacgcaatggatgccttaaccgttgcattcactactcacaaccacatccaatacctaaactacttaaatgcaagaaaagacgaaaagcacaaagaacatcacaacatattcgccatcgaaaatataataacagaaattgtagaaaagaagaacggaagcaaagaaagacgctttaaactgccaataaaaaactttagaacagaagcaaaaaaacagcttgaggaagtactcatcagtcataaagctaaaaacaaagtagttactaaaaacattaacaaaacaaagaagaaaggcggagtggtatcaaaaatcgtactgacgccgcgaggacaattacataaagaaaccatatatggctcagcaaaattcttgaaaactaaggaagaaaaaatcagtggtaaattcgatctagaaaccataaacaaagtacaaaacgaaaaatttaaaaatgcactactagatagactcaaagaatttaacggagatagcaaaaaagctttcacaggaaagaatgtaccagctaaaaatcccatatatttaaatgaacaaaaaacagaacaagtgcccgaaagcgtggtactcgcatggtatgaaacaggctacacaatccgcaaagcagtaaatgctgacaatttcaaagattataaaaacttagaaaaaattatagataaaggagtaaaagaaatattaaaaaatagactaaacgcctttaacggaaatgcaaaagaagcattctcagatttagaaaagaaaccaatatggctcaatcaatcgaagggcattgcagtaaaaaccgtaactatcaccggaataaataatgctgaaaccctgcactataaaaaagatcactttggtaacgaattactagacgaaaatggtaaaaaaataccagtagacttcgtatctacgggtaacaaccaccacgtagccatatacgaagacgcagacggaaatctccaggaacgagtcgtttctttctacgaagccgttgaaagagtaaatcaggggctaagcatcatagataaagaatacaatcaggatcttggttggaaatttctatttacgatgaaacaaaatgaaatgttcttattcccctcagaagacttcaatccaaaggaaacagacctatttgacgaaaaaaacctaaatttgatttctaaaaacatgttccgcgttcaaaagtttggaagcctactatcgggcttttggtttagacatcacctcgagacaacagttgacttaaacagttcattaaaagacacaagctacaaagttatccaatcatgtaacaacctaaaattaatagtaaaagtaaggctcaatcacttgggaaaaatagtccaaataggagagtattga

SEQ ID NO: 5629 - RNA, 4236 nt, synthetic construct
  misc_feature 1..4236: note = Cas9 variant
  source 1..4236: mol_type = other RNA
atggtaaaaaaagaatacttcataggattagacatgggaacatcaagtgtcgggtgggcagttgcagacacaaactacaatcttctcagagccaaaggaaaagacatgtggggggtaagactatttcccgaagctagcaccgcagctgaccgacgaagccatagaacagcccgtcgaaataataagcgaaaagccgcccgtgaaggattcctacgcgaaatattcgaagacgaaataaataaaattgacccaggatttttcgaacgtctaaaagagagcaaatattacctagaagataaactcactgatacccccttcgtacttttcgccgacaaaggatataccgacaaagaatattacgatgaatatccaacagtcttccacctaataaaagaactaatttcagaaaagggcctagaaccccacgatatacgacttgtgtatttagcatgcctaaatatatataaacatagaggtcactttctaaatgataccctgtccggggacggtatagataacatcaatagtttatgtaatgatttcacatcatacttagccgactataatcaaaactccgaagacgatggcactgaaaaaatggacttggactcaacggtactagcaggagtcttcgaagaaacactgtgcaacaaacatttaagtaattcagccaaaaaacgagacttaattgacaaactgggaattactaacaaaactaagtatctaacagaaatgatggctctcatctccggactagcatcttcagtaagtaatatgtttgcaaaggatacttatgacgaagaacaaaaaaaatttaaactttcattcaggtcaagcaatctagatgaagacatggtaaaagtacaagcaatgttaacacctgaagaatatgaaatgatatgtataatgaagaaaatacacgactggtctgtcgtctctgtaatcatgggatcacacaaatacattagtgacgccagagttgaactctacgaaaaacacaaacaggacctcgcaaaattaaaggcgatatacaaagagtacctaccagacaaatacgatgcgatgtttagagagatgacagacaatagttatagcgcatatgtaggaaaagtctctagcaacaaaaaatcacaaacaggaaatcacaaagtacgaatgcaaagaagaggagctaaatgcaaacaagaagacttttatgatagaataaagaaagaaataaattcagttccccaagaagaaaaaatagatatattacaagatatggaaacaaactcttttctgccgaaacaactaactaacgaaaacggtgtaataccataccaactacatttagctgaattaaaaaaaatacttgataatgcttccacatatttaccatttctaaattccgcagacgaaacggggataagtaataaagataagataattcagctatttgagttcagaataccctactatgtaggaccattgtttaaatccgaaaaaaataaaacaaatgcatgggtagtaagaaaagagagcggaaaagtctatccatggaacttcaatgaaaaaatcgacgaaaaacagagtgcagaaatatttatagaaagaatggtaagacattgcacatacctaaacaatgaaagcgccttaccaaaaaactcattaaagtatgaaagattccgagttctaaatgaactaaataacttaagaattaacggagaaaggataagtcctgaactaaaacaacgaatatataacgaactattcaaagtcaagaaaaaacgaatcacaaaatcaatgctatgcgagtacctatacaaaaacggtatagccgacaaagattctgaactaagcggcttcgatggaacttttgctaatgctctactaagttatggaaaattccgagaactattcaacgtggatacactgacagataaacaagaagcggcagcggaagatataataaaatggtcaacggtctatggagattcaaaaaagtttctgcaggaaaaaatagaggaaaattatggaccagaatcagaaaatcctctcttagataataaacaaataaaaagagtaatgggatacaaatttacagactggggaaatctatcgcgagaatttctaaatctagaaggagcagacaaagataatgacacaactacaggagaagtaatgccactaattacaagaatgtgggaagaaaattacaatttaatggagcttatgtccaataaatttagctatagagatgcgttagcagagaaaacggaagaaatagaaaaaacactgacagatatagaatacgaagacctcgaagatttatatataagtgctcccgtcaaaagaatgacatggcaaactttattaatcttaaaagaaatataccaaataatgggatacgcaccaaagaaaatcttcgtagaaatggcgcgcgaagaggaagaaaaagtgaacggaaaaggagccagaaaaagttcaagaaaaaaacgactagaggatttatatcgaaattgcaaagatgcgtctaaagagctttctacgggaataaagaatgctgacgaagcaattctccgtagaaaaaaactatatctatattaccttcaaaaagggaaatgtatgtactctggaaaaacaatagactttaagagcttattcacaaacaactacgatatagaccacatatacccacaaagcgtagtaaaagatgacagcttagaaaacaatatggtactagtcgaaagaaactacaataacaaaaaaagcgacacctttccaatcttctccgactggcaaaacaaaatgaaacctttttggacaatgttaaaggaacaagggttcatcaatgaagaaaagtacaaacggcttacaagaacagacgaactaacagatgatgaactagctaacttcgtaaacagacaattagtagaaacaagacaagcaactaaagtaattgcggaactgctaaaaaattcatttgatgatatagatagcaagatagtgtacgccaaagcgggaaacgtctcggaattcagacacaaatttagtatgaaatatgataaagaaacagaaaagagctcagttattcacccagaactagtgaaatgccgaatcataaatgacttccaccacgcaaatgatagttatctaaacatagtggtgggcaatatatacgatgtaaaattcacacaaaacccctacaactacatcaaagaatataaaaagcagaagaacaattcagcactaagcgaacaagaaaaagaaaagtaccacatggacaaaatattcaactttgacgttaaaagaaatggtgaagtagcctggatatcaaggggcgacaataaaactttagaaaccgtattaaaagtaatgagaaaaaacacaccaatagtgactagaatgaactttgaagaacatggacaactagctgacctaaccatatattcagcatcagatgccctatcaaaaaaaggtgtcggatacataaaagtgaaagcaagtgacgccaggttagacgtattaaaatacgggggatacaaaaaatacaaaggagcatacttttttttagtcgaacacacagaaaaaaacaaaagagtacgtacaatcgaaaacatgccactatacttaaaaaatgaattgaacaccaaagaaaaaatcgaactttggtgtgcagataaagaaaatggccttggattggtggatccagacgttcgactaggaaaaattaaactatactctaaaataagaatagatggattcgacctgtaccttacaggccgaacgggtaataacttactaacatccaatgccgtacagcttaaaataggctcaaacaaaccttccgacaatgacaaactattttggagatactacataaacaaactcagtaagtacacagaaaacagtgaattcgtaagcatacaaaacaacataaagttatatgacctgttcgtggaaattaacaacgcgggagtatactccaaacgtcaaaacccgataggcgataaactattggaaggaagaagcaaattcataaatctaacgttgtcaaaacaagtagagacgctgttgggaataatacgaatatatagtcttgaaaaccaaggagcagaccttagtaacataggagggcaagaaaaaaatggaacaatgaaaccacacaaaagaatctcagacaaaaaagaagttttgctcataaaccagtccgtaacagggctctatgaaagtaaaattgatttactgaaaatatga

SEQ ID NO: 5630 - RNA, 4236 nt, synthetic construct
  misc_feature 1..4236: note = Cas9 variant
  source 1..4236: mol_type = other RNA
atgaaaaacattttagggttagacttaggaactaacagtataggttgggcactaataaaacaaaacgcagaagaaagacaaggatcaatacttggaatgggaacaagggttttacctatgtcacaagacgtgctcggagattttggcaaaggaaattccgtatcacaaacagcagcacgaacagggtacagaggaataagaagactgcgagaaagattcctattaagaagagaaaggctacatagggtattaaatatactaggatttttaccctactactatgctgcacaaatagacttcgacaaacgattcggaaaattcaaagcagaaactgaaccgaaactgccctacaacaatgaaggatttatcttcaaaaactcatttgaagaaatgttaagtgatttcaaaataagtcaacccgaattactttccggaaataagaaagtaccgtatgactggacaatctattacctgcgtaagaaagcagtatcacagaaaatagaaaaagaagaacttgcatggatcctcttaaattttaatcagaaaagaggctactaccaattgagaggagaagacttcgacgaagaaaaagacaaaacatttgtaaccctaaatgttgacaaagttatagactcaggcgaaaaagtaaaaggaaacatactttttgatatatactttacaaatgggtggaaatacgaaaaacaaacaacaaaacccgaagattggctaggtagatcaaaagaatttatcattaccgaatcgttactcaaaaatggcgaagtaagaagaacatttaaagcggtagattccgaaaaagattggatagcgatcaaagcgaaaacagaacaagaaattgaaacggcacataaaacagtagggtcatacatatatgatgcaatcttacaaaacccaaaacagaaaattaaaggaaaattggtaagaacgatagaaagaaaattctacaaagaagaattaagaaaaatactagaaaaacaaaaagatttccatttagaactacaaaacgaggacctatactccgattgcgtcagagaactatatcgtaataatgacacccaccaactctccctagccaagaaatcgttcattcacttattcttggaagacataatattttaccaaaggccattaaaatcccagaaaagctctgtaagcaattgtacattagaatgtcgaaaatacagagacaaaaacggggcagagggtatccaattcctcaaggtaattccaaaatcaaacccctattaccaagaatttagaatctggcaatggatgtcaaaccttaagatctacagaagggacgatgatgtcaatataacaagcgagtgcttaaaaacagcagaagattacgaggacctatttgtattccttaatataagaaaagaggtcgaccaaaaggcgtgtctaagacattttaaactatctgagaaaacacacagatggaattacgtcgaagataagaaatacccgtgtaatgaaactggaacaatgataagcgaaagactaaagaaagttggagattcacctgataatatctttacgagagaaatggaacaacaaatatggcacattatctactcagtaaacgacaaaacagaatatgaaaaagcactaaaatccttcgcaaagaaaaatgaactcgataatgactccttctttgaagcatttcgaaaatttcccccgtttgatagtgaatacggcagcttttccgagaaagcaatcaagaaactgttgcctctaatgagaataggaaagcactggaactgggaagcagtcgatgagaaaatcaaaaacagaatacagaaaataatcattggagagtatgacgagaacataaaagacaacataagagagaaaacactttctctacagaaagaaagtgattttcaaggtctaccattatggctagcacagtatgtagtgtatggaagacattcagaggcttcagtagctgggaaatggaactcagttgatgatatagaggagtacctaaaggaatttaaacaacattcactcagaaatccaatagtagaacaagtaataatggaaaccgttagagtagtcaaagacatatggataaaatatggtaacggtgcggcagacttcttcgacgagatacacatcgaactaggaagagaaatgaaactacccgcaaaagaacgaaacaaaatgacccaaaagataagtgagaacgaaaacacgaacttacgaatcaaagccttactagcagaaatgatgaacgatagcgaagtacaaaatgtaagaccatatagtcccatgcagcaagagatactaaaaatatacgaagatggtgcgttaaacagcgaaatatcagttgacgacgacatactaaaaatcagcaaaacagcgcaaccatcaccaagcgacctaaagaagtacaaactatggttggaacaaaaatacagaagtccgtacacaggcgacataatcccccttaacaaactattcacaactgaatatgaaattgaacatatcataccacaatcacgctattttgatgactcatttagcaataaagtgatatgcgaaagtttggtcaacagactaaaggacaactatataggactagggtttataaaacaattccacggctacaaaatatcagataaaaccaaagtattcgaagtagaagagtacgaagacttcgtgaaaaagaactacgcaaacaaccgaagcaaaagatcaaaactattattagaagaaataccggaagaaatgatagaaagacagctaaacgatacaagatatatttcaaagtatattagcggaatactctcaaatatagtaagaaagaaagaaaacgacgaaggcgtaaactcaaaagatattataccaggaaacggaaaaataacttcccaactaaaacaagactggggactaaatgacgtatggaatgatctcatattacccagattcgaaagaatgaacgaattaaccaaatcctcatattttactgtatggaacgaaaaataccaaaaattcctaccgaccgtacctgttgagttcagtaaaggatttagcaagaaacgcatagaccatagacatcatgcactagacgccttagtgatagcctgtgcaaccaaagaccatgtaaatcttctaaacaataaatcagcgaaatccgaaatgaaaagatatgacctcaagagaaagttaatgaaatttgagaagaaaacttatcaacacagccagactggtgaacgaattgttaaagacgtgcctgtagagttcctcaaaccatggaatgatttcactgtagaagcaaaagaaaaccttgaaaagataatagtaagtttcaagcagaacctaagagtcattaacaaggcaaccaaccactacgaaaagtggatcgaaaaagacaacgttaaagttaagggcttagtagaacaacaaggcttaaactgggcaatacgcaaaccactacataaagatacagtctcaggaaaagttgacttgcccggaataaaagtccccaagggaaaaatactcactgccacacgtaaatcgattgacacaagttttgatctaaaaacgataaacagcataaccgacacaggagttcagaagatcctgaaaaattatctagagtataaaggaaattcatcagaagaggcgttctcatcagaaggaatcgaagatatgaataacaacatcgaaaaatttaatgaaggcaaattacaccaaccaataacaaaagtacgaatatttgaactaggatcgaagttcccattaggccaaatagggaacaagaaacataaatacgtcgagactgcaaaaggaacaaacctcttcttcgccatttacgaagacgacaaaggaaaacgtacatatgaaacaataccactaaacgaagtaatagagcgacaaaaacagggactagcaccagttacactgaaatctaaaaatgacttttacctatgcccaaacgacctagtttatgttgcagcagaaggcgagagtgtcaacaaaatcgacttcaaatatgcttcacaggagttcatacataacatctataaagttgtatcgtttagtggatctcaaatcttctttgtcaaacaaaacatagcagtatccattgtaaataaagccgagttctctacattaaacaaaatggagagagcagtggatggaaagatgataaaagattgctgtattaagctaaaaatagacagaattggaaacataactaaatcgtga

SEQ ID NO: 5631 - RNA, 4239 nt, synthetic construct
  misc_feature 1..4239: note = Cas9 variant
  source 1..4239: mol_type = other RNA
atgatgaccaaaaacatactaggactcgatttaggcacaaacagcattggctgggcattaattaaacaaaacgcagaagaaagaaaaggctcgatcctaggtatgggaacaagagttctcccaatgtcacaagacgccttaggtgactttggaaaaggaaatagtgtatctcaaactgcagccagaacaggataccgaggagtaagacgtcttagagaacgattcctccttcggagagaacgacttcacagagtattgaacattctaggatttctacctgattattacgccgcccaaattgactttgacaaacgatttggtaaattcaaagcagaaacagaaccaaaattaccctataacaatgaaggcttcatatttaaaaattccttcgaagaaatgttatcagattttaaaataagccaacccgaattactaagcgaaaataagaaaattccatacgattggacaatatattacctaaggaagaaagctgtatcacaaagaatcgaaaaagaagaactcgtttggatcctcttaaactttaatcagaaaagaggatactaccaattacgtggagaagactttgacgaagaaaaagataaaacttttgtaaccctgaatgtcgataaagtcatcgactcaggagaaaaagtaaaaggaatcgtattatttgatgtgtacttcacaaatggctggaaatatgaaaaacaaatcaccaaaccagaagactggttaggtagatcgaaagaatttataataactgaaagtttactcaaaaatggcgaagtaaaaagaacattcaaagcagtagattctgaaaaagattggatagcaatcaaagcaaaaacagaacaagaaatagaaattgcacacaaaacagtgggcagctacatctacgacgccatactccaaaacccaaaacagaaaatcaaaggcaaactaattagaacaattgaacgaaaattttacaaagaagaactaagaaaaattctcgaaaaacaaaaagaatttcatcccgaactacaaaacgaagatctatattcagattgcgttagggaactttacagaaacaatgatgcacaccaactgagcttagccaagaaagattttatacatctgtttgtagaagacatcatattttaccaacgacctctaaaaagtcagaaaagtagtgtttcaaactgtaccctcgaatgtcgaaaatacaaggataaaaacggagaagaaagaatacaatttctaaaggtgataccgaaatccaacccatattaccaagagttcagaatatggcaatggatgtccaacttaaaaatttacagaagagacgacgacgtaaatataacatcagagtacctaaaaactaccgaagactatcaagacttatttgttttcctcaacacccggaaagaagtagatcaaaaagcgtgtctaaagcacttcaaattaaacgagaaaacacaccgttggaactacgtggaagataaacgttatccctgcaacgaaacaggaactatgattctagaaaggttcaagaaagtaggagacagcgctgacaacatattcacccgcgaaatggaacagcaaatgtggcacatcatatatagtgttaacgataagacagaatacgaaaaagctcttaaaagttttgcaaagaaaaatgacttagataacgttagctttttcgaagccttcagaaaatttcccccatttgactctgaatatggttcgttctcagaaaaagcaataaagaaactacttccactaataagaacaggtaaatactggaactgggaagcagtagatgaaaagactaagaaacgaatacagaaaatgataaccggagaatgggatgaagacataaaagacaacataagagagaaaactttatcgctccaaaaagaaagtgatttccaaggcttaccactttggttagctcaatatgcggtatatggacgacacagcgaagcatcggtagccggtaaatggaacagtgtaaatgacatggaagaatatcttaaagaatttaaacaacactcactacgaaaccctatcgttgaacaagttataacagaaacaataagggtagtcaaagacatctggataaaatatggcaacggagcagcagacttctttaatgaaatacacatagaactaggtagagaaatgaaactccccgcaaaagaacgatcaaaaatgacacaaaagatatctgaaaatgaaaatactaatcttcgaataaaggctttattggttgaaatgatgaacgactcagaagtccataacgtaagaccttactcaccaatgcaacaagaaatcctaaaaatatacgaagatggagcactaaattcagagataagtgtggatgacgacatactaaaaataagtaaaactgcacagcccagcccaagtgatctaaagaagtataaactgtggctggaacaaaaatatagatcaccctatactggagacatcattccgttaaacaaattatttaccacagaatacgaaatagaacatataataccacaaagtagatacttcgacgacagtttcagcaataaagtaatatgtgaatcctctgtaaacagactaaaggacaactatattggattaggattcataaaacaatttcatggatataaaatcagcgataaaacaaaagtatttgaagtagaagaatacgaagattttgtcaagaaaaactacgcaagtaattggtccaaacgatcaaaactactacttgaagaaattcccgaagaaatgatcgaaagacaattgaatgataccagatatatcagcaaatacatatcaggaatactaagtaatattgtaaggaagaaagaaaatgacgacggcgttaactctaaggatataatcccaggaaacggcaaaataacaagccaattaaaacaagattggggtttaaacgatgtatggaacgatctagtcttacccaggtttgaaagaatgaacgagcttacaaaaagtaacgattttacagtatggaacgaaaaataccaaaaattcctacctacagttccagtagagttctctaaaggattctccaagaaaagaatagatcaccgccaccacgcactcgatgccctagtcatagcatgcgccactagagatcacgtaaacttactgaacaaccaaagcgcacgatctgagatgaaacgctatgatctcaaaagaaaactaatgaaatttgagaagaaagcctaccaacatagccaaactggcgaaagaatagttaaagatgtaccagtagaatttttaaaaccatgggacaactttatcgtagaagcaaaagaaaacttggatcgcataatagtatctttcaaacagaacttaagggtgatcaataaagctacaaaccactatgaaaaatggattgagaaaaacaacgtaaaagtaaaggccctagtggaacagcaaggattaaactgggctataagaaagcccctccataaggacactgtcagcggaaaagttgacctacccggcaccaaagttccgaaaggaaaaatcctaacagcgacacgaaaatccattgataccagtttcgatatgaagacaataaattcaataacagacacaggaatacagaaaatcctaaagaactatttagaatataaaggttcctacgaagatgcgttcagtcctgaaggtatagaagacatgaataaaaacatcgaaaaattcaacgatggaaaacagcatcaacctataatcaaagtaagaatattcgaattaggtagtaaattccctctcggacaaattggaaacaagaaacataaatatgtcgaaacagctaagggcaccaacttattctttgcaatatacgaagacgataagggtaaacgcacatatgaaacaatacccttaaacgaagtaatcgagcgacaaaagcaaggcctggcgcctgtaacattcaaaagcaaaaacgacttctatttatcaccaaatgacctcgtatatgtagccgcagaaggggaatcagtagacaacctagacttccaaagtgactctcaagaatacataaacaacgtatataaagtagtcagcttctccggctcacaaatattctttgtaaaacaaaatgtcgccgtcagcattgttaataaagccgagttctccacactgaataagatggagagagcaatagatggaagaatgataaaagaatgctgtgtaaaactaaagattgatagaattggcaatatgaccaaaagctga

SEQ ID NO: 5632 - RNA, 4245 nt, synthetic construct
  misc_feature 1..4245: note = Cas9 variant
  source 1..4245: mol_type = other RNA
atgaaaaaaatacttggactggatttaggaacaaactcaatcggatgggcgttcgtcgaggaagccgaaaatgaatcagaaaagtcgagcataattaaattaggcgtaagagttaacccccttacagtagatgaacaacaaaactttgaaaaaggcaaaagcatcacaactaacgctgatcgtactttaaaacgaagtatgagacgaaacttacaaaggtataaacaaagacgagaaaatctcatagatatcctaatgaaaaacggtttcacaagtgacgacacaatattaagcgaaaatggaaacagaacaacattcgaaacctacagactacgctcaaaagcagtagctgaaaaaatatctttgcaagagttcgcaagagttctcctaatgattaataaaaaaagaggctacaagtcatcacgtaaagctaaaggaactgaagacggcgaattaatcgacggcatggaagtagcaaaaaaactgtacaattacaatctgacgcccggccaactctgcctccagttactaaacgaaggaaagaaacatttaccagatttctacagatctgatcttcaagccgaattcgaccgaatattcgatatccaaatgactttttatactgaatatcttacattagaattaaaagaagaactaagaggaaaaaagcgtgacgcagtatgggcaatatgcgcaaaaattttcaaagaaaaaggtttcgaactaattggaacaaaacgacaaggcagcaccgccgaacaaaaacacgaaaactattcatggcgggctaagggactaagtgaaaaactagaactcgaacaactagttgtagtattgcagcaaatcaacatacaacttaacagttcaagtggatacttaggagcaatatctgatcgatcaaaagaattattttttaacaaacaaactgtcggacaatatcaaatggcagtacttgacaaaaacccaaatgcaggcctaagaaatatggtattttatagacaagattatctagacgaatttaacgcaatatgggaaaaacaagctctatttcatccaatacttactgatacactaaaagacgaaatccgcgatgtcatcattttttaccaacgacgtcttaaaagtcaaaaaggtttaatatcattttgcgagcttgagtcaagaaagatagaagtggaaatagcgggccaaaataagaccaaaatggtaggatcgcgagtaataccacgaagcagcccactctttcaagagtttaaaatctggcaatctctcaacaatatagaggtatttggcaaaggaaaaaaatccaagaaacaaaaagaacaaacactattcgatcaaaccgaagacccccttgaatttggaggaagacgagaattatacgaagaagaaaaagaactactagcattagaattgtccataaaaaaagaactgaaaaaagctgacatacttaaactattattcgacaaccccaaagaattagacctaaacttcaacgccgtccaaggtaacctgacacaagctaccttgtttaacgtatacaaaaaaataatagaattatcaggacatgaaatagacgtagagaaagattcagcatcaaaaatattaaaatcaatagaagagatattcaaagcattgaactataataccgaaatactgcacttcgactcggaaaaaagccaagaccaacaagctatgtacatgttatggcatcttttatactcgtttgagggcgacaactcaaacactggcaacgaaaatctaataaataaaattagcaaattatacggttttgaaaaagaatacgccaaaattcttgcaaatgtctcatttcaggatgattatggtagtctaagtgcaaaagcaataagcaaaatcctaccttacttgaaagaaggccataaaagtgacatagcctgcgatctagccggttacaagcatagcgcatccagtttaacaagagaagaattagaaaataaaacttataaagacaggttagaaatcttaccaaaaaatacactaaggaatccggtcgtcgaaaaaatactaaatcaaatgataaacgtaatcaacctcataatagatagtcgagaattgaaaaaaagtgcaaaggagagagaagaattaaccaagtcaatatcagaaactacaaaactacatcaacaatacaaagacatattagccaaagcgccattcaacttaaccaatacatccagaaacgacataatccgatacaaactatacgaggaactcaaagacaatggatataaaacactctattcaaataaatacatatcacccgctgccctcttctctggagatttcgatatagaacatataataccacagagtagactatttgatgactccttctccaacaaaaccttagaattacgttcaataaacatagaaaaaggaaataaaacagcatacgacttcataaaaggaaaatatggcgaaactggtgaagacaactgtttggataaatacttaaatcgaatcgagactctatacaagaacggaatcttaaaaaaatcaaagtataataaattaaaaatgcaagacaaagatataccggacggcttcattgaaagagacatacgggacacacaatatatcgcaaaatatgcaaagaccctactaggtgacctagttaaattcgtagtatcaacaagcggatccgtaacggaacgattacgagaagattggcagttagttgatgtaatgaaagagttaaactgggaaaaatatatgcaattaggtctcactgaagaatttacaaatgaagaaggtcatcgcattcgcaaaataaaagactggacaaaaagaaatgaccaccggcaccacgcgatggatgcgctaacagtcgcattcacaaagaggcagttcatacaatacctcaacaacttaaacgcccgacgaataagcgacgaacaaggaatttctaatagcgaaaaggacgaaaggaataatgtctcaataaccacaaatgacatgaaattaaatactcgcgacgtactaggtatagaaaaaaaagaattatacagagacaatcgaggcaaactcagatttaaagcaccaatgccgctcttagaatttcgcgaagaagcaaaaagacacttagaaaatacattgatttcaatcaaagccaaaaacaaagtaacaactataaatataaacacgctgaaaaaggcaggtggcgtgtacaaaaaaacacagctcacgcccagaggccaattgcataatgaaacaatatacggaagccaaaaacaatacatagtaaaagaggaaaccattaatgcaaaattcgacgttgaaaaaatcgccacagtaactaatcccgtatatcgagaagcactattaaaaagattagaacaaaataacaacgacccaaaaaaagcattcacgggaagcaatgctctaactaaaaaacccatgtggtttgacgaacaacaaacagaaaaagtaccagaaaaagtaaaaaccgtatcattcgaaacgatatatacaataagaaaagaaatcagccctgatctaaaaatagaaaaagtcgtagacgaaaaagttagacaaatcctgaacaatcgtcttaacgaatacaacgggaatgctaaacaggcttttagcaatttagacgaaaatccaatatggctcaacaaggaaaaaggaatcacgataaaaagggtgaccattactggaatcaacaacgcccaagccttacatgagaaacttgataaagatggaaaaccaattttagatggggaaggcaaaaaacaaccagtagattttgtaaataccggaaataatcaccatgtagcagtatattgcgacgccgacggaaacctacaagaaaacgtgatatccttttatgaggcagttacccgaagaaacctagggctacccatcatagataaagactacaaaaaagatgacggttggcaatttttattctcaatgaaacaaaatgaatacttcgtgtttcctaatgagtctactggatttaaccccaacgaagtggatttactaaaccctgacaactatagcctcatatcacctaacctcttccgagtccaaaaatttactataaaagattacttcttcagacatcacttagaaacaaatgtcgaatcgaacagtacattaaaaggaatcacctggttaagatgcggacttaacaacatagacaatataataaaagtacgcataaatcatattggacagatcatacacgtaggagaatactga

SEQ ID NO: 5633 - RNA, 4248 nt, synthetic construct
  misc_feature 1..4248: note = Cas9 variant
  source 1..4248: mol_type = other RNA
atggccaaatttaacaaaccatattctatcggtctcgacatcggcgtaagctcggtcggatacgctgtcataactgaagactacagagtcccagcattccgcttcaaggtactaggtaacacagaaaaagagaaaattaagaaaaacttaatcggctcaacaacctttgtaccagctcaatcggcacaagtaacacgtgtattcagagtaaacagacgcagaatagatcgtcgaaaccatcgaatagcatacctacgcgacatattccaaaaagaaattgaaaaagttgacaaaaacttttacagaagattagacgagtcatttagagtcctaggcgataaatccgaagacttacaaataaaacaacccttctttggtgacaaagaattagaaaccgcataccataagaaatatcctacaatataccatctccgtaaacacttagcggatgcagacaaaaatagtccagtagcagacatacgtgaagtatacatggccttatcacacattctgaaatacagaggacacttccttacactagacaagataaatccaaataatatcaacatgcaaaatagctggatcaatttcatcgaatcctgccaggaagtattcgatttagaagtcagcgaagaatctaaaacaattgcagcgattttcaaaagttcggaaaaccgacaagaaaaagtcaagcaaattttatcgtattttcaacaagaactacttaaaaaggacaaaagtatattcaaacaacttctacaattactttttggtctcaaaaccaaatttaaagactgcttcgaactagaagaagaaccagatctaaacttctccaaagaaaactatgatgaaaaccttgaaaacttactaggcactctagaagaagatttttcagatgtgtttgctaaactaaaaatacttagagacacaatcctactatccgacatgcttacttatacaggagctacacacgccagattttctgccacaatggtggaacgctacgaagaacatcgcaaagacctacaacgattcaagagcttcgtaaaacaaaacctatcagaacaagactacctcgacatcttcggcaggaagacacccaacgggttcgacgtagacaaagaaacaaaaggatacgtaggatatatttcaaataaaatggtcctaacaaacaaacagaaaacaatacaacaaaacttctatgactatatctcaggaaaaattaccggaatagaaggagcagaatatttcttgaataaaatatcagatggcactttcctccgtaaactcagaactacagacaacggtgccatacccaaccaaatacacgcctacgaacttgagaaaatcattgaaagacaaggtagagactatcccttcctcctggaaaacaaagataaattgttatctatactaacctttaaaataccctactatgtaggacctctagctaaagggaacaattcaagatttgcctggattaaacgagccacttcacaagacatactagacgataacgacgaagatactcgtaatggtaaaatacgaccctggaactaccacaagctcataaacatggataaaacacgagacgccttcattactaacctaataggtaacgatatcatattacttaacgaaaaagtactccccaagcgatctctcatatacgaagaagtcatgttacaaaacgaacttacccgagtaaaatataaagacaaatacggaaaaacacatttctttgattccgaacttcgacaggaaattataaataacttatttaaaacaaactctaaaagagtctcaagtgcaatgcttctgaactacttagaaaattacactaacctccaagcagtagaaatcgtaagcggaatagaaaaaggtaagagcttaaacagtacgttgaaaacctataatgatcttaaaacaatcttttcagaagaactcctagatagtgagatttaccaaaaagaacttgaagaaatagtaaaggtaattacagtttttgatgataagaagtccatcaaaaattatctaaccaaatattttgggcgattagagtttttaaacgaagaacgaattaaccaactatccaaactccgttatactggatggggacgctattcagcaaaactgctgctagacatcagagatgaagatactggatttaatttaatgcaattccttagaaacgatgacgaaaataggaacttaagtcaactaatatctgacagcacactatccttcgatagcgctataaaatcaatccaatcaaaatctaccgtcgaagacgacgtatttgacgaaattaagaaattagcaggctcaccggcaattaaaagaggcattctaaattcgataaaaattgtagatgaacttgtccaaattatcggatacccaccccaaaatattgtaatcgaaatggcacgtgaaaacatgaccacagaagaaggacagaagaaagctaaaactcgcaaaaccaaactagaatcagccttaaagaatatagaaaactccgttttagagaacggaaaagtgccacattcagatgaacaactacaatcagaaaaattatacctttattacctacagaatggtaaagatatgtattccttagacaagacagggtcaccaacacccctctatcgcgatcgtttggaccaatatgaagtagaccacataataccttattcattcttacctatcgactctatagacaataaagtactaacacacagagaaaataatcagcgaaaactgaataatatccctgataaagaaacagtcgcaaatatgaaaccattctgggaaaagctatataatgcaaaactaatatcacaaacaaaatatcaaagactcacgacatctgaacgaactcccgacggcgtacttacagagtccatgaaagcaggatttatagaaagacaattagtcgaaacaagacaaataataaagcatgtagcccgaatactagacaacagatttcttgacacaaaaatcattaccctcaaatcacagctgataacaaacttcagaaacactttccatattgcaaagataagagagctaaatgactaccaccacgcccacgacgcgtacctagcagtagtcataggtcagacattattaaaagcctaccccaaattagcaccagaacttatatacggtcatcatgcacattttaatagacacgaggaaaacaaagcaaccatcagaaaacatttatatagcaacataatgcgctttttcaataaccccaatagtaaagtttccaaggatatctggaattgcaatagagacctaccaataataaaagatattatatacaactcacaagtcaactttgtcaaacgtaccatgatcaagaaaggcgccttctacaaacaaaacatcatcccaaacgactcatctgtcactgttgataagagattcccaatcaagaataaaaagtacctcgatccaaaactatacggtggctattacgaaagaaattccgcactatcagtcttcattattggccaatcatttaacaagaataataaactaaaagtagttaaagagttctacgatataaacataatagattatcctctattcaacacagaccctatgtcatttttcaacgacgactccgaaaacggctttctaactaaaaataaccttcaaagtgtacaagcattttataaaatcccaaaatactcactaattcagaaaaacgatggaacacgcatgcttttcgaatcgacaacaaattttcataaagcaacacaattcaaactaactgaagctcaaaacgaactctttttccatatgaaacgcttacttacaaaaacagactttatggatttaaaatctgaagaatctattaaagaatcccaagatttcataatgaatcataaaaacgagttcgataacatagttaatggactatttggctacgccgaaagacaattaggatccaagagcttattcacacaagcccacgaagcatacaaactccgaaaatacccagtgttttcgcttaacgaagaaacaatacgttattattatgacaatttcttgcgactcttttcactaaccaaatcaggtacgagtagtggatacgtagtaggattattcgaagcaccaaaactaagaaatgtagtataccgagcaactaaggatgagtcaaatgcaaccttaattcatcaatcaatcaccggtttatacgagactagaatagacctctcaaaacttggcgaagattga

SEQ ID NO: 5634 - RNA, 4248 nt, synthetic construct
  misc_feature 1..4248: note = Cas9 variant
  source 1..4248: mol_type = other RNA
atgaacttaaggaacgtcgcaaaggaaggaatcaattataacatcgggttagatctcggcactggaagcgtaggttgggcagtgacagatgaacaaggagaactatttagtttcaaaggcaaaaccacttggggatcaagaatatttccaacagcggaaacagcagccgatacaagattaaaaagaggccaaaggagaagatacgcaagaagaagatggaggttagatttgttacagagcttgttcgaagaagaaataaaaaaagtagacccagaattttttactaggctaagacaaagccatctcctaaaagaagataaaacgtacgcagcgatattaagtagcaaaggagcaacgaggccattatttccggaaggagaagcagaggttgaatattacaaaaaatacccaaccatatatcacttaagaaaagccctaatggaatctaataaccaagaagatataagactaatatacctagcatttcataatatagtaaaagcaaggggtaactttttgcaccaggatacacctgggctaacagcaagcaacgcaaatatgggagatgctgtcgaaaagctatgtagtgcattagaagactggtgtagtagtcagaacatagaatgtgccatcagaaagaaccaaaaaagtatccaagatttaatggagggcaaaacaatagaaccatccgaaagtaatgctttaaaagagacatttgatgcatcacgaagcagtagaaaagacaaagcatcagtcctggctggatggatagcaattcaacctggagaacaatttgaaccaaaacaagcaaaagacgcatctaaagaaatagcaaatgcagtctttggattgtcagccaacatgaaaaaagtattcgtagaactagaagaagatcaaaaaatatatttaaataatgacgaacaagtcgaggccttttacacggtgtgcccggatgaaggtgtggcactttttgaggctttgcaaagcatgtacagtgcctatgtactgatgggtatcctaaaaggagctgatggcggatcaatatcttcgtgtaaagtagcagcttatgaacagtataaggaagatctcaaattactcaagacgctagtcagagagtttgcaccaaagaaatatgacgaatttttccgcggcgatatattcgatgctaaaaaaggattccgtacaagaaactatgatccagcgactgcaaaagggtatactaaatacaacagtgtgagaggagcaagttatgatgcatttaaaaaagaagtagagaaattatttgagggaacagctgcagaagaagatgtaagatatacagatatgatgcaaagatttgacgaagggacattcttaaggcgtctaaaaacatcagataacggatcaataccataccaattacatttagaagaaatggtagcaattatagaaaatcaaaagacattttacccattcttggaggaaaataaagaaaaatttgagagtttagtaacctttcgaataccctattatgtaggaccactaacacaaaaaaatgcacgtcccgacaaccacggtaacgctcgatttgcatggtcgcaacgaaaagaaggacaagagaacgcaagagtctatccttggaattgggaagaagtaatagatagaaaacagagcgcagccaaattcatggagcgcctcacgggtacctgcacatacatactggaagaaccagttctccctagatacagcttactctatgaagaatattgcttattgaacgaactcaacggtgcaagatggagggacatgggaggcgactggcacagatttgactacgaaacccgaatggacataatagaagacctattcaaaaaaaaaaaaggaaccgttaagtacgctaccgtggcagactggttagtcagggaaaaacatagatcatgcgctgaagttaaaggcggacaaggggaaacgggctttgaatcaaaattgagtagttacgtattttttaaaggtgtattacatgtagacgagatcgatgaagcagacattccaatgatagaagaactgatatggtggaacacattattcgaagataggagtatactcaaagaaagcattgaagacaaatatggggataggttaaatgatgaacaaataaaagcaatttgtaaaaaaagatttacaggctggggtaggttgagtaaaaaattattatgtggtataaaagcacaaacagataacggtccctgttcaataatggatgtattgagagaaggaaaccccaacaatgatgcacgaagcgcaactatggtctttatggaaataataagggatgataaatttggttttaccaaactaatcgaggaagagaacaagaaaagaatcagtagcgtagacgatttcgatgtcaatgacctcccaggctccccagccgtaaggagaacagttaatcaagcaaaaagaatagttgacgaaatagtaggaattgcaggctgtgctcctcaaaatatattcattgaagttacaagagacgaagatggacgaaacaaaggtcgacgaactaaaagacgctatgacgctatacaagaagctgtaaaggtcttaaagaaggaacaaaaagagtattttgatgcaaatgtcgcagacctcttaaaaaacacagctcctgcagccctagatgacgagcgactagccctatattttatgcaaaacggaaaatgtatgtactgtggaaaagacttggacattaatcaactagacaaatatcaagtcgatcatattctacctcaatcatatgttaaagatgactcatttgaaaacaaagcattagttcatagcgatgacaatcagaggaaatcaaacagtatgctattggatgatagcataataagaaaaatgaagccatattgggaagcattgagaagtgccggattaatcggagaaaaaaaattcaaaaatctgactagagtgagggtaagcgacaaagaattaggaggattcatcgcacgtcaaatggtagaaacaagccaatctatgaaactaactagtctgctgcttgaacaagcatatccagaaactcaagtccgaccagtgaaagcaggattttcttcagaccttaggagaaggctgaaattagtaaaatgtcgagaaataaacgattaccatcatgctcatgatgcatacttggcatgtgaagtaggacaattcatcgcgctcaggcataacaaactctatgagaaccctataggttactcacatgcagttaaagattttatagcaaaacgtgcaaaatacgcatcagaacacggaaaaccaatggatacatatggaatgcctggttcatcctcattcgtcatttcaagtttcatgacctccggattcgatgaagaaacaggagaaattttcaaagatgcatgggacgcatctctagcagccgttcgcatacatcaagcacttaatagaaaagattgctacatatcgcgcatgccagaagaaacaagcggcgccttttgggatgctacaatatatagcccaaaacaaaccaaaaaaaaactatcattaccgctcaaaaaaggactagaccctcaaaaatatggatcttatagtagagaacaatttgcctacttttttgtctacgaagcaaaaaaaattaagaaaaaagaggaaacgaaagaatacgttttcgcctcagtcccagttcaagtagccgcattagtcgcagccgaccctaacgcactaatcgaattcgcaaaagccgatgcagaagaaagaggattaaaatttgctaaaattgtaagagaaaaagtttataaataccaactaatagaagtgaatgacgaaagatttttcgtaacaggattaagaacagtaagaaacggactccaaatagcctttagtgaacaagacagaaatattgtaagcggaatagtcgaaggaaattcaagtaacaataatctactggacatatacgataaaataacaaatagatatgcactatatgctagccgcttcggtaaattgctaaacttatctggctacagagagaattttatccaggcctccttagaggatcaagaaagagttgtgcttgccttaatatcattattcaatgcaagaacaaatatgatagacttatcagctatcggaagtagtaaaactgtgggaaacatgtcaatgacatttgcaaaagaaatggctatggcggacaaccgatttgcattcatagaccaaagcgtaacggggatgttagaaagaaaaacatatttgtga

SEQ ID NO: 5635 - RNA, 4251 nt, synthetic construct
  misc_feature 1..4251: note = Cas9 variant
  source 1..4251: mol_type = other RNA
atgggatcacgtataatacctatgtcgcaagatattttaggagaatttggaaaaggaaatagtgttagccaaacctcagaaagaacagcctacagatcgacgcgtagactcagagaaagatttttattaagacgtgaacgactgcatcgagttttaaacatattagatttcttaccaacacattatgcatcccaaatagacttcaagaaacgactaggtaaattcaaagaaaacaaagaaccaaaaatagcatacgacaacaaatcatttctgtttctagatagcttcaacgaaatgctcaaagacttcgaacaagaacaaccaaatatgctaataaatgaaaaaggagaaaagaaattaataccatatgactggacactatattatctaagaaagaaagctctacgggagaaaatatctaaagaagaattaagctggatcatactaaatttcaatcaaaaacgaggttattatcaactcagaggcgaagatgaagaagaaaatccctctaaactcgtagaatttcattctctcactgtagtcgacgtggtgcccgacgaacctataaaaggaaaattagaaacttggtattccataatactagataatggttgggtttacaggagatcttcaaaaacagaattatacgactggaaagacaaaattaaagagttcattgtaacaacagatcttaattatgacggaacggtaaaaaccgacaaagaaggtaatgttaaacgatctttcagagcaccctcagaaacagattggaccctcatcaaaaagaaaactgaatacgagatagaacaatctagcaaaacaataggagaatacatatacaacacactactaaaatatccggaacagaaaataagaggcaaactaatccgcaccatcgaacgaaaatactacaaagaagaactaaaacaaatcttgctcaaacaaactgaatttcataacgaattaaaagacgattccctctattatgactgtctacgcgaactatatagaaacaacgaaagccaccaattatttttagaaaagaaaaatttcgcgcaattgttcatcgaagacatcatcttttatcaacgacccctcagaagccaaaaatccctgatatcaaactgtccattagaattttataaatttaaagactctgtaggcaatgaaaaagtccaacacctgaaagctatacctaaaagcaaccctttctaccaagagttccgcatatggcaatggatatcaaacttatcaatatactccaaactagatgattcaaatttcacatcgcactttttcgatagtacagatgactgggaatccttattcgaaatgctgaatggaagaaaagaaattgaacaaaaacaattactaaagttccttctagagaaaaagggatttaaaggaaaatcattaagtagtgaaatagaaaaatatagatggaattatgttgaagataagaaatatccctgcaacgaaacaagatcactaatacaatcccggctagataaagtagcgaacctaccagagagcttcttaacacgacatgttgaacaagaactatggcatttaatctattcagtaaccgacaaaattgaatttgaaaaagccctagacacatttagtaagaaatataaaatagatacgccaacatttgttgacgcgttcaagaaatgcccacccttcaaatcagaatacggatcattcagcgaaaaagccatcaagaaattgttacctttaatgagaacaggaaaatattgggatctcgacaacatagataaagctacgaaacaaaggattgagaaaatcatatcaggcgaatacgacaaagacatacgagatagagtaagagaaaaagccattaatctactctcagaaaccgattttaacagactacaattatggttagctcaatacatagtttacgacaggcactcagaagctacatcattagacaaatgggaaaccatagatgatatagtaacatacctacatagtttcaaacaacacagcttaagaaacccgatagtagaacaagtaataacagaaacaatcagagttgtaaaagacatatggagcaattacggcaacggaagcaaagattatttcaacgaaatacacgtcgaactaggaagagaaatgaaactaccagcggaagaacgtaaaagaatacaagagaaaaattcacagaatgaagatacaaacctgagaataaaagcactgttgagcgaaatgcaaaacgaccccaacgtagaaaacgtacggccgtattcacccgtgcaacaagaaatactcaaaatatatgaagagggtgttctaaattcaaacatagagatagcagatgacatcttaaaaattagcaagacagctcaaccgtcttcctcggatctaaaacgttacaaattatggttagaacaaaagtaccaatcaccctatacaggagaaatcattccattaaacaaactctttacaccagaatatgaaatagaacacatcattcctcaatccagatactttgacgactcatataacaataaggtgatatgcgaaagtgcagtcaacaaattgaaagacaacagcttaggatatgaatttataaaaggatataatggccaaattgttgaatgcggatttggcaagaaagtaaaaatcttcagtattgacgaatacgaagacttcgtacagaaaaactatgcgaataacagatcaaaggcttcaagattaatgatggcagacatacctgaaaagatgattgaaagacaattgaacgacacaagatatatatctaaatacataagcaatatactgtcgaatattgtaagatcagaatcgaatgacgacggagtaaattccaaaaacttaatctccgttaatgggaaaatcacaactgttctaaagaaagattggggaatgaatgacatttggaatgacttgattctgcctagatttatccgaatgaaccaaataacagacagcgattcattcacaacatggaatgaacgatttcaaaaattcatacccacagttccgatagaattaagtaaaaacttcagcgcaaaaagaattgaccataggcatcacgcaatggatgcattagtaatagcatgtgcaacacgagatcatgtgaatcttctcaataacctatatgctaagagctcagctagatatgacctaaaccgtaaactaagaatattcgagaaaacaacctataaagacatcaaaacaggccaaataatcgaacgcgaaattcctaaagcctttttaaagccgtggcaaaattttacaaccgacgccaaagacgcaattgaatcaataattgttagttacaaacagagtttaagagtaataaacaaatcaactaactactatcaaaaatgggtcgaaaaagacggaatagtaaagaaagagaaaataaaacaagaaggaaagaactgggctataaggaaaccactccataaagacacagtatcagggctagtacaattatcttgggtaaaagtaccaaaaggaaaagtaatgacagcaacaagaaaatcactggacagttcttttgatttaaaaacaatagccacaatcacagacaccggaatacagaaaatactaatcaaataccttgaatccaaaggcaacaatccagaatcagctttttctcccgaaggcatcgaagacttcaataacaatatacatttatataacgacggcaagaaacaccgacctataacaaaagtaaggctatacgaaatcggttccaaattcccattgggtgaaaaagggaacaaaaacgcaaaatatgtagaggcggcaaaaggcacaaatttattcttcgcggtgtacgccaacaacaaaggagaacgaagtttcgaaacaataccccttaacctagttatagaccgtctcaaactaggcctaagcgctgtacctgaaacaaacgagaaaggagataacttactattccacctaagccccaacgatctcgtctacgtaccttcagaagacgaaatggaaaacctaaaactaataaatctagaacatatctcaaaagatcaactaaatagaatatataaaatggtgtcatcaaccagcaatagatgcttctttattaaaagcgaaatagctctctcgatagtaaacaaaatagaatactcaccgctcaataaaatggagaaaagcatagaaggaatcatgatcaaagatgtttgtctaaaactacaagttaataggataggaaacctggaacgatacttttcttga

SEQ ID NO: 5636 - RNA, 4257 nt, synthetic construct
  misc_feature 1..4257: note = Cas9 variant
  source 1..4257: mol_type = other RNA
atgaaagtaaaaaacatattgggattagacataggtgtaacatcaataggattcgcacatgtcacagaaaacgaaaaagataacaaaagccacatcaagcagctcggagtacgtataaaccccctaacagtcgatgaacaaaccaattttgaaaaaggcagaccggcatcagtaaacgcagatagaacattaaaaagaggagcaagaaaaatgttatcaagatacaaggacagaagaaaaaaccttatagaaatcctctcaaaaaccggattcataaatagcgaatcaattctagccgaagacggtaaaaacacaacccacagtacatgggcattacgagctaaagcatcaagggaaagaatagaaaaagatgaattaggtagagtcctactagcgataaataaaaaaagaggttataaaagcagcaggaaagcgaaaaacgaagacgaaggccaagccatagatggcatggctatagcaaaaagattatacgaagaaaacttaacaccaggacaactagtataccagttactacgtgaaggcaaaaaatatataccggacttttatagaagtgatctccaagacgaattagataaagtttggaactttcaaaaacaatttcaccaagaaatattaacagatacattttacaaagatatacaaggtaaaggacaaagagctacttcagcctcattttacggggtttatggtttcaatactgccgaaaacaaaggctcccgcgaagaaaaacgactacaagcatacgcatggcgatcagacgccctaacaaaacaactaactagggaggaagtagcattcgtcataactgaaattaataataacttaaacaatagtagcggttatttaggggcaattagtgaccgatcaaaagaattgttttttaacaaaaaaacagtaggccaatatttatatgagcaattacaacaaaatcctcacacaagactgaaaaaccaagtattttaccgacaagattacctagacgaattcgaaacaatatggaccattcaatcaagatattacccagaattaacagacgatttaaagagagaaatacgtgacgttgtaatcttttaccaaagaaaactaaaatcacaaaagggcctggtttccttttgcgaattagaatcaaaagaaattatgatagaaaaaaacggaaaagcagcagtaaaaaaaataggatcgaaggtcgcgccgaaaagcagcccgttattccaggaattcaaaatatggcaagtattgcacaacgtagacataaaaaataaaaaagacaaaaccaaacgaccactagatgattcggagaaggaatacttgttcaacgaactaaatataaaaggaaatctaaaagctgctaaagtaatccaactattaactttgaataaaaacgaaacagagctaaattatacacaattggagggtaacaggacgcaaaaagctttatacgaagcatacctaaaaatattagatacagaaggttatgatgtcaataacctactaggaatcaaaagtaacaaagacgaagtatttttagatgatttggacgtaaacgcactcgaaatcaaaacaatgataaaacaaatatttaacgccttaaatataaatacaggtatcctagacttcgatgcagaactcgacgggaaagcattcgagcagcaagcatcttatcacctatggcaccttctctattcatatgaagaagatggaagcaaatcaggcaatgaacacttgtataaactactggaaaacaagttcggatttaaacccgaacatgcaagaatattggccggaataaccttatcagatgattatggtaatctatccgcaaaagccatgcgaaaaatatacccccagataaaggaaaacaatttctcaacagcatgtgaactagtcgggtaccgtcacagcaaaaactctctcacaaaagaagaaaatcaagaaaggcccttaaagaacaaactagaattattgaagaaaaactcactgagacagcccgtagtagagaaaatcctcaaccaaatgattaacctagtcaatgaattgatagataaaaatagtgaaaaagatgaacaaggatcaataatagaatatttcagatttgacgaaattagaatcgaacttgcacgagaacttaaaaaaaacacagatgaaaggagagatttagatgcggctattcgagaaggaaacctaaggaatgaaaaaatatacaaactcctccaagcacagtttggcattaaaaacccaactagaaatgacatcataagatatcgactctacgaagaattaaaaaacaacggttacaaagatctatatacaaacagttacatacctcaagaaaaactgtttggcaaagaaatagacattgatcatataattccccagagcaaacttttcgatgatagcttctcaaacaagacactgacttacaacactacaaacaaagacaaaggaaatcaaaccggattcgactatatagagtcaaaatatggaatcgacggaatcgaagcttataccgcacgaatagaaaatctttttgagagtggaaaaaaaaataaagaagaaggagtaagcaaagctaaatatcaaaaactactcaaaaaagagtcggaaattggcgacggcttcatcgaaagagatctgagggaatcacaatatatagctaagaaagccaaagaactattattacaaataacgaggtctgtagtcgcgactagtggaagtattacggcaagattacgagaagactgggacttagtaaacgtaatgaaagaactaaatctaccaaagtaccgagcactcggacttactgaaatggaagaacgtaaatacgggcaaaaagtagaagttattaaagattggacaaaaagagatgaccatcgacatcatgcaatggatgcgctaaccattgccttcacaaaacataaccatatacaatacctaaatcaccttaatgcgcgaaaagatgaacaacacaaagaacacaaaattataaatgctatcgaaaacaaggaaaccatattaatcacagataagtcaggaaaccgaaagcgagtatttaaagcaccaatgcctaattttagacaaacagcgaaacaatatttagaagaggtcctaatatctcataaagctaaaaacaaagttgtaacgaaaaataaaaacaaaatccttggtaaagaaaaaatccaagaaacacttacacctcgagggcagctacatgatcagactatatacggatttaactggtggagcagaattaccctttcaaagaaagtatcacgtaacgaaatagaaaaaataatcgacaacaatacgaaattttttttacaagaatttatacagttaaaaggcagtatagctaaagcgttctccgatgctgaactcaacaagcttatgtacaaaggaaaaatactcaaagaaatcgaagtcgcaattccatgttatacacaacgtattgacatatcaaaagtttttaccgactcacaaaaaagtaattccgcaaaagaaaaaaacatcaagaacatactagatctaaaagttagaaatatactccaaaacagactatcagaattcaaaggagactttaagaaagcattttccgacctcgataaaaatcctatctggtttaacaaagaaaaaggaatctccataaaacgtgtaataatctccggagtaaaaaacgtagaacccttacactataaaaaagaccacctcggcaacgacatactagacggtaaagaaaacagaataccagttgatttcataagcacaggaaacaaccaccacgtagcaatataccaagatgaaaaaggtaatctacaggagaaagtcgtcagtctttttgacgcagtcaagcttgtgaacgcagatgaaccagtaatagacaaaacatacaaccaggggctaggttggcagttcttattcacgatgaaacagaacgaaatgtttgtatttccaaacgataacacaggttttgatccaaaagagattgatctattagatccaagtaataaaaaattaatatcaccgaatttatttagagttcaaagcatttccatagtacaatacggtaataatatagttcgggactttaagtttcgaaaccacttggaatctgtactgaacgacgataaagttttacacggaataacattccaacagataaaaagtttagggccactactgaatatagtcaaagttcgaataaaccacttaggtgacatagtaagcgtcggagaatactga

SEQ ID NO: 5637 - RNA, 4260 nt, synthetic construct
  misc_feature 1..4260: note = Cas9 variant
  source 1..4260: mol_type = other RNA
atggctaaaccacaaaactatacaataggtttagatataggtacaaactcggtaggatggacggtaactgacgaccaaaacaacatattaagaatcaaatccaagaaagcaataggcgctagactatttgaagaaggaaaagtagccgcagaaagaaggagttttcgtacaactagaagacggttatcaagaagaaaatggaggataaaattactagaagaactatttgacgaggaaatatcaaaagtagatcctaactttttcgcaagatctcacgaatcgtggattagtcccaaagataaaagagaaaggtattcagccatagtgtttccaacaccagaagaagataagaaattccataatgaatatccaacaatataccacttaagagacagactcatgaaagacgatcaaaaacacgatatacgcgaaatatacgtagcaatacaccatataatgaaatacagaggaaatttcctacacgatgaaagtatagaaacatacaggagtggaatgtcatcattaggaggaggagacgaacgtactatactcaatacgaaaatactggatgacctaaatgacgcgtttgcagacaatctggcaacacaaggaatcagcgttaatagcgccagcgcagaccaaatcaacgagatagttacaagtggacatttgaacgttgactctcaaaaagcaatagcaaaactactattacccactacactgtcatcagatgacaagaaacaagacaagaaaatcaagaaactagcaacagacgcagccaaaaatgtagcatcagcatggctgggctacaaagccaactttgcagcaatactaaatatacaagaagttgataaagataaaaagaaaatatacagttttgcactacaaggtgctgacgaagaagacaaagttgaaactctcgaaagcgttctgtcacaagaccaaatcgaaatagtagaccgaataattagaatcagacatgcaatagtactaggcgaaatcattcctgtaggtatgaccctgagcgaggcaatgatagaaaaatacgatcaacacgctaaagacctgaaaaatttaaaaacagtaataagaaatcttaaagatagaaagaatgccgtaaaactacaggcaatttatgatttgtatgtcaacaatcgacatgcggatacagcaaaagcaatgaaattagccggggtgaagaaaagaacggaattattagaaccagaagagttcaacaaatctattgaaaaacttctggacgactcacctgtaagtgccgaaattaagaaacgaatagccgaaaaagattttctcccactccaaaggtctaatagcaatggagtcatcccaaaccaactccaccaaattgaattagatgaaatcataaagaaacaatcaaaatattatccatttttgggtgaaacaaatgaacatgcatccgctgacgtagcaagaaaagctccaacaaaactagatcaactactaacatttcgagtcccatactatgtcggaccattaatcacgaaagaggaacaagaagaacaagatggccactcttttgcatggatgattcgtaaaaaccccaaagatcatgagaaaatcacaccatggaactttgacgaaaaagtagatcgaatggcatccgctacacaattcattaaacgcatgaccactaaagacacatacctactaggtgaagacgtattacccagttcaagtctaaaatatcaacttttcaccgttttgaacgaactcaataacttaagaataaaccacaagaaattgactagagaagaaaaagagcaagttatagaagacctgtttaagaaatataaaacagtaaaagctgacaaatttaaaaactactggcagaaaggtcatgcagggttggatgtaaaaatacaaggtatggcggacccagaaaaatttaactcgaccatgagtacctacatcgatctacagaaaattttcggcgatcaattagatgacgcccaacgacagaatgacttcgagaaaataatagaatacagtacaatttttgaagatcgaaaaatactaggggaaaaattaagagccgactttgtatggttaagtgaagatcaaataaaaagattatgcagactgaggctccaaggctggggaagattaagcctaaaattattaacacgactaacagatgcagacggccagaatgtattggaaagacttttgaactcgaatgataatttcatgcaaatagttaaagacccggtaataaaagctaaaatagaacagaaaaatcaaaaattattgagagccgactggtccgaaaatgcaacagaatctatattagacgaagcctatacatcccctcaaaataagaaagccattagacaagtaatgcgcgtcgttcatgatatcgttaaagcatgtgatggtaatcttcccgctaaatttgcaatagagttcgcaagaagtcaagacgatgaccccaaaagaacagtagcaagagcagacaggctacagaaaatatacgcccaaatatcagacgaagttgtaagccaaggagtaaaagaccaacttagtggaatgaaaagtttaaaagaccgttattatctatatttcatgcaaggtggaagggatgcatatacgggtaaacctttaaacatagatcgactaagcgactacgacatagatcacataatgccacagagcttcataaaagatgattcattggacaatagagtattagtaacacgagcagttaataaccagaaaagtgataatgtaccagtactgttatatggaaaccacctcgttgcagacctaggaattacaataagagaaatgtgggacagatggcagaaaagcggaatgataagtaaaagaaaactagcaaacctgctcaccgatccagccacattaagtgaatatcgagcggaagggtttattaaccgacaattggtagaaacatcacaagttattaagttaacagctaccattttacaatctgaatttccagattcaaaaatcatagaagtcccggccaaatacaatagtatcttaaggaaacaattcgatctgtacaaatcaagagaagtaaatgattaccaccatgctattgacgcgtacctatcaacaatagtggggaattatctataccaagtctatcccaacttaagaaggctatttgtttacggtgaatttaagaaattttctcatggggaggaagaaagctcacatcaagcagtaagaagagtgaaatcaatgaacttcttagacgatttactaaggggaaaacacggggatgatatatattgtagagtcaccggggaagtcattttctcaagaaaagatatcatttcaaaactgaaacaagcatattcctttaaacaaatgttagtaacacaagaagtattcacaaagaaaagtgccttatttgatcaaaccgtttatccatctccggcaagagattcaaaaacacgtagcgggttaatacccagaaaacaaggcatggacacagaaatatacggtggttactcagggaacaaagacgcttatttcgtattagcacaagtagtaaaaagtaaaggccacactttacaagtagtaggtgtacccatccgtgcactcagagcgctagcaaactgtagtaactattcagaacaactcctaaaaatagtaaaagcacaagtactttttaacaagaaaactggtaaagctaagaaaggaatctctgacgtacgaatactactcgacaaaatcccctacagacaaccagtattagacggctcagcattctatatgttaggcagcagtacttacaaatacaatttaaaacaaattagcctatcacaacaatctatgaaatacatcttggattatattgacgatccaaatttcaataaacatgaaatgactaaaatagaccaacaaaatgaaaaagaatgcctgttatccgtatatgacgaaattttggacaaaatggataaatacctttcactatacgacataaacggattcagaaagaaacttcatgtcggaagagacaaatttataaaattagaagtcgaaaaacaagctgaggccatcaaaaatgtattaagaggctttcatgcaaattctgatatgactaaattaagtgacttaggattaagtacatctttaggttttatgcaagcgagtgacgggataaaattaagcgacaacgcggttttcatataccaatctccgactggtttatttgaacgcagggttaaagtatctgatttattaaaatga

SEQ ID NO: 5638 - RNA, 4260 nt, synthetic construct
  misc_feature 1..4260: note = Cas9 variant
  source 1..4260: mol_type = other RNA
atgatgatcaaaaacatattaggtctagacttagggacaaactcaataggatgggccctcattaaacaaaatttcgaaaacaagtacggagaaatattaggaatggggtcgagaataattcccatgtctcaagatgttctcggggaatttggaaaaggaaacagcgtgagtcaaacagcagcacgaacgggatatagaggagtccgtcgcttaagagaaagattcctactaagaagagaaagactccatcgagtattaaacgtactaaactttttaccagagcactatgcatcacaaatagactttgagaaaagattcggaaagtttaaatacgagactgaaccgaaactagcttacaacaatgacggatttttctttaagaactcatttgacgaaatgctaggagattttaaagatcatcaatttcatcttctagaaaatggaagaaaagtcccatatgattggacaatatactatttaagaaagaaagctctaagtcagaaaatcgaaaaggaggaactagcgtggatacttctaaacttcaaccagaaaagggggtattatcaactacgaggtgaagactttgaggaagagaaggatcgagtgttcgtcagactaaaagtcgatcgagttgtggactccggtgaaaatataaaaggcaagatattgtatgacgtatactttgaaaacggttggaaatatgaaaaacaaatagttaaaaccgaggactggattggaaggacaaaagaatttatagtaacagaaagcattttaaagaatggggatacaaaacgaaccttcaaagctgtggactcggaaaaggactggattgcaattaaaacaaagaccgaacaagaaatagataagtcacacaagactgtaggagcttatatttacgaagctcttttacaaaaccccaaacagaaaataaaaggcaagctagtcaggactatagaaagaaaattctatcgagaggaactaaagaaaattttagaacgacaaaaagagttccacccagaactccaaagtgacgacctctataacgattgcataagggaactatatagaaacaatgaagcacaccaaataaccctcagtaagaaagacttcgtccacctactactaaatgatctaatcttctatcaaagaccattaagaagccaaaaatcatcagtaagcaattgtaccctagagttcaggaaatacaaagacgaaaacggagtagaacacgcccaatatttaaagactatccccaaaagtaacccctattatcaagaatttagagtctggcaatggatgtttaacctaaacatataccgaaaagatgacgataccaacgtaacaaaggaatttttatcatccacggaagattacgaaacattattcgaatttctgaacaataggaaggaagtagatcaaaaagcattattgagacatttcaaactaaatgaaaagacgcaccgatggaactacgtagaagataagaaatacccatgcaacgaaacaaaaacaatgatttcgacaagattagaaaaggttgaaaattatccttccgactttctcacaagagaaatggaacaaaatatatggcacataatatactcagtcaatgacaaaatagaatacgaaaaagcactaaaatcttttgcacacaaaaataatttagacgaaaattcattctttgaagcgtttaagaaattcccaccattcaaaagtgaatatggtagcttttcagaaaaggcaataaagaaattattaccgttacttagacttggaaaatattggaattgggaatcaatagacagaaaatcacaaggcagaatagagaaaatcataacaggagaatttgacggaaacattaaagataaagtaagagaaaaagcaatacatttaacagcagaaaacgacttccaaggactacaactgtggcttgcccaatatatcgtatacggtagacattccgaagctagcatgattggtaagtggaactcagccgatgacctagaagaatttctaaaaggattcaaacaacattcattaagaaacccaattgtagaacaagttatcaccgaaacactgagagtagttaaagacatatggctaaaatatggaaacggcgctaaagatttcttttctgaaatacacatagaattaggaagagaaatgaaacaaactaaagacgaacgagtagacgcaaccaaaaggataaccgaaaatgaaaacacaaacctaagaatcaaagctctcctcgccgaaatgatgaacgacaattctgtcgaaaatataagaccatatagcccaatgcaacaagaaatactaaagatttacgaagacggaatcctcaagtccgatattgaaatagacgacgacatactcaaaataagtaaaaccgcacaacctagcagttcagatttaaagcggtacaaactatggttggaacaacgttataaatctccctacaccggccaaataatacccttaaataaattatttacatccgaatatgaaatagaacacataatcccacaatcaagatacttcgacgactcttttagtaataaaattatatgcgaaagtgcagtaaataaactgaaagacaattacataggactaggtttcatcaaacaattcggagggatgattgttgaatgcggctttggtaaatccgtcgagatattcaaagcggaagaatacgaagattttgtcaagaaacactacgccaacaataggtcaaaaagaaataaacttttattagaagaaataccagagaaaatgatagatagacaactaaatgacacaagacacataagcaaatacatatcgggggtactcagcaatatagtccgacaagaagacggtacggatgaaggtgttaattctaaaaacattgtaccgggtaatggaaaaataacaacccaattgaaacaagactggggtttaaatgatgtatggaatgaactaatattaccaagatttgaacgcatgaatcaactaacaaactcaaccgatttcacaagctggaacaaaaatcatcaaaaatttttacctactgtgccgatagagttcagcaagggtttttcaaagaaaagaatagaccataggcatcatgcaatggacgctctagtaatagcatgtgcaactaaagatcatattaacttattaaacaatcaatcagcaaaatctgatacaaaaagatacgatctaaaacgcaaactcatgaaatttgaacgagtagtttacagccattctaaaacaggagagaaaatcgaaaaagaagtaccaaaacaattcctcaagccatgggataacttcacagtagacgccaaaaataagatggaaacaataatagttagcttcaaacaaaatcttagagtaataaacaaagcaacgaatcattacgaaaaatggatagaaaaagatggcataaaaagaaaagaactaataaaacaagaaggcacaaattgggcaattcgaaaaccaatgcataaagaaacagtatccggaaaagtagacctaccaggaattaaaattccaaaaggaaaaatactaaccgctacaagaaaaagcctagacacgagcttcgatttgaaaacaataaacagtattacagacactggtattcagaaaattttaaagaactacctagaatttaaaggaagcagcgaactagcattttcgccagaaggaattgaagatatgaacaaaaacatagaaaaattcaacgacggaaaaccacaccaaagcattaacaaggtgcgtatattcgaattaggcagcaaattcagtgtaggtcaaactgggaacaagaaagacaaatacgtagaagcagcaaaaggaacaaacctgttctttgcagtctacgaagacaaaaacggcaaaagatcctacgaaacgatcccactcaatgaagtaatagagagacaaaaacaaggcctcgacagcgtttcatttaaaaataaagaggatttcctcttgtgcccaaatgatctagtttacgtccccagtgaagacgaactagaaaatatatacaatattgacttcaaaaatctaacaacagagaagacagggaacatatacaaagtcgtctcattctctggaaaccaaatattctttattagacaagatatagcgataagtatagtaaataaagcggagttctccacactaaataaaatggagagggcaatagacggtagcatgataaaagaaaactgtataaaactcaaaatagacagattaggtaatatagccaaaatatga

SEQ ID NO: 5639 - RNA, 4263 nt, synthetic construct
  misc_feature 1..4263: note = Cas9 variant
  source 1..4263: mol_type = other RNA
atggcaaaaccaaaggattacaccataggactagacataggaacgaactcagtcggatgggtagttacagatgatcaaaataatattctacgaataaaagggaagaaagcaatcggtgcacgattgttcacagagggaaaagtcgctgccgaaagacgcagctttagaacaaccagacgtcggctgagtagacgaagatggagaataaaaatgctagaagaactattcgacgaagaaatagcaaaagttgatccatccttctttgcaagactccacgaatcttggatatcaccaaaagataagagaaaaagatatagtgcgatagtatttccatcgcctgaagaagataagaaattccacgaaagctaccctacaatatatcatttacgagataaactaatgaaagatgatcagaaacatgatataagagaaatatacattgcagtacaccaaatgataaaagccagaggtaatttccttcacgatgaaagtgtagagacatacagatctggaatgtccagtcttggcggaagaagcgaaaggacaatattatcagtccagacattagaggaacttaacgatttatttgccgagaacgaaggcactgaagaagtcgaactaaatgttgcttcagcagaacagattaatgatatattaacaggaggacacctgaatgccgattcacaaaaggaaatatcaaacctcctattaccatcatcattcccttcatttgatgacaaagccaaagaaaaacaagtaaagaaattgatcaataacgtagctacaaatatctcaaaagcgtggcttggatataaagcagactttagcacaattctaaacttagcaaaagtcgacaaagaccagaaaaagatattcgcatttgcactgcaaggcgaggatgaagaagacaaagtgcaagaactcgaatcgctattagagcaaagtcaaacagacatagtagacagattaatagaaatacgtcacgcaatagttctatcagaaatagtgccagtaggaatgacattaagtgaagcaatgattgacaaatacgatcaacacaaagaggaccttatcaccttaaaagcagtaatacgaaatactaaagacaagaagaaagctgccaaactccaagctatatatgacttatacgtgaaaaatcgacacgcagacctagccaaagcaatgaaactaaccgggatcaagaaaagatctgaacttttagatccagaggaactcaagaaagggataagttcgctgctagatgatagccccgaagcagtagaaataaaacaaaggcttgaagaaaagacatttttaccattacaacgatcaaataacaatggcgtaatccccaaccaattgcaccaagtagaattagatgaaataatcaagaaacaatctaaatactatccgttccttgcagagaaaaacccagacgaatctgaagaggcacaaaagaaagccccaactaaactagatgcgctgctgacattccgcgtaccgtactacgtagggccaatgataactaaagaagaacaagaggctcagaacggtcattctttcgcatggatggtaagaagagacccacaggatcacgaagccatcactccatggaacttcgaaaagaaagtagacaaaatggcctcagctacccaatttataaaaagaatgacaactaaagatacatacctactcggagaagacgtattgcctgcatcgagtctaaaataccagttattcacggtattaaatgagctcaataatcttcgagtcaacggaaagaaactgacatctgatgaaaaagagcaagttatagaaggcttgttcaagaaacagaaaacagtcaaagccgacaaattcgtaaaatactggcaggccaaacacataggagcagatatcaaagtaaaaggcctctcagatccaagtaaatttaacagcacaatgtccacctacattgactttaagaaaattttcggagaccaattaaacgacgtcaacagacaaaatgatttcgagaaaattatagaatattcaacaatttttgaagatagaaaaattcttgaagataaattaagagccgatttcgcatggctctctgaagaacagataaaacaactctgtcgattacgcttacaaggatggggaagattaagtgataaattacttacgagactcacagacgcagacggtcaaaatgtattagaaagactctggaatagcaacgataacttcgtacaaatagtatcagatcctaatataaaagcaaaaattgaacaagaaaaccaaaaattattaagagactcacaaagcgacaatgctgtcgaatccatcctagacgacgcatacacgtcaccacaaaataagaaagcaattagacaagtcatgcgtgtcgtacacgatatagtaaaagcctgcgacggcaacgttccagctaaattcgcaatcgaatttgctagatcgcaagaagatgacccaaaaagaacgacagcacgagtaaatcaaatgcagaaaatttacgatcaaatttcggatgaagtagtatcacaaggagttaaagagcaattaagcggaatgaaaagcctcaaagatagatattatctatatttcatgcaaggaggacgtgatgcttataccggagcaaaactcaacatagatagattatcagattacgacgttgatcatatcatgccgcaatcgtttgtaaaggatgattctttagataatcgtgtactggtagcaagggccgtaaacaaccaaaaatcagataaagtcccggcgctattattcggaaacaaggtagttgcggacttaggcataaccgttcgcgaaatgtgggacaaatggcaaaaattaggtatgatcagcaaaagaaaactgtcaaacctactaaccgacccggacgctttaaccgaatatagagcacaaggcttcatcaggcggcaattagtagaaacttctcaagtcataaaacttacagcaacaatactacaaagtgaatttcccgactccaaaataatagaagttcccgccaaatacaattcaatagtacgcaaacaatttgatctatacaaaagcagagaagtgaatgattttcaccacgctatagacgcatacctatccacaattgtcggtaactacctatatcaagtctatccaaacttaagaagaatgtttgtttacggagagttcaagaaattttcaagcaatgctgaagaaagcgctcatgacgttgccagacgcgtaaaatctatgaacttcctagatgacttattacgaggtacccacggtgacaatatatactgcagatcaacaggagaaatagtctttaatagaaatgacataataagcaaattgaaacaagcgtattcgttcaaacaaatgctcgtaacgcaagaagttttcactagaaaatcagctctgtttgatcaaacagtatatccttcacctgaacgagacagtaagaaacgcagtggcttaattccccgtaagaaagggatggatcccgaaatatacggagggtacgcacacaatcaagatagctacttcgtcctagcaaaaatagaaaaagtaaaaggctacacattgcaaatagtaggagtacccatcagatctttggaaataatcaataaagcggaagacttttctacagctctgttagatataataaaaagtaaagttatgtacaacgagaaaacaggacaaccaaaaagaggaataaagaacgtagaaatccttgtaaacaagctcccatacaggcaaccaatattagaaaaagatgtatcatatatgctcggttcaagtgcttataaatacaacatgaaacaaataacactaagtagacaatctatgaaatacatcctagactacatcgatgatccaaatttcacaaaacatgaaatgacaatgatagatgaacaaaacgaacgtgaatgcttactatctgtatacgacgaaattctagaaaaagtagacaaatatttaccccttttcgatggaaacaaatttcgagaaaaactccactcagcccgaaaagaatttgtttccctatcagtagatgacgaagctagtgctatagaaaagatacttcgcggtctacacgcaaattcagaaatgcccagcttggaaaatttaaaaataaaacctgcactaggattcttccaaatgaaaaacggaataacactgagtaatgatgccgtattattataccaatcacccacagggctattcgaaagacgcgtgaaagttagtgatctattaaaatga

SEQ ID NO: 5640 - RNA, 4263 nt, synthetic construct
  misc_feature 1..4263: note = Cas9 variant
  source 1..4263: mol_type = other RNA
atggcaaaaccaaaagattacacgatcggactcgatataggtaccaattcagtaggatgggtcgtcactgacgatcaaaataatatattgagaataaaagggaagaaagcaattggagctagattatttacggaaggcaaagtagcagcgaaaagaagatcctttcgaacaactcgaagaagactatcacgaagaagatggaggattaaactactagaagaactatttgacgaagaaatcgctaaagtggaccccagcttctttgccagattacacgaatcttggatttcaccaaaagataagagaaaaagatactcagcgatcgtatttccaagccctgaagaagataaaaagtttcacgaaagttatccaacaatttaccatttaagagacaaattaatgaaagacgatcaaaaacatgacattcgcgaaatatacattgcagtccaccaaatgataaaggcaaggggaaatttcctacatgatgaaagcgtagaaacttaccgttctggaatgagttccttaggtggacgaagcgaacgaaccattctgtccgttcaaactttagaagaattaaatgacctttttgcggaaaacgaaggaactgaagaagtcgaactcaacgtagccagtgctgaacagataaacgatatactaacaggaggtcatttgaacgcggattcacagaaagaaataagtaaccttctcttgccaagctccttcccctcattcgacgacaaagcgaaagaaaaacaagtaaagaaattaatcaacaacgtcgcgacaaatatatccaaagcatggctcggatataaagccgatttttctacgatcttaaatctcgcaaaagttgataaagaccaaaagaaaatcttcgcgttcgctctacaaggggaagacgaagaagacaaagtacaagaactagaatcacttttagaacaatcccaaacagacatagttgatcgactgatagaaataaggcacgccatagttttatctgaaattgttcccgttggtatgaccttatcagaagctatgatagacaaatacgaccaacacaaagaagacctaataacattaaaagcagtaattagaaatactaaagacaagaagaaagcagcaaaactacaagccatctacgacctatatgtgaaaaaccggcatgcagacttggcaaaagcgatgaaactgacaggaataaagaaaagaagcgaattactggaccctgaagaactgaagaaaggcatatcttcactacttgacgatagccctgaagcagttgagataaaacaacgaatcgaagagaaaacatttcttccactacagagaagcaacaataatggtgtaattccaaatcaattacaccaggtagaactagatgagataattaagaaacagtctaaatattatccattcctcgcagagaaaaatccagacgaaagtgaagaagcacagaagaaagccccaaccaaactagatgcactacttactttcagagtcccctattatgtcggaccgatgataactaaagaagaacaagaagctcaaaatggccattcttttgcatggatggtaagacgcgaccctcaagaccacgaagctatcacaccatggaatttcgaaaagaaagttgacaaaatggcatcagctacacagttcataaaaagaatgactacaaaagatacatatctattaggagaagacgtactgccagcgtcatccttaaaataccaactattcacagtgcttaacgaattaaataatctaagagtcaatggtaagaaattaacatcagacgaaaaagagcaggttatagaaggtctatttaagaaacagaaaacagtaaaagctgataaatttgtaaaatactggcaagcaaaacatataggagcagacataaaagtaaaaggattatctgatccctccaaattcaattcaacgatgtctacttacattgacttcaagaaaatattcggcgaccagttaaacgatgtaaaccgacaaaatgacttcgagaaaatcatagaatactccacaatatttgaagatagaaaaatattagaagataaactaagagtagattttgcgtggctaagtgaggaacaaatcaaacaactctgcagacttagactacaaggttggggcaggttatcagacaaattacttacaagactaaccgatgcagatggacaaaacgtccttgaacgactctggaactccaacgataacttcgtgcaaatagtctccgacccaaatataaaagcaaaaatagaacaagaaaaccaaaaactactgagagactcacaaagcgataacgcagtagagtctatattagacgatgcatacacatccccacaaaacaagaaagctataaggcaagttatgagagttgtgcacgacatagttaaagcatgcgacggcaatgttccagcaaaatttgctatcgagttcgctagaagccaagaagatgatccaaaacgaacaacagcaagagtaaaccagatgcagaaaatatacgatcagatatcagacgaagtagtctcacaaggggtaaaagaacaattaagcggaatgaaatctctcaaagacaggtactatctatacttcatgcaaggaggacgcgatgcttataccggcgccaaattaaacattgacaggctatcagattatgacgtggatcacatcatgccacaaagttttgttaaagatgattctctagacaaccgagtcctagtagcacgagcagtaaacaatcaaaaatcagacaaagtaccagcactcctgttcggcaacaaagtagtagctgatctaggaataacggtaagagaaatgtgggataaatggcaaaaattaggaatgataagtaaacgaaaattgagtaacctacttactgatcctgacgcattaaccgaatatagggcgcaaggttttatccgtagacagctagtcgaaacaagtcaagtgataaaacttacagccaccatactacaatcagagttccccgactcaaaaattatagaagttccagcgaaatacaatagtattgtcagaaaacaattcgacttatataaatcacgagaagtaaacgattttcaccatgccatagatgcatatctaagcacgattgtaggaaattacttataccaggtatacccaaacctaagaagaatgtttgtctacggagagttcaagaaattttcctctaatgcagaagaatcagcacatgacgttgcaagaagagtaaaaagtatgaatttcctggacgatctattaaggggtacccacggcgacaacatctactgtagaagcacaggagaaatagtttttaatcgaaacgacatcatatccaaattaaaacaggcttacagttttaaacaaatgttagttacccaagaagtatttaccaagaaatcagcattgtttaatcaaacagtatacccctcacctaaaagagacggtagcaaaaggagcggcctaatccctagaaaaagaggcatggaccctgaaatatacggagggtatgcacacaaccaggattcacatttcgtattagcaaaaatagaaaaagtaaaagggtatacgctccaaatagtaggagtaccaataagatcccttgaaattataaataaagccgaagacttctcaactgcattactggacataataaaatcaaaagtcatgtacaacgagaaaaccggacaaccaaaaagaggaatcaaaaacgttgaaatcttagtaaataaacttccatatcgacaaccaattctagaaaaagacgtatcatacatgctcggttcatcagcatacaaatataacataaaacaaataacactaagcaggcaaagtatgaaatacatccttgactacattgatgacccaaatttcacaaaacacgaaatgaccatgattgacgaacaaaacgaaagagaatgtttactgagcgtatatgacgaaatacttgaaaaggtagataaatacctcccattattcgatggtaataaattcagagaaaaactacatagcgcgcgaaaggagttcgtatcactatcggttgacgacgaagcaagcgcaatagagaaaattttaagaggactccatgcaaattcagaaatgccgagcttagaaaaccttaaaattaaaccagcattaggatttttccaaatgaaaaacggaataaccttgtccaatgatgcagttttactatatcaaagcccaaccggtttgttcgaaagaagagtaaaggtatccgatttgttaaaatga

SEQ ID NO: 5641 - RNA, 4263 nt, synthetic construct
  misc_feature 1..4263: note = Cas9 variant
  source 1..4263: mol_type = other RNA
atggcaaaattcaacaaaaactactcaataggactagacataggagtaagttcagtaggctatgcagttgttacagatgactatcgggtccccgcatttaaatttaaagtgttaggtaatactgaaaaagagaaaatcaagaaaaatcttatcggaagcaccacgttcgtacccgcacaatctgcacaaggcacaagagtttttagggtaaaccgccgtaggatcgatcgaagaaaccaccgcatagcctacctcagagatatcttccaaaaagaaatagaaaaagttgataaaaacttttacagaagattggatgaatccttccgagtcctcggcgacaaaagtgaagaattacaaataaagcaaccattctttggtgacaaagaattagaaactgcatatcataagaaataccctaccatatatcacctaagaaaacatctcgctgacgcagacaaaaattcccctgttgcagacatacgagaagtctacatggctatcagccacatacttaaatatcgtggtcactttctgacattagatagaatcaacccaaacaacataaacatgcaaaatagctggatagactttatcgaatcatgccaagaagtatttgacctcgaaatctccgatgagagtaaaactatagttgcgatatttaaaagcagtgacaacagacaggaaaaagttaaaaagatactcagctactttcaacaagaattactaaagaaagataaatctatattcaaacaactcttacaactactctttggactcaaaacaaaattcaaagattgtttcgaattagaagaagaaccagacctaaacttctcaaaagagaactacgacgaaaatcttgaaaatttcctaggatcgctagaagaagacttcagcgatgtatttgcaaaattaaaggtactgagagataccatcctattatcaggcatgttgacctacactggaactacgagagcccgctttagtgctaccatggttgaacgatacgaagaacatagaaaagatctacaacgattcaagtcctttgtgaaacaaaatctatcagaacaagactacctagacatatttggaagaaaaacaccaaatggttttgatgttgacaaagaaacaaagggatacgttgggtatatcagtaataaaatggttctcacaaatccccaaaaacagaaaactatacaacaaaatttttatgattacatcagtggaaaaataacaggaattgaaggggccgaatactttttaaacaaaatatcggacggaaccttcttacgaaaactacgtaccactgacaatggcgcagtccccaaccagatacacgcatatgaattagagaaaattatagaccgacaaggagaagactatccatttttactagaaaataaagataaattattaagcattctcacattcaaaataccatattatgtaggaccattgagcaaaggaaacaactcgcggttcggatggatcaaaagaacaataagtcaagatatcctagacgataacgacgaagatacacggaacggcaaaataagaccatggaattatcaaaagctcattaatatggatgaaacccgtgatgcattcataaccaatctaatcggtaacgatataatcctacttaacgaaaaagtactaccaaaaagatccctcatatatgaagaggtaatgttacaaaacgagctaacgcgcgtaaaatataaagataaatatggcaaaactcacttcttcgatagcgaattgcgtcaggagattatcaataacctcttcaagacaaacaataaaagagtttcatctgctatgctgctcgattacttagaaaactatacaaacctgcaagctgttgaaatagtttctggtatagaaaaagggaaatcactcaacagcactttaaaaacatataacgatttaaaaacaatattctcagaagaattactagactccgagatataccaaaaagaactcgaagaaattgtcaaagttattacagtatttgacgacaagaaatcaatcaaaaactatctaataaaatactttggacatttagaatttcttaacgaagaaagaatcaatcaactgtctaaattacgctataccgggtggggacgatactcagctaaacttctcctcgatattagagatgaagatacaggattcaacctaatgcaatttttacgaaacgatgacgagaacagaaatctcagccaattaatatctgattcaacgctgtcgttcgactctgcaataaaatctatccaatcaaaatctacagtcgaagatgatgtatttgacgaaataaagaaactagccggaagccccgcaataaaaagaggtatacttaattcgataaaaatagtggatgaacttgttcagataatcggctacccgccccaaaacatagtaatagagatggcacgagaaaacatgaccacagaagaaggccagaaaaaggcgaaaacaagaaaaacaaaactagagtcggctttgaaaaatatcgaaaacagtgtactagaaaacggaaaggtaccacactcagatgaacaactacaaagtgaaaaactttacctttactatttacaaaacgggaaagatatgtatagcctagacaaaacaggctcccccacacccttatatagagatcaactagaccaatatgaagtagaccatattataccatattcatttttacccatcgactctatagataacaaagtactaactcatagagaaaataatcaacgcaaactgaacaatataccagacaaagaaactgtcgcaaatatgaaaccattctgggaaaaactatacaacgcaaaattaatttcacaaaccaaatatcaaagactcacaacatcggagaggacaccagacggagtactaacagaatcaatgaaagccggtttcatcgaacgacaattggtggagacccgacaaatcataaaacacgtagcgagaatattagacaatagattcttagatacaaaaataatcgcactaaaatctcaactcataactaattttcgaaacaccttccatatagccaaaatccgcgaattaaatgattaccatcacgcacacgacgcatatttggcagtcgttgtaggccaaacattattaaaggcttaccccaaacttgctccggaattaatatacggtcaccatgcacacttcaatcgccatgaagaaaacaaagctacaattcgaaaacacctatactcaaacatcatgaggttctttaacaaccccgatagcaaagtatctaaagacatctgggattgtaatagagacctaccaatcatcaaagaagttatatataatagtcaagtaaactttgtaaaacgaactatgataaagaaaggggctttctataaccaaaatcccgtcggcaaattcaataaacaaattgcagccaataacagatacccactaaaaacaaaagtatcgagcctagatacgtcaatatacggcgggtatgggcccatgaatagtgctctaagtataataataatagcagaaaggtttaatgaaaagaaaggaaaaattgaaacagtaaaagagttccatgacatatttataattgactacaagaaattcaataataaccctttccaattcttaaacgacaccagcgaaaacggattcctaaagaaaaacaacatcaatagagtattggcattttatggggttccaaaatattcattaatgcagaaaaacgatggaacacgaatgttattcgaatctaaatcaaacctccataaagctacccaatttaaacttacaaaaacccaaaacgaactcttctttcacatgcgcagactactcacaaaatccaatctcatggatttaaaatctgaatcagccattaaagaatcacaaaattttatactcaaacacaaagaagagtttgacaatatttctaatcaacttagcgcattctcacagaaaatgctaggagacacaacatctctgagaaacttaataaaaggatacaatgaaagaaaaataaaagaaattgattccagcgaagaagttataaaatacttctacgacaacttcataaaaatgttcagctttgttaaatccggtgcaccaaaaggaataaacgactttttcaataataaatataccgtggcaagaatgagaccgaaaccagacaagaaatttctaaacgctacccttatacaccaatctataaccggcctctacgaaaccagaattgatctctcaaaactaggtgaagattga

SEQ ID NO: 5642 - RNA, 4263 nt, synthetic construct
  misc_feature 1..4263: note = Cas9 variant
  source 1..4263: mol_type = other RNA
atggcaaaattcaacaaaaattactcaatcggattagatataggagtttccagcgtaggttatgcagtagtcactgacgactacagagtcccagcattcaaattcaaagtacttggaaataccgaaaaagagaaaataaagaaaaaccttatagggagcacaacatttgtaccagcacaatcagcccaaggtacaagagtgtttcgcgtaaatcgcagaagaatagaccggcgtaaccatcgcatagcttatttaagagacatattccaaaaagaaatcgaaaaagtcgataaaaacttttaccgaaggctcgacgaatcattcagagtactcggcgataaatccgaagaattacaaatcaaacaacccttcttcggagacaaagaacttgaaacggcatatcacaagaaatatcctaccatatatcacttaagaaaacaccttgcagacgccgataaaaactcaccagtagcagatatccgcgaggtctacatggccatctcccatatactaaaatatagaggacacttcctcacacttgacagaatcaacccaaacaacataaatatgcaaaattcatggattgactttatagagtcatgtcaagaggtatttgaccttgaaatttctgacgaatcaaaaactatagtcgcgatctttaaatcatcagacaacagacaagagaaagtcaagaaaatactatcatacttccaacaggagctattaaagaaagacaaatccatatttaaacagctactacaattgttattcggactcaaaacaaaattcaaagactgtttcgaattagaagaagaaccggacttaaatttctccaaagaaaactatgacgaaaaccttgaaaatttcctaggctcactcgaagaagatttcagtgacgtcttcgccaaactaaaagtattaagagatacaatactactttctggtatgctaacctatacaggaacaacaagggccagattttcagccacaatggtagaacgatacgaagaacacagaaaagacctacaaaggtttaaatctttcgtaaaacaaaaccttagtgaacaggattacctcgatatctttggccgtaaaactcccaacggtttcgacgtcgataaagaaaccaaaggatatgtaggctacatttcaaacaaaatggtacttacaaacccacaaaaacagaaaaccatacaacaaaatttttacgactatataagtggaaaaattacagggatcgaaggtgcagagtactttcttaacaaaatcagtgatggaacatttctacgcaaattacgaacaaccgacaatggtgcagtaccaaatcaaatacatgcatacgaattagagaaaataattgaccgacaaggcgaagattatcccttcctactcgaaaacaaggacaaactactcagtatcctaacttttaaaattccctactacgtaggtcctttaagcaaaggcaacaatagccgcttcggatggataaaacgaacgataagccaagatatcttagatgataatgacgaagacacaagaaatggcaagattcgaccatggaactaccaaaaactaatcaatatggacgaaacacgagatgcatttataacgaacctaattggaaacgatatcatcctacttaacgaaaaagtattacctaaaagaagcctaatctacgaagaagtcatgctacaaaacgaacttacgagagtaaaatataaagataaatacggaaaaacacatttcttcgattcagaattacgacaggaaataatcaacaatctatttaaaaccaataacaaacgtgtctcatccgctatgctactagactatctggaaaattatacgaacttacaagcagtagaaatcgtaagtggaattgagaaaggaaaatccttaaactcaactttaaaaacatacaatgacctcaaaacaatcttttcagaagaattactagactcggaaatataccaaaaagaactcgaagaaatcgtaaaagtaataacagtattcgacgataagaaatcaattaaaaattatctcatcaaatactttggacatttggagttcctaaacgaagaacgaataaaccaactgtccaaactaagatacaccgggtggggcagatactcagcaaaacttttactagatataagagacgaggacactggattcaatttaatgcaatttctaagaaacgacgacgaaaaccgaaacttatcccaattaatatccgactcaacactatcatttgattccgcaatcaagactatacaatccaaatctaccgtagaagatgatgtattcgacgaaattaagaaacttgccggttcccctgctataaaaagagggatattaaatagcataaaaatcgtagacgaactcgtacaaataattggctatccaccgcaaaacatagtcatagagatggctagagaaaatatgactaccgaagaggggcagaaaaaggcaaaaacaagaaaaactaaactagagtcagcattaaagaatattgagaactcagtattagaaaatggaaaagtcccacacagcgacgaacaactacaatctgaaaaactatatctttattaccttcaaaatggaaaagacatgtacagtctagataaaaccggaagcccaacaccactatatagagaccaactagaccaatacgaagtcgatcatataatcccctacagcttcctacctatagactccatagacaacaaagtcctaacacatagagaaaacaaccaacgaaaactaaacaacatacccgacaaagaaaccgtcgcgaacatgaaaccattctgggaaaaactttacaatgcaaaattaattagccagacgaaataccaaagactcacaacttcagaacgcactcctgacggagtattaaccgagagtatgaaagctggattcatagaacgccagctagtagaaaccagacaaataataaaacacgtagcacgcattcttgacaacagatttctcgacacaaaaataattgcactcaaaagccaactaatcaccaattttaggaacaccttccatatcgctaaaattagagaactaaatgactaccaccatgcacatgatgcttatctagccgttgtagttggtcaaactcttctaaaagcatacccaaaactcgcacccgaactcatatacggccatcacgcacatttcaatagacatgaagaaaataaagcaacgataagaaaacatctgtacagcaacatcatgagattcttcaataacccagattccaaggtcagtaaagacatctgggattgcaatagagatcttccaatcattaaagaagtgatctacaactcacaagtaaattttgtaaaaagaaccatgatcaagaaaggagccttttataaccaaaatccagtaggaaaattcaacaaacaaatagccgcaaataatagatatccattaaaaacaaaagtttccagcttagatacttcaatttacggcggatacggccccatgaactccgccctttctattatcattatagcagaaagattcaatgaaaagaaaggaaaaatagaaaccgtcaaagagttccatgacatttttataatagactataagaaattcaataacaaccctttccaatttctcaatgatacaagtgaaaacggtttcttaaagaaaaacaacataaaccgcgtcctagcattctatggcgtacctaaatattctttaatgcagaaaaatgacggaacccgcatgttattcgaaagtaaatcaaatttacacaaagcgactcaattcaaactaaccaaaactcaaaacgaactattctttcacatgagaagactccttacaaaaagcaacctcatggacctaaaaagtgaatcagctattaaagaatcccaaaattttatacttaaacacaaagaagagtttgataacatctctaaccaactatccgccttctcacagaaaatgctaggagacaccaccagcctaagaaacctaataaaaggatacaacgaaagaaaaattaaagaaatagatagtagcgaagaagttattaaatatttttatgacaattttataaaaatgttctcttttgtaaaatctggtgcaccaaaagacataaatgatttcttcaacaacaaatacactgtagcaagaatgagacctaaacccgacaagaaatttctgaatgctacattaattcatcaatcgatcacaggtctttatgaaactcgtatagacctctccaaactaggagaagactga

SEQ ID NO: 5643 - RNA, 4263 nt, synthetic construct
  misc_feature 1..4263: note = Cas9 variant
  source 1..4263: mol_type = other RNA
atggccaagttcaataagaattatagtataggacttgatataggagtaagctcagtaggatacgctgttgtaacagatgattacagagtccccgcattcaaattcaaagttctgggaaataccgaaaaggagaaaataaagaaaaatttaatcggcagcactacatttgttccagcacaatcagcacaaggtacaagagtttttcgagtaaatagaaggagaatcgacaggagaaaccatcgaatagcttatttacgagatatcttccaaaaagaaatagaaaaagtagataaaaatttctaccgaagactggatgaatcctttcgcgtattaggagacaaatcagaagaattacagatcaaacagccatttttcggggacaaagaactagaaacagcatatcacaagaaatacccaactatataccacttaagaaaacaccttgcagacgccgacaaaaactctcctgttgctgatattcgagaagtatatatggcaatatcacacattttaaaatatcgaggtcatttccttacattagaccgcataaacccaaataacataaacatgcaaaattcatggattgacttcattgaaagctgccaagaagtatttgaccttgaaatcagcgacgaatcaaaaactatagtagcaatatttaaatcgtccgacaatcgacaagaaaaggtaaagaaaatcctatcatacttccaacaagaactgctaaagaaagataaatcaattttcaaacaactattacaactactattcgggctgaaaaccaaattcaaagattgctttgaactagaagaagaaccagacctaaacttctcaaaagagaactatgatgaaaatttagaaaacttcctaggatctttagaagaggatttttcagatgtttttgctaaacttaaagtattgcgagacactatcttactttcaggaatgctcacgtataccggaacaacacgagctcgattttccgccacgatggtcgaacgctacgaagaacatagaaaagacttacaaagattcaaatcattcgtcaaacaaaacctaagcgagcaagactatttagatatattcggtagaaaaacacccaatggcttcgacgtggataaagaaacaaaaggttacgtaggctacatatccaacaaaatggtacttactaacccccaaaaacagaaaacaatacaacaaaacttttacgactatatatccgggaaaataacaggaatagagggcgctgaatatttcttaaacaaaatttcagacggcacattcctgcgcaaactgcgcaccacggacaatggagctgtgcctaatcaaatacatgcatatgaactagaaaagataatcgaccggcaaggcgaggactatccattcctgctagaaaacaaagataaactactaagcatactcacattcaaaataccgtattacgtgggaccactatctaaaggaaacaattccagattcggttggatcaaaagaacaatatcacaagatatactggatgataacgatgaagacaccagaaacgggaaaatacgaccttggaattaccaaaaactcataaatatggacgaaaccagagacgcctttataactaatctaattggtaacgatataatcctattaaacgaaaaagtactcccaaaacgctccttgatatacgaggaagttatgcttcaaaacgagcttacccgagttaaatacaaagacaaatatggtaaaacccacttctttgactcagaattacgccaagaaataatcaacaacctctttaaaacaaacaacaaaagagtatcatccgccatgttactcgattacttagaaaactacaccaacttgcaagcagttgaaattgtttcaggcatagaaaaaggtaaatctttaaactccacgttaaaaacatataacgatttaaaaacaatcttttcagaggagttattagactcagaaatatatcaaaaagaactagaagaaattgttaaagtaataaccgtctttgacgacaagaaaagtatcaaaaattacctaataaaatatttcggacacttagaatttttaaacgaagaaagaataaaccaactctcaaaactgaggtacaccgggtgggggcgatacagcgctaaactactcctagacatacgcgacgaagataccggatttaacctgatgcaatttctgagaaacgatgacgaaaacagaaacttatctcaacttatatcagactcaacattgagttttgactccgcaatcaaatcaatccaaagcaaatctacagtagaagatgatgtattcgacgagattaagaaactagctggaagccctgccattaaaagaggaatactcaactctataaaaattgtggatgaacttgtccaaataataggctacccgccacaaaatatagtaatcgaaatggcccgagaaaacatgacaactgaagaaggacaaaagaaagcaaaaacaaggaaaaccaaacttgaatcggcactcaaaaatatagaaaacagcgttttagaaaatggcaaagtcccacattccgacgaacaactacagagcgaaaaactctatttgtactatttacaaaacggaaaagacatgtattcattagataaaacaggttcacctacacctctctacagagatcagttagatcaatatgaagtagatcacataattccatattcattcttaccaatcgactctatagacaacaaagtcctgacccatagagaaaacaatcaaagaaaactaaacaacataccagacaaagagaccgttgcaaacatgaaaccattttgggaaaaactctataatgcaaaacttatatcacaaacaaaataccaaaggctaacaacatcagaaagaacacccgacggggtgctaacagaaagtatgaaagcaggcttcatcgaaagacaattagtagaaaccagacaaattataaaacatgtagcccgcatactagacaatagattcttagacacaaaaatcatcgctctgaagtcacaattaataaccaactttagaaatactttccacattgccaaaatacgagaactcaatgattaccatcacgcacacgatgcatacctggcagtagtcgttggtcaaacacttttaaaagcctatcccaaactagctccagagctaatttacggacaccacgcacacttcaacagacacgaagaaaacaaagcgacaataaggaagcacctttactcgaatataatgcgatttttcaacaacccagacagtaaagtttcaaaagacatctgggattgcaaccgtgacctgcctataataaaagaagtaatatataactcacaggttaacttcgtaaaacgaacaatgatcaaaaagggcgcattctacaaccaaaatccagtaggaaaattcaacaaacaaatagccgccaataacagatacccattaaaaacaaaggtttcttcactcgacacctccatatacggtggctatggccctatgaactctgcactcagcataataataatagccgaacgttttaatgaaaagaaaggaaaaatagaaacagttaaagagttccatgatatttttataatagactacaagaaatttaacaataacccctttcaatttctaaacgacacatcagaaaatggattcttaaagaaaaataacataaacagggtattagccttctacggagttcccaaatacagcttgatgcagaaaaacgatggaactaggatgttatttgaaagtaaatcaaatcttcacaaagcaacccaattcaaactcactaaaacacaaaatgaattattctttcatatgagaagactattaacaaaaagcaacctaatggatttaaaatctgaatcagcaatcaaagaatcacaaaactttatactaaaacataaagaagaatttgacaacatatcaaaccaattatcagcattttcacagaaaatgctcggagacacaacctcactgagaaaccttataaaaggatacaacgaaagaaaaataaaagaaatagactcctcagaagaagtaattaaatacttctacgacaacttcataaaaatgttcagttttgttaagtcaggtgctccaaaagatataaacgactttttcaataacaaatacacggtagctcgtatgcgtccaaaaccagacaagaagtttttaaatgcaacactcatacaccaatcgataactggtctctacgaaaccagaatagacctgtcgaaattaggagaagactga

SEQ ID NO: 5644 - RNA, 4263 nt, synthetic construct
  misc_feature 1..4263: note = Cas9 variant
  source 1..4263: mol_type = other RNA
atggcaaagtttaataaaaactatagtataggtctagacataggagtaagcagtgtaggatacgcagtcgtaacagaagactaccgagtaccagcctttaaattcaaagtcttaggaaacactgaaaaagagaaaatcaagaaaaatctaataggttccacaacattcgtccccgcacaaagtgcacaaggaacaagagtattccgagtaaacagacgccgtatcgaccgcagaaatcaccgaattgcatacctacgtgatatctttcagaaagaaatagagaaaatagataaaaacttctatagacgactagatgagtcatttagagttctcggcgacaagtccgaagacattcaaatcaaacagccctttttcggaaataaagaattagaaacagcctatcacaagaaataccctacaatataccacctcagaaaacacctagcagatgccgacaagaactcccctgtagctgacatcagagaagtatatatggttctatcgcacatcttaaaatatagaggccacttcctcacgctgggcaaaatagatccaaataacataaatatgcaaaacagttggatagattttatcgaaagttgccaagatgcattcgacttagaaatctcagacgaaagcaaaacaatagcagccatctttaaaagcagcgaaaaccgtcaagaaaaagtcaaacaaatactgagttatttccaacaagaactattaaagaaagataaatcaattttcaaacaattactacaattattattcggattgaaaacaaaattcaaagactgttttgagttagaagaagaacccgacttaaattttagtaaagaaaactatgacgaaaatcttgaaaatctgctcggcgcactcgaagaagatttctcagatgtattcgccaaactaaaaatactacgggacaccatcctgctcagctctatgcttacgtataccggtgccacccatgctagattttcggcaaccatggtagaaagatatgaagaacaccgtaaggacctccaaaggttcaaatcattcgtaaaacaaaatctttcagaacaagattacctcgacatattcggaagaaaaacaccaaccggattcgacgtagacaaagagaccaagggttatgtaggatatatctctaacaaaatggtcctaacaaatccacaaaaacagaaaaccatacaacaaaatttttacgattacatctccggcaaaataactggaattgaaggagcagagtgctttctaaacaaaatatctgacggaacctttttgagaaaacttcgaactactgacaatggtgcaatacctaatcaaatacatgcatatgaattggagaaaattatcgaaagacaaggtcgtgattatccattcctactagaaaataaagataaacttctctcaatcctcacattcaaaatcccatactacgtcggcccactcgctaaaggaaataacagtcgcttcgcatggataaagagaaccacatcacaagatgtacttgatgataatgatgaagacacgcgtaatggcaaaatcagaccctggaactaccataaacttattaacatggatgaaacccgagatgcgttcataataaacctaataggaaacgacataattcttctcaacgaaaaggttctaccaaaacgcagcttaatatacgaagaagtaatgctccaaaatgaactaacaagagtaaaatacaaggacaaatacggcaaaatacatttctttaatagcgaactgagacaagagataatcaacaacttattcaaaactaactcaaaacgagtctcaagtgcaatgctactaagttacctcgaaaatttcaccaacctacaagcagttgaaatagtttcgggaatagaaaaagggaagtcgctaaattcaactcttaaaacttataacgatttaaaaaccatattttcagaagaattattagactctgaaatttatcaaaaagaattagaagagataataaaagtaataactgtttttgacgacaagaaatctattaaaaactatttaacaaaatacttcggacatctagagttcttaaacgaagagaaaataaaccaactatcaaaactaagatacactgggtggggccgttattccggtaaactacttttaggaataagagacgaagacacaggcttcaacctaatgcaatttctacgaaatgacgacgaaaacaggaatctaacacaattaatcagcgatacaaccctgtcatttgactcagcaattaaagcaatccaatccaaaagtactgtggaagatgatgttttcgaagaaatcaaaaacctagcaggtagccctgcaataaaaagaggtatactcaattcaattaaaattgtcgacgagcttgtacagattataggctaccctccccaaaatatcataattgaaatggctagagaaaacatgactacagaagaaggccaaaagaaagcaaaaacaagaaaatcaaaactcgaatcagcactcaaaaacatagaagactctgtattagagtcaggaaaagtaccccattccgatgagcaactccaaagtgaaaaactttacctatactatcttcaaaatggaaaagatatgtactctctagacaaaacaggaagcccaacccctctctacagagaccagttagaccaatatgaagtagatcacattattccatattcattcctcccaatcgactcaatcgataataaagtcctaacccaccgagagaataaccaaagaaaactgaataacatacctgataaagaaacagtggccaacatgaaaccattttgggaaaaactatacaacgcaaaactgatatcacaaacaaaatatcaaagattaacaacttcagagagaacacccgacggtgttctcacggaaagcatgaaagctggctttatagagagacaactcgttgaaacccgtcaaataataaaacatgtagcacgaattttagacaacagattctccgacaccaaaattattacattaaagtcacagctagtaacaaacttccgaaacacatttcatatagccaaaataagagaattaaatgactaccatcacgctcacgacgcatatctagctgttgtcgtgggacaaactctattaaaagcatatcccaagctagcaccagaactaatttacggacaccacgcacatttcaatagacacgaagaaaacaaggcaaccctaagaaaacacttatactctaatattatgcgtttctttaacaacccagacagcaaagtaagcaaagacatatgggattgtaacagggaccttcctatagttaaagacgttatatataactcccaaatcaactttgtgaagcgaactatgattaagaaaggagcattttataaccaaaatcctgttgggaaactaaataaacaaatagcagctaacaatcgataccccttaaaaacaaaagttagcagcctcgacacaagtatttacggtggttacggtcccatgaactcagcactgtcaatcattataatcgccgaaagatttaatgaaaagaaaggaaaaattgaaactgtcaaagagttccacgacatctttataatagattatgaaaaattcaacaacaatccatttcaattcttaaacaacgtttcagaagaaggattcctaaagaaaaacgacttaaacagagtcttagccttctaccgcatctccaaatatagcctaatgcagaaaatcgacggcacaagaatgctattcgaaagtaaatctaacctccataaagtaacacaatttaaactaacaaagacccaaaacgaattatttttccacatgaaacgcttactaaccaaatccaatctaatggacctaaaatctgaatccgccatcaaagaatcccaaaactttatacaaacccatcaaaacgaatttgataacatcgctgatagactttcaaattactcacaaaagatgctaggcgaaaccaaatcattacaaaccctaattaatggctacaatgaacgtccgattaaacagatagataacaatgaagaaactataagatattactacgacaactttattaaaatgttctcttttgtaaaatcaggagcacccaaagacatcataaatttctttaatgacaaatacacagtacctcgaatgagacctaagccagacagaaaaatgctagacgctacactaatacaccaatcaataacaggtctctacgaaacgcgaatagacttaagcaaacttggtgaagactga

SEQ ID NO: 5645 - RNA, 4263 nt, synthetic construct
  misc_feature 1..4263: note = Cas9 variant
  source 1..4263: mol_type = other RNA
atgtcacgtaaaaattacgtagacgattacgcaattagcttagacataggaaacgcatcagtcggatggtcagcgttcacacccaattatagattagtaagagccaaaggacatgaactaataggagtacgtttatttgatccagcagacacagctgaaagtagacggatggcgcgtacaactcgtagacggtattcgagaagacgatggagactaaggctcctagacgctctattcgatcaagctcttagcgaaatagacccatccttcctcgcacgaagaaaatatagctgggtacatccagatgacgaaaataacgccgactgttggtacggaagcgtattatttgactcaaatgaacaagacaaacgtttctatgaaaaatatccaacaatataccatttacgtaaagcattaatggaagatgactcacaacatgatatacgagaaatttatctggcaattcaccacatggttaaataccgaggtaatttcctagtggaaggaactttagaaagctctaatgcgtttaaagaagatgaattattgaaactcctaggccgaataacaagatacgaaatgagcgaaggagagcaaaacagtgatatagagcaagacgatgaaaacaagctagtggcgccagcaaatggacaactagccgatgcactttgcgctacaagggggtcgagaagtatgagggtcgacaatgctttagaggctttaagtgcagtgaacgatttgtcaagagagcagagagcaatcgtgaaagcaattttcgcgggacttgaaggtaataaactagaccttgcaaaaatatttgtcagtaaagaattttcatcagaaaataagaaaatattaggaatatattttaataaaagtgattacgaagaaaaatgcgtacaaatagtagatagtggtttattagatgatgaagaaagagaatttttagatagaatgcagggacaatataatgccatagcgctgaaacaattactcggtcggtcgacatctgtaagtgattccaaatgtgcctcatatgacgcacatcgtgcaaattggaatctaataaaactgcaattacgaacaaaagaaaatgaaaaagatataaacgaaaactatggaattttagttggctggaaaatagatagcggacaaaggaaatctgtaagaggagagagtgcatacgaaaacatgcgaaagaaagcaaatgtatttttcaagaaaatgattgaaaccagcgatttgtcagagactgataaaaaccgactgatacacgacatcgaagaagataaactattcccaatacaacgagacagcgacaatggcgtcataccacatcagctacatcaaaatgaattgaaacaaataatcaagaaacaaggaaaatactatccattccttttagatgcatttgaaaaagatggaaaacagattaacaaaatagaaggcttgttaacattcagagtgccctattttgtcggaccgctagtggtaccagaagatctacaaaaatcggacaattccgagaaccactggatggttagaaagaagaaaggcgaaataactccatggaatttcgacgaaatggttgataaagatgcctcaggtcgaaaatttatagaacgattggtaggaacagactcctatctactaggagaaccaactcttcctaaaaattcattactttaccaagaatatgaagtactaaacgaactaaacaacgtaagactatcagtaagaacaggtaatcattggaacgataaaagaaggatgcgattaggcagagaagagaaaactttattatgtcagagactatttatgaaaggtcaaaccgtaactaaaagaaccgcagaaaatctcctaagaaaagaatacggaagaacttacgaactctcagggctgagcgatgaaagtaaatttacgagctcattatcaacatacggaaaaatgtgtaggatatttggagaaaaatacgtgaatgaacatagagatttaatggagaaaatcgttgaattacaaacagtattcgaagataaagaaacattattgcaccaactaaggcaattagaaggaatatctgaagctgactgtgcacttttagtgaatacacattataccggatggggtcgactatcaagaaaactactaacaacaaaagccggggaatgtaaaataagtgacgactttgccccacgaaaacactcaataatagaaataatgcgagctgaagacaggaacctgatggaaatcataacggataaacaattgggttttagcgattggattgaacaggaaaatttaggagccgaaaatggaagctcattaatggaagtagtagacgacttacgagtatcaccaaaagttaaaagaggaataatacaatctattcggcttattgacgacatttcaaaagctgttggaaaacgaccaagtcgaatattcttagaactagcagatgatatacagccatcaggcagaacaattagccgaaaatccagactccaagacttatatagaaacgcaaacctaggaaaagaatttaaagggatagccgatgaactcaatgcatgcagtgataaagacctacaggatgacagattgttcctatattacacacaattgggaaaagacatgtatacaggcgaggaactcgatttagatcgactctccagtgcgtatgacatcgatcacattattccacaagctgtgactcaaaacgatagtatagacaaccgtgtattagtggcgagagcagaaaatgcacgaaaaactgactctttcacatacatgccacagatagcagaccgtatgcgcaatttttggcaaatactactagataacggtctcatatcaagagtaaaatttgaaagactaactcgccaaaatgaattttccgaaagagaaaaagaaagattcgtacaacgcagcttagttgaaactagacaaataatgaaaaacgttgcgactctgatgagacagcggtatggtaacagtgcagctgtaatcgggcttaatgcagaattaactaaagaaatgcatagatatctaggattcagtcacaaaaatagagatatcaatgattatcaccatgcacaagatgctctgtgcgtagggatagccggacagttcgcagcaaatcgaggatttttcgccgatggagaagtaagcgatggcgctcaaaacagctataatcaatacctacgcgactatcttaggggctatagagagaaattgtcagccgaagatcgcaaacaaggacgagcgttcggatttattgtaggatcaatgaggtcgcaagatgaacagaaaagggtaaatcctagaacaggtgaagttgtatggagtgaggaagacaaagattaccttcgaaaagtaatgaactaccgaaaaatgttagtgacccaaaaagtaggagacgactttggagctttatatgatgagacaagatatgctgctaccgatccaaaagggatcaaagggatacccttcgatggagccaaacaagacacaagtctatatggaggtttcagctctgcaaaaccagcatatgcggttctaatagaaagcaaaggaaaaactagactcgttaatgtaacgatgcaagaatacagtttgctaggtgatagaccaagtgatgacgagttaagaaaagtactagctaaaaagaaatcagaatacgcaaaagcaaatatcttactaagacatgttcctaaaatgcaattgatacgatatggaggaggattaatggtaataaaaagcgcgggggagttaaacaacgcccaacaattatggctaccatatgaagaatactgctatttcgatgatttatcacaaggaaaaggatctcttgaaaaagatgatttgaagaaacttctcgattcgatacttggatcggtgcaatgtctatatccctggcacagatttaccgaagaggaactagctgatttgcatgtagcgtttgataaactaccggaagatgaaaagaaaaatgttatcactggaattgtaagcgcgttacatgcagatgcaaaaaccgcaaacttaagtatcgtcggaatgactggttcatggcgcaggatgaataataaatcaggatacacattttccgatgaagatgaatttatatttcaatcaccctctgggttattcgagaaaagggtgacggttggggaattaaaaagaaaagcaaagaaagaagtaaattcaaaatacaggacaaacgagaaaagactacctacgcttagtggagcctcacaaccatga

SEQ ID NO: 5646 - RNA, 4263 nt, synthetic construct
  misc_feature 1..4263: note = Cas9 variant
  source 1..4263: mol_type = other RNA
atggcaaaaccaaaagattatactataggactagatattggaacaaatagtgtaggatgggttgtgacagacgatcaaaataatatacttagaataaaaggcaagaaagctataggagcacgtctattcgcagaaggaaaagtagctgctgaaagacgatcatttcgtacgacaagaagaaggataagtcgtcgtagatggagaataaaattattagaagaattatttgatgaagaaatagccaaagtagatccaagtttctttgctaggctacatgaaagctggatatccccaaaagacaaaagaaaacgatactcagccatagtttttcctagcccagaagaagataagaaatttcatgaaagttacccaacaatataccacctcagagataaactaatgaaagacgatcaaaaacatgatataagagagatctacatagcagttcatcaaatgataaaagttcgtggaaactttctgcatgatgaatctgtcgaaacatatcggtctggtatgagttctctaggaggaagaagcgaaagaaccatcctaagcgtacaaacacttgaagaattgaacgatctattcgcagaaaatgaaggaacagaagaagtagaactcaacgtcgcgtccgccgaacaaatcaatgacatattaacgggtgatcatctaaacgcagactctcaaaaagaaattagcaacttacttttaccatcatcatttccctcattcgacgacaaagccaaagaaaaacaagtgaagaaactgataaacaacgtagccactaatataagtaaagcatggctaggatataaagcagacttttcaacaatactcaacttagcaaaagtagacaaagatcagaagaaaatattcgcgttcgcactccaaggaggagacgaagaagataaagtacaagaattagaaagtctcctcgaacaatcccaaacagatatcgttgatagacttattgaaatcaggcacgcaatagtgctctctgaaatagtaccagtaggaatgacattaagcgaggcaatgatagacaaatatgatcaacataaagaagacctaattacattaaaagccgttattagaaacacaaaagacaaaaagaaagccgccaaacttcaagctatatacgacctatatgtaaacaacagacatgcagatcttgctaaagcgatgaaactcacaggaatcaagaaacgatcagaactacttgacccagaggaattaaagaaagctatatcgagccttttagacgattctccagaagctggggagatcaaacaaagacttgaagggaaaacttttcttccattacaaagatccaacaacaatggtgtaataccaaatcaactccaccaagttgagttagacgaaatcatcaagaaacaaagcaaatactacccatttctcgcggagaaaaatcccgacgaatcggaggaggcacagaagaaagctcctacaaaattagacgcattactgactttccgtgtgccatattacgtaggccctatgattacaaaagaagaacaagaagcacaagacggtcacagtttcgcatggatggtaagaagagacccacaagaccacgaagcaataacaccttggaatttcgagaagaaagttgacaaaatggcaagtgccacacaattcatcaaaagaatgacaacaaaagacacatatctattaggagaagacgttttaccagccagctcactaaaatatcaattattcactgtattaaatgagttgaacaatctacgagttaatggcaagaaacttacaagtgacgaaaaagagcaagtcatagaaggcttgtttaagaaacagaaaacagtaaaagccgataaattcgtaaaatactggcaagcaatacacatcggcgcagacataaaagtcaaaggactttcagatccatcgaaatttaactcaacaatgtcaacttacatagactttaagaaaatattcggtgatcaactcaacgatgcgaaccgccaaaacgactttgagaaaatcatcgaatactcaacgatatttgaggatagaaaaatcctagaagacaaacttcgagctgattttgcttggctaagcgaagaacaaataaaacaattatgccgtctaagacttcaaggatggggccggttatcagataaattactcacgaggttgacagacgcagacggacaaaatgtactagaaagactctggaactccaacgacaatttcgtacaaatagttagcgacccgaacattaaagcaaaaatagaacaagaaaatcaaaaactgttacgcgatggacaatcagatgacgctgtagaatccatattagacgacgcatacacatcaccacaaaacaagaaagcaatcagacaggtgatgcgcgtagtacatgacatagtaaaagcctgcgacggtaatgtgcctgcaaaatttgctattgagttcgcacgaagtcaagaagatgacccaaaaaggactacagcgagggtaaaccaaatgcagaaaatatacgatcaaatttcggacgaagtagtctcacaaggcgtaaaagaacaactctcgggaatgaaatccttaaaagaccggtattatttgtactttatgcaaggtggacgagatgcatacacaggagctaaactgaatatcgaccgattgtcagattacgatatcgaccatataatgccgcaatcatttgtcaaagacgactccctcgacaacagagttcttgttgcaagagcagtcaataaccaaaaatccgataaagttccagctttcttattcgggaacaaagtggtagcagatctaggaataactgttagagaaatgtgggataaatggcaaaaactaggaatgataagtaaacgaaaattatcaaacctactaacagatccagatgcactaacagaatatcgagcccaaggctttatacgccgccagctagttgaaaccagtcaagtcataaaacttacagctactatcctacaaagcgaatttccagactcaaaaataatagaagtaccagcaaaatacaactctatagttagaaaacaatttgatctttataaaagtagagaagtcaacgattttcaccatgcaatcgatgcctacctgtccacaatagtaggaaactatctgtaccaagtttaccctaacttacgcagaatgtttgtttatggagaatttaagaaattttcatcaaacgcagaggaatcagcacatgacatggctagaagagttaaatctatgaatttcctagatgacctactaagaggaacacatggagacaacatatattgtagatccaccggtgaaatcgtcttcaacagaaatgatataatcagcaaactaaaacaggcttatagttttaaacaaatgctggtaacacaagaagtcttcactagaaaatctgcccttttcgaccaaacagtctacccctcacccgagagggatagcaagaaaagaagtggcttaattccaaggaagaaaggaatggatacggaaatatacggaggatacagtggaaataaagatgcatattttgtgctagcagaggcagtaaaagaaaaaggacatactctacaaatcgtaggcgtcccgatacgagcactgaatacactgaaaaattcagcaaactattcagaaaaattacttgaaattataaaaccacaagtaatgtttaacaagaaaaatggtaaacctaagaaaggtgtaaatgatgtaaggatattaatggataacatcccgtatagacaacctgtactagaagggggagctttatatatgttaggtagcagcacatataaatatagtctcaaacaaattacattaagccaggaatcaatgaaatatatattagactatattgacgaccccagcttcaataaacacattatggtgaacatagatcatcaagatgagaagaaatgcctactatcagtatatgacgaaattttagataaaatggacaaatatctaccattattcgacataaatggattccgcaaaaagctccatgacggacgagaaaaatttgtaaaacttcctgtagagaaacaagccgaagttgtaaaggatatactcagagggctccatgctaacagtgaaatgactaaaccatcagatctcggcctaacaacagcattaggattcatgcaagcaccagatggcataaaaatatccgatgatgcagtatttatatatcaatcgccgacaggtttatttgaaagacgtgtcaaagtgtcagatttgctaaaatga

SEQ ID NO: 5647 - RNA, 4266 nt, synthetic construct
  misc_feature 1..4266: note = Cas9 variant
  source 1..4266: mol_type = other RNA
atgacaaaattcaataaaaactactcaataggcttagatatcggagttagtagcgtcggttatgcagtagtaacagaagactaccgagtacccgccttcaaattcaaagtcttaggaaacactgaaaaagaaaaaataaaaaaaaatctcataggatccaccacttttgtaagcgcccaaccagctaaaggtacacgcgtatttagagtaaacagaagacgaatcgaccggagaaaccacagaattacatacctacgtgacatatttcagaaagaaatagaaaaagttgataaaaatttctatagacgattagatgaaagctttagagttcttggagacaaatcagaagaccttcaaataaaacaaccattcttcggggacaaagaattagagacagcgtaccataaaaaatacccaacgatataccatctacgcaaacacttagcagacgcagacaaaaactctccagtcgcagacatacgcgaggtttacatggcgatatcgcatattttaaaatatagaggtcactttttaaccttagacaaaataaacccaaataatattaacatgcaaaattcatggatagatttcattgaatcatgccaagaagtatttgatttagaaatcagcgacgagtcaaaaaacatagcggatatattcaagtcaagcgaaaaccgacaagaaaaagtaaaaaaaattctcccatactttcaacaagaactgctaaaaaaagataaatccatattcaaacaacttctacaattacttttcggtctcaaaaccaaattcaaagattgttttgagttagaagaagaaccagacctcaacttttcaaaagagaactacgacgagaatttagaaaactttctcggcagcttagaagaagactttagtgacgtatttgcaaaattaaaagtccttcgagatactatactattatcaggtatgctcacgtatacaggagcaacacacgcacgattctcagcaaccatggtcgaacggtatgaagagcatcgcaaagaccttcaaagatttaaattctttataaaacaaaatctaagcgaacaagattacctcgatatctttggtagaaaaactcaaaacggattcgatgtcgataaagaaaccaaaggctacgtcggatacatcactaacaaaatggttctgacaaacccacaaaaacaaaaaacaatacaacagaacttttacgactacattagcggtaaaatcacaggaatagaaggtgcagaatacttcctaaacaagatatcagacggaaccttcctgcgaaagttaagaacctcagataatggcgcaataccaaaccaaatccatgcatacgaactcgaaaagattatcgaacgccaaggtaaagattacccattcctgttagaaaataaagacaaactactaagcatcttaacctttaaaatcccctactatgttggaccacttgcaaaaggatccaactcacgatttgcttggataaaaagagcgacttcaagcgacattttagatgacaatgacgaagacactaggaacggaaaaatacgtccatggaactaccagaaattaataaacatggatgaaacacgcgacgccttcatcactaacttaataggaaacgacatcatcctcttaaatgaaaaagtcttacccaagcggagccttatctacgaagaagtcatgcttcaaaacgaactaaccagagtaaaatacaaagacaaatatggaaaagcacacttcttcgatagcgaactaaggcaaaatattataaacggcctatttaagaacaattctaaaagagtaaacgccaaatcattaataaagtacttaagcgataaccataaagaccttaatgctatcgaaattgtatctggagttgagaaaggaaaatctttcaacagcacactaaaaacttataatgacctaaaaaccatcttcagcgaggaattattggatagcgaaatttatcagaaagagctcgaagaaataattaaagtaatcacagtttttgacgataaaaaatcgataaaaaactatcttactaaattcttcggtcacttagaaattctagatgaagaaaagattaatcagctctcaaaactacgttattccggttggggaagatacagtgctaaattacttctcgacatacgtgacgaagatacaggattcaatttactacaattcctccgtaatgatgaagagaacaggaaccttaccaaattaatatcagacaataccctaagctttgagcccaaaattaaagatatacagtccaagtctaccatagaagacgacatcttcgacgaaatcaaaaaactagcaggctcgccagccattaaaagaggcatcctcaactcgataaaaatagttgatgaactagtacaaatcatcggataccctccacataacatagtcatagaaatggcaagagaaaatatgactaccgaagaaggtcaaaaaaaagcaaaaacacgtaaaacaaaattagaatcagcactaaaaaacatcgagaactcactattagaaaacggaaaagtaccacactccgacgaacaactacaaagcgagaaactttacctatactaccttcagaacggcaaagatatgtacacactagacaaaactggttcaccagcaccactatacctggaccaattagatcaatacgaagttgaccacataataccatattctttcctccccatagattcgattgacaacaaggtattaactcatagagaaaacaatcaacaaaaattaaacaacataccagacaaagaaaccgttgcaaatatgaagcccttctgggaaaaactatacaacgcaaaactaataagccaaacaaaataccagagacttacaacaagtgaaagaaccccagacggtgttctaacggaatcaatgaaagcaggctttatagagagacaactagtagaaacgcgacaaattataaaacacgtagctcgaatcttagacaaccgattttccgacaccaaaataataacactaaaatcgcaactcataacaaacttcagaaatacgttccacatagcaaaaattcgagaacttaacgattaccaccatgcacacgacgcataccttgcagtagtcgtaggacaaacattattaaaagtttacccaaaactggcacccgaattaatatatggccatcatgcacacttcaaccgacacgaagaaaacaaagcaaccctcagaaaacacctatatagcaacataatgagattcttcaacaatcccgattctaaagtaagtaaagacatatgggattgcaatcgagacttaccgattattaaagacgtaatctataactcacaaatcaatttcgtaaaacgaacaatgataaaaaaaggagcattttacaatcaaaatccagtaggaaaatttaacaaacaactggctgcaaacaaccgatatccactaaaaaccaaggcattatgcttagatacgagtatttatggcggctacggcccaatgaactccgctctatcaataataataatcgccgaacggtttaacgaaaaaaaaggaaaaatagaaacggtcaaagagttccatgacattttcatcatagattatgaaaaatttaacaacaatccttttcaattcctaaatgataccagtgaaaatggatttctaaaaaaaaataacattaacagagtactcggcttttaccgtattcccaaatacagtctaatgcaaaaaatagacggaaccagaatgctattcgaaagcaagagtaatttacacaaagcaacacaatttaaattaactaaaacacaaaacgaactattctttcacatgaagagattattaaccaaatcaaatttaatggatctaaaatctaaaagcgcgataaaagaatcacaaaacttcatactcaaacacaaagaagaattcgacaatatatccaatcaattaagtgccttctcccaaaaaatgttgggaaacacaacttctctaaaaaacctgatcaaaggatataatgaaagaaaaataaaagaaattgacataagggatgaaaccataaaatacttttacgataattttataaaaatgttttcattcgtcaaatcaggggctcccaaagacataaacgacttctttgacaacaaatgtactgtagctagaatgcgaccaaaacccgataaaaaattattgaatgcgacccttatacaccaaagcattactggactatacgagacgcgaatagatctaagcaaactaggtgaagactga

SEQ ID NO: 5648 - RNA, 4266 nt, synthetic construct
  misc_feature 1..4266: note = Cas9 variant
  source 1..4266: mol_type = other RNA
atgaagaaaatattgggactcgacctaggtcccaacagtatcggatgggccttagtaaacgaagcagaaaatgaaaatgaaaaatccagcatcatcaaaattggatcaagggtcatccattatggagataaccttgtcaaagtcgataaatcgggtaaaatctctgcatcaatgacaccagaagaagacttcagttctggaaaaggattatcaccgaacgcgggacggacaaaacaaaggtcagcacgaagaaacttacaacgatacaaacaacgacgtaataacttaatagaaatcctaaaagcacactccctaatagataataatttcatattctcagaagaaggaaatgaaacaactttcaaaacatacaaaaatcgagccctagccgccacaaatgaaatatcactagaagatttcattaaagtactttttatgatcaataagaaacgtggatataaaagtagtagaaaagcaaaaggagatgaagacggtcaactaatcgacggaatggcaatagcaattcaattatacgaacacaaccaaactccaggacaatttgtatacaacctactcaaaaacggcaagaaaaacattccagatttttatcggtccgacctacagaccgaatttgaccgcatatggaattttcaaaaagcattccaccaagaatcattaagcgatggaatctgcgaaaaattggtaggacagaagaaaaatgtaacaagtgcgatactattcaaagagttcaaaatagaatctcttgaaatcaaaggaaaatgggacgagaaaagattcttcagatacgaactaagaaacaaagctgtgcaacaagaacttaaactaaacgaaatagcagaatgtttagtagaaataaacggcgaaatatccaacagcagtggatatcttggcgcaatcagtgatagatctaaagagctagtctttcagaaaataaccgtaggacaatatttatacaaacaaatagccgcaaacccgaatacaagcctcaagaaacaaatattctaccgccaagattaccttgatgagttcaatacactatgggaaacccaagccaaatatcataaagaacttaccgatgaattaaaaactcagatacgagatgtaataattttctatcaacgaagactaaaatcccaaaaaggcctaatatcattttgcgaatttgaatcaaaacaaattgaagtattcgttgacggcaagaaaagtatcaaaacgcgaggcatgagagtaattccaaaatcaagccctttatttcaagagttcaaaatatggcagattctaaataacatagaaatcacagatctcaaaacaaaagagtcccgcgaattaacagacgacgaaagacagctactatttgaagaattaaacataagaccaaaaataagcaagaaagaagccttaaaaatattaacagaaaaaccagcacaatacgatttaaactacaaagatatcgaaggcaataaaactaacgcaaaattttatgaagcatacaataaaattatacacctttcaggacacgacgagatcgactttacagataaaacgtcagatataaatgaatacctaaaacaaatattttccttattaggaataaaaccagagatcctagattttgacagttcattaaaagatgaggactttgaaaaacaactacattttcaactttggcacttgctttactcgtttgaaggtgacaataccaaaaccggcgacgaaaaactactgcaaaaactcaacactaaattcggcttcccagtcgagtatgccaaagtaatttcaaatatcgctctcccagatgactacggttcattaagtgcaaaagctattagaaaaatcctaccacacttaaaagatgggttttcatacggcggaaggaaatcgagacccgacgaaccctcagcatgtgagtacgcgggttatagacattctaaagcatcattaacgaaagacgaaaaagaaaacaaaacatacaaagacaaattagaaatcctacccaaaaatagcctaagaaacccaattgtagagaaaatactaaaccaaacaattaatgtagttaacgctgttatcggagattatggtaaacctgatgaaatacgactagaactagcaagagaactcaagaaatcagcagaagaaagacaagacgccaccgatagtatctctaaagcgacagcaaaacatgaaaaataccgaaaagtcctccaaactgaatttggattaaaacacataagtagaaatgacttaatacgatataaactatatctcgaactcaaaaacaacgggtttaaaactctatacagcgacacttacatagcaccctacgaaatattcagcaagaaattcgatatagaacacatacttccgaaagcaaaactctttgacgacagcttttccaataaaacactcgaactcaaatctgttaacttgaagaaaggtgatatgacagcatatgactttgtaaaagaagaatacggtactgaaggtctagctaagtacgaacagagagtccaagacttatttctaaacaagaaacgaaatgaggacctagatcaagaaaacgaaagtcgcattaccgacgagaaaatatcgaaaactaaaagagacaaattacttatgccagaaaataaaatacccaccggctttatagatcgagaattaagggactcgcaatacattgcgaagaaagcaaaaaccatgatggaagacatatgcaaagatgtagtaacaactactggaagtgtaaccgacaggctcagggaggactggcaactaatcgacataatgcaggaactaaattggccaaaatacgccgcactcggcttaacagaagagttcacaaatgaagaaggcaacgtaataagaaaaataaaagactggacgaaaaggaacgaccaccgacaccacgccatggatgcaataactatagcattcactaaacgatctcacatacaatatttaaataacctgtctgcaagatcagataaaagttcgtcaatttatggcatagaacaaaaagaactatatagagacaaaaacaacaaactaagattcgcaccacccataccaataaacgaatttcgagcagaagcaaaaatgcaactcgaaaatacactcatcagtatcaaagcccaaaacaaagtagtaaccaaaaataaaaacaagatatccggtcagaagaaactacaagaaactctcaccccacgaggacaattacatctcgaaacaatttatggtaaaataaaccaataccagacagcagaaatcaaagtgggagggaccctagatagcgaactaataaacaaagtagccaacaaaaagacacgagaagccctactaaataggttagccgagttcggaaacgaccctaaaaaggcattcacagtcaaaaacactatcgacaaaaaccctatatacttagataaacatcaaagttacaaaatacctgaaaaagttaaaatcgtgtggcaagaacctgtttacactatcagaaaatcaataacaccagacctcaaacttgataaaatcatcgacccaaaaataaaggctttactagaatctagattaaaggaatgcaatggcgatgcaaagctagctttcagtaacttagccgagaacccaatatggctgaacaaagaaaaagggattcaaataaaaagagtaacaataacaggcattagtaacgctgcatctttacatgacaagaaagatctcaacggtaaaccaatattagacgaaaaaggcaataaaatttctgtcgattttgtaaataccggcaataatcatcacgtagccatatacaaagacgaaaacgggaacttacacgataatgtagttacattcttcgaagccgttgaacgcgtcaatcaaaacctaccagtagtagataaattatttaagcaaaaagaaggatggcagttcctgttcactatgaaacaaaacgaatatttcgtattcccaaatgaaatcaccgccttcaaccccaatgagttcgatctactcaacccagacaattattacttaatatcaccaaacttattcagagtacaaacaatgagtaaagtcatgtacggaaataacacacttagagactacaaattcagacaccatttagaaacaaccttacaagatataaaagaattaagggatatagtttttaaacagttcaagagcttatctatctttgacaagatagtcaaagtacgaatcaatcacctagggaaaatagtaaaaactggggaatattga

SEQ ID NO: 5649 - RNA, 4266 nt, synthetic construct
  misc_feature 1..4266: note = Cas9 variant
  source 1..4266: mol_type = other RNA
atgaaggacatcttaggattggacttaggaactaatagcatcggttgggcagtagtaaaagaagctcaaaacgacaacgaacagagtgaaatcgttgacgtcggagttcgagtaaatccacttacaacagatgaaaaaaccaatttcgaaaaaggaaaaccaatatcgacaaacgccgacaggacactaaaaagatccgctagacgaaatctacaaagatataaactccgtcgtaaagaattaatagaactactaaaagaacatcaattgatttccacagacactatactaacagaaaacggtaaagggactactttccaaacattagaattaagagcaaaatcagcaaaagaaaaaatctcactagaagaattagcacgagtttttttgacaatcaacaaaaaaagagggtataaatcatcacgaaaagctaaaaacgaagatgaaggacaactaattgacggcatggaaattgcaaagaggctatacgaagaaaacctaacaaccggacagctatccctccaattattaaaagaaggcaaaaaaagcctaccagactactacagatcagatcttcagtttgaactagataaagtatggaacttccaaaaacagtttcactcacacattttaactgacgagttctatgctcaactaaaaggtaaaggtcaaagagcaacaagtgctctttttctcgcaaaataccaaatatatacagcagaaaacaaaggatcaagagaagacaaaaaattacaagcttaccaatggagagtagatgcactttcaaaagaactaacaagagaacaactggcatttgtcataactgaaataaacaataacttgaataattcatcaggttacttaggagcaatatccgatcgtagcaaagaactatattttaacaatgaaaccgtaggagagtacctatggaaacaaattgcagctaatccccacacgtcgctgaaaaatcaagtattttatagacaggattatttagatgaattcgaacagatatggaagacccaatccgccttctatccagaaatactaaccgaaagcttaaaaaaagaattaagagatgtagtcatcttttatcaaagaaaattaaaaagtcaaaaatccctcgtctccttctgcgaattcgaaaacaaagaaatagaaataaaaaaagaagatggaaccagtacaaaaaaagttattggcctaaaagtagctcctaagtccagtcccttattccaagaatttaaaatttggcaaaatttaaataatgtgctgattagaaaaaaaggatctaaaaccaaaaaagcagcaaaaaaccagcaagcggtactattcgaggaagaaaaaaccataagcgaactcgacctggaagcaaaacaagctttattcaatgaactaaatctaaaaggaaatcttaaagccgactattgtttagaaatattaggatactcaccgaaagaatgggaaatgaactactcagtactcgaaggtaacagaaccaataaggcactatacgaagcatacttaaaaattacagacttagaaggctacgacgctaagaatcacctcaaagtgaaactaaataaagatgaagtagaattagatgatttgaaagtaccagcaagtgaaattaaagacatggtccaagcaatattcaaagaagctggtataaacacagatattctacactttaatgcagaacttgacgggaaagacttcgaaaatcaagcgagttatcaattatggcatttactgtattcttacgaaggcgacgatagtaaatctggtaatgaacttctatacaaacttctagaaacgaaattcggattcaaaaaagaatatgcccagatattagcgaacgtttcgctaagcgacgactatggaagcctttcaacgaaggcgatgaggaaaatccacccctacataaaagaaaacaaattttccacagcatgtgagctagctggatatagacattcgaaacactccctgacaaaagaagagaacgataatcgagttttaagagacagcctagaagttctaaaaaaaaattccttacgacaacccgtggtagagaaaatactcaaccaaatgataaacctagtaaacgcactattaaaaaagtacagaacagaaaacccgaattttaaattcgacgaaattagaatagaactagctagggaactaaaaaaaaacgctgaagaaagagcgaacatgacggctaatatcaacaaagcaaaaacggaacatgaaaaaatcattaaaatattaaaaaatgaatttggcctacctaatccaacacgcaacgacataatacgatacagattgtacgaagaacttaaagcaaacggatacaaagatttatacaccaacatcaaaattccacaggaaaaactctttaccaaagaaatagatatagaacacatcataccaaaaagccgcgtatttgacgacagtttttccaacaaaacattatccttccgcaagacaaacctcgataagggagaaagaaccgctttcgattacatggaatccaagttcggtgctgacaagttagaagagtatgtagcacgagtcgaagatctatataaaaacaacataatctcaaaagccaagtaccaaaaattactaaaaaaagaatccgaaattggagatggattcgtcgaaagggacctaagagagacacaatacatcgccaagaaggctaaagagatactcttgcaaataacaccaaatgtactaagtaccagcggcggtataacagacagactaagggaagattgggacctcataaatgttatgaaagagttgaatctgcccaaataccgagcgttagggttaacagaaatggaagacagaaaatatggacaacaagtcgaagtaataattgattggactaagcgcaatgatcacagacaccatgcaatggacgctttaaccgtcgcattcacaaaacataatcatatacaatatctcaactacttgaacgcaagaaaaaacgagaaacataaggaacatagcaatataatgggaatacaacaactagaaacaataaaagtaacggataaaaacggaaatgaaaaaagagtgttcaaagctccaatgcctaacttcagacaagtaacgaaagcatttctcgaaaacatcctaattagccataaagcaaaaaacaaagtcgtaacgaaaaacaaaaataaggtggcgggctcaaacaaagtccaagaggtactaacaccaagaggacaactgcacaaagagacagtttatggtaaataccaatactatgtacaaaaggaggaaaaaataggaggcaagttcgacctagaaactataaaaaaagtcgcaaacccattgtatcaatcattattaaagaaacgactcgaggaaaatggtggagatcccaaaaaagctttcactggaaaaaattcactagcaaaaaatccaatttacctagatgatgcccaaacggaacaactaccggaaaaagttaaattagtctggctagaaaattcatttagcataagaaaagatataacaccagaaaactttaaagacgaaaaactaatagataaaatattagatgaaggtgtcaagagaatactaaaagagagattacaatcctttggaaatgatgctaaaaaagcattctctgatttagaaaaaaatccaatctggctaaataaagaaaaaggcataacaataaaaagagtaaccatatcaggagtcgccaacgcagaacctttacacacaaaaaaagatcacctgggaaaagagatcctagacaaagaaggaaaaccaattcccgtcgatttcatatcaacaggtagcaatcaccatgttgccgtatatagagacgagaagggaaacttgcaagaaaaggtcgtttcagtatttgaagcagtggtccgcgccaaccaaggcctcccaataatagataagacatataaccagcatttaggctgggaatttctattcaccatgaaacagaatgaaatgttcgtattccctaatgagagcacaggattcaatccaaatgacatagatctcttagaccccaaaaataaacgtatcatttcacctaacctgtttagggtccaaaaattagcgacgggcgactactggtttagacaccatctagaaacaacagtagaaacaaagagcgcgacaaaagatatgacttacaaaagactaagcctcaaccatatcaaaaacattatcaaagtaaggataagccacctaggagacatagtatcagtaggtgagtattga

SEQ ID NO: 5650 - RNA, 4275 nt, synthetic construct
  misc_feature 1..4275: note = Cas9 variant
  source 1..4275: mol_type = other RNA
atgaaacggatattaggtttagatttaggaactaactcgattggatgggcgctagtaaacgaagctgagacagatgaagaagtcagttcaataatacgacttggtgttagagtgaaccccttgacagtagacgaaactcaaaatttcgaaaaaggtaaatcaataactacgaacgcagaaagaaccctgaaaaggtcaatgagacggaatctccaaagatataagttacgacgagatgcgctagtagagttcctaaaagaacttggattcattactgacgaaacaatattatcagaacaagggaacaggaccacatttgaaacatgtaggttgcgggcgaaagctgccgaagaagaaattagtctagaagaattaagcagagtattactaatgataaacaaaaagcgaggctataaaagctcaagaaaagttaagaaagaagaagatggcgtcttaatagatgggatggaaatagcaaagaaattatacgaggaggacctaaccccaggacagttgtgcagccagctattagaatcaggaaagaaagtacttccagacttttatcgctcagatctacaagaagaactagaccgaatttggtccgtgcagaaacaattccatccagatgtattttgcgatgcagcaaaagaagaaataaaaggcaaaaatagatcacaaacatgggcaatattagcaaactattttgtgtggaaagaggaagtagtaggatggaatgatcgcgaggctaaaaatgaaaccatcgaaaaagaatgcaaattagtaggactaaaaagaaccacaaaaggctacgagttgaagaaagaaaactacagatggagggcacaggccttgacagagcaactaggactagaagaaatagctgtcgtattacaagaaattaatggtcaaatcaacgctagttcgggatacttaggagccatatcagatagaagtaaagtactctacttcaatcatcaaaccgtaggccaatatcaaatggctgaactcgataaaaatccacatgctagtttaagaaacatggtcttttatagacaagactatttagacgagttcgacagaatttgggaaaaacaagcagaatttcacaaagaactaactgccgaattaaagaaagaaatacgagacatgataatattctatcaacgaagactaaaaagccaaaaaggattaatatctttctgcgaatttgaacgcttagaaatcgttgtagaaaaagacggcaagaaacagacaaaagtcataggatgcaaagtaatcccaagatcacaccccctatttcaagaatttaaagtatggcaaactctaaatgatattaaagtattaggacgagaaaagaaaagaaatgcattatcggcgtcggaatcacgtgcattatatccagaagaaaaagaaattcttgcaagagaactagccataaaagaaaatatgaagaaagcggacgtcttaaaactactattcgaaaatccgcaagaactagacctaaattttaaacaaatcgatggtaaccgaacaggatttagcttattctcagcatactcaaaaatgatagaaaaatatggatatgagcctctcgactttaagaaaccagctgatgaaatcataggccaacttagaaccattttcacagacctaggttggaatactaatctattcaccatagatcttacaaaagaaggaaaagaactagagatgcaaccatacttcaggctatggcacttattatacagctttgagggtgacaacacaagtacaggaaatggaaaactcatagagaaaataatgcaactatgtggagtggaaaaagaatatgccgtcgagttagcttctctttcattccaagacgattacggatccctatctgctaaagcaataaaaaggattctaccgtatttaaaagaaggtaatttatacgatgtagcctgtgaatacgcaggatacagacatagcaaatcttctctaacaaaagaagaaatagaaaataaagtactcaaaggaaaacttgaagtgttacctaaaaatagcttaagaaatccagtggtagagaaaatcctaagtcaaatggtaaatgtaatcaacacaataatagacacttacgggaaaccagatgaaataagagtagagctagctcgcgaactaaagaaatcagcaaaagaacgtgaagaactgacaaaagcaattgcaaaaagcaccagagaacacgaagaaatacgaaagctcctccaagacgaatttggtatgatgaacgtcagcaggaacgatataatcaggtataaactttatgaagaactaaaagacaatggctataagaccctatacagcaatcaatacatacctaaagagaaaatcttctctaaagaaatagatattgaacatataatcccacaaagccgattatttgacgattcccttagcaacaaaacattagaatataaggcaataaacatagaaaaaggaaacaaaacagcatatgattttgtaaaggaaaaatatggtgaagaaggtctacagcaatacataaatagatgcgaaagtctatttaacgataagaaagccaagttaagaaagctaaaaatggaacaaaaagacataccagatggtttcatagatagagaccttaggaacacccaatacatagccaagaaagcactagcaatgcttaacgagatttgtaggagagtggtggccacgacaggaagcataacagaccaattaagagaagactggcaattagtagatgtaatgaaagagctcaacttaccaaaatatgaagcattaggatttgtagaaacctatgaagacaaggatggccgaaaaattaaacgaataaaagactggacgaaacgaaatgaccacagacatcacgcaatggacgcactcaccgtagcgtttacaaaagatgcattcattcagtatttcaataataaaaacgcggcccaagacagtggtaacagaaaccatacaaacataatcggtatcaagacacgatatttcgacaaaggtagggccttaccaccaatacctctggagcaatttagaatagaagctaaacaacatttagaaaagctcctagtttccataaaagccaaaaataaagtagtgactgtaaatgtaaaccgcacaaagaaaagaaaaggcgaaaatactaaaatacaacaaaccccgagaggacaattgcacctagaaacagtatatggtagtcataaacagtacgtaacaaaaatagaaaaagtaaacgcaagtttcgatgcagctaaaatagcaacggtatcaaaacgagcatacagaaatgcgctactcaaaagactagagacattcggaaatgacccaaagaaagcgttcacagggaaaaacgcactcgagaaaaacccattatatgccgataaataccagacaatacgcgtgccagaaaaagtacaaacagtcgaatttgaaactatatatacaattagaaaacccgtcgaccccgcattaaatgtagacaaagtagtagatgtaaaagtaagagcaatattagaacgaagactaaaagaatacggaggagatcccaaaaaggctttcgtaaacttctgggaaaatcccatatggttgaataaagaaaaaggaatatcaataaaaagagtgtcaatcagaggaataaacaatgctcaaagtatacacgttaagaaagataaaaatggaaacccgatttgggatgaaaatggtaaacaaataccagttgactttgtcaacacaggaaacaaccatcacgtagcaatttatagaaaacccgttctagacaagaaaggtcaggtaacattcgatgaggatggcaacctaatgtacgaactggatgaagtcgtcgtaccattcttcgaagcagtaactcgagcgaacctaggactaccaatcatagacaaagattatagaaaatcagaagggtggcagttcttgttctccatgaaacaaaatgaatatttcgtcttcccaaatgagaaaaccggctttaatcctaaagaagtagatcttctcaatcctgataactacgcgatgatatcaccaaacctgttccgagtgcaaacaatgagcaaagtaatgtatggaaacaatgtggtaagagattataaattccgtcaccacttagaaacaacagtgaaagatatgaaagaattaaaagatatcgcttataaacaatacaaaactttgagctttggcaattctgtcgttaaaataagaatcaaccatataggtcaaatagtaagtgtaggagagtattga

SEQ ID NO: 5651 - RNA, 4275 nt, synthetic construct
  misc_feature 1..4275: note = Cas9 variant
  source 1..4275: mol_type = other RNA
atgaaacgaattttaggattagacttaggaacaaatagtataggatgggcactcgtaaacgaagcagagaccgacgaagaggtttccagtatcatacgtctaggcgtgcgagtcaaccccctcacggtggacgaaacccaaaatttcgaaaaaggaaaatcaattacaaccaatgcagaaaggacactaaaaagaagcatgagaagaaacttacaaagatataaattacgaagagacgctttagttgaatttctcaaagagcttggatttataacagacgagaccatcctctccgaacaaggtaaccgtacaactttcgaaacttgtagactgcgagcaaaagccgcagaagaagagatctcattggaggaactatccagagtccttctaatgattaataaaaagagaggctataaatctagtcgcaaggttaagaaagaagaagatggtgtgctaatcgacggaatggaaatagctaagaaattatacgaagaagatctgacgccaggacaactatgcagtcaactcctggaatctggaaagaaagttttaccagatttctatcatagtgacctccaagaagagttagatagaatatggtctgtacaaaaacaatttcacccagatgttttctgcgatgcagcaaaagaagaaattaaaggcaaaaacagaagtcaaacctgggcaatattagccaattactttgtatggaaagaagaagtcgtaggatggaacgatagagaagctaaaaatgaaacaattgaaaaagaatgcaaacttgttggacttaaaagaacaacaaaaggatatgagttgaagaaagaaaattacaggtggcgagcacaagcattaacagaacagcttggtttagaagaaatagccgttgtattacaagaaatcaatggccagattaacgcctcaagtgggtacctaggagcgatttcggaccgatccaaagtcttatactttaaccaccaaaccgtcggacaatatcaaatggcagaattagataaaaatccacatgcatcacttagaaatatggttttctatcgacaggattacttagatgagttcgacaggatctgggaaaaacaagcagaatttcacaaagaattaaccgcagaactaaagaaagaaataagagatatgataatattttatcaacgtcgtcttaaatcccaaaaaggattgatttcgttctgtgaatttgagagattggaaatcgtcgtagagaaagatgggaagaaacaaaccaaagtgataggttgcaaagtaatcccacgtagccaccccttatttcaagagttcaaagtatggcaaacacttaatgacatcaaagtactcggaagagaaaagaaaagaaacgcattatcagccagcgaaagccgagcgctttacccagaagaaaaagaaatacttgcacgagaattagctataaaagaaaatatgaagaaagcagacgtgttaaaactactttttgaaaatccacaggaactggacttaaactttaaacaaatagatggaaacagaaccggattcagccttttctcagcctatagcaaaatgatagaaaaatatggctatgaaccattagattttaagaaacctgctgatgaaataattggacaattaagaaccatcttcacagacttaggctggaatacgaacttattcacaatagacctaacaaaagaaggaaaagaacttgaaatgcaaccctattttcggttatggcacctattatacagcttcgaaggagacaatacctcaacgggtaacgggaaattaatagaaaagataatgcaactttgcggagtcgaaaaagaatacgcggtagaactcgcatcactttcatttcaagacgactatggtagcttaagtgccaaagcaataaaaagaatattaccgtacctcaaagaaggaaacctatatgatgtagcctgtgaatacgcaggctacagacactctaaaagctcactaacaaaagaagaaatcgaaaataaagttttaaaaggaaaactagaagtattgccgaaaaacagcctaagaaatcccgtagtcgagaaaatattatcacaaatggtgaatgtgattaatactataatagacacatatggtaaacctgatgaaataagggtagagttagctcgagaattaaagaaatcagcaaaagaaagagaagaactaacaaaagccatagctaaatcaacaagggagcatgaagaaataagaaagctcttacaagacgagttcggaatgatgaacgtcagtagaaacgacatcataagatacaagttatatgaagaattgaaagataatggatataaaacactgtattcaaatcaatacatacctaaagagaaaatcttctcgaaggaaatagacatagaacacatcataccacaatccagactattcgatgattccttatcaaacaaaacattagaatataaggctataaatatagagaaaggtaacaaaactgcctacgattttgtaaaggaaaaatatggcgaagagggtctacaacagtacataaatagatgtgaaagcctatttaacgacaagaaagccaagctgaggaaattgaaaatggaacaaaaagacatacctgatgggtttatcgacagagatctaagaaatacacaatatatagcaaagaaggcactagcgatgctaaacgaaatctgtcgaagggtagtggcaactacaggttcaataacagatcaactgagggaagactggcaattagtggatgtaatgaaagaattaaacctaccaaaatacgaagccctgggattcgtagaaacatacgaggacaaagacggaagaaaaatcaaaagaattaaagattggacaaaaagaaatgatcatagacaccatgcaatggacgctttaacagtagcatttactaaagacgcatttattcagtactttaacaataaaaacgctgcacaagacagtggtaatagaaaccacaccaacataataggcataaaaacaagatattttgacaaaggtcgagcattacctcctatcccactagaacagttcagaatagaagctaaacaacacttagaaaaactgttagtaagtataaaagctaaaaataaagtagtaacagtaaatgtaaatagaaccaagaaacggaaaggagaaaacactaaaatacaacaaacacccagagggcaactacatctcgagacagtatacggatcgcataaacaatatgtaactaaaatagaaaaagtaaatgcatcatttgacgccgcaaaaatagccaccgtaagtaaaagggcttacagaaacgcgttacttaaaagattagaaacctttggaaacgatccaaagaaagcgtttactgggaaaaacgcattagagaaaaatcctttatacgccgacaaatatcaaacaatacgcgtaccagagaaagtacaaactgtagaatttgaaacaatttatactataagaaaaccagttgatccggcactgaacgtcgacaaagtagtagacgtgaaagtcagagccattttagaacgcaggttaaaagaatatggaggagaccctaagaaagcattcgtaaatttttgggaaaacccaatatggctaaataaagaaaaaggaatatcaataaaaagagtaagcatacggggaatcaacaacgcacagtcaatacacgttaagaaagacaaaaacggaaatccaatatgggatgaaaatggaaaacagatcccagttgacttcgtcaacaccggtaataaccatcacgtcgctatttatagaaaaccagtactagataagaaaggacaagtcacctttgacgaagacggaaacttaatgtatgaactagacgaagttgttgtaccattctttgaagccgtaacaagagccaatttaggtctaccaataatagacaaagattatagaaaaagtgagggttggcagttcttattcagtatgaaacaaaacgaatattttgtattcccaaacgagaaaacaggcttcaaccccaaagaagtcgatctattaaatccagataactacgcaatgatctcgccgaatctttttagagtacaaaccatgtcaaaagtaatgtatgggaataatgttgtaagagactataaattccgtcatcatcttgaaactacagtcaaagatatgaaggagctcaaagacatagcctataaacaatataaaactctatcttttggaaacagcgtcgtaaaaataagaatcaatcatattgggcagatagttagcgtaggcgaatactga

SEQ ID NO: 5652 - RNA, 4278 nt, synthetic construct
  misc_feature 1..4278: note = Cas9 variant
  source 1..4278: mol_type = other RNA
atgagaagaaacatattaggcctagacctaggaactacaagtataggatttgccaaagtgatagaagatgaagattaccaaaactccgcagtagaactaataggtgtgcgcgttaacccattgactactgacgaacaaaccaatttcgagaagggaaggcccgtaagcgtcaatgcagacagaactttgaaacgaggcatgcgaagaaatctggacaggtaccaattacgacgccaccatcttatcgaggtattaaaagccaaccatataatcacagtagacactaaattagctgaagacggaaaaaatactacacatgcaacatacgcagtaagagcattagcagcaaccgccgaaatcccactagaggcatttgcaagagtacttttagccattaacaaaaaaagaggctataaaagctctagaaaagcaaaaaatgaagatgaaggacaactcatagatggtatggccgtagctaaacggttatatgaggagaatctaacaccagggcaattatcctacttgctactaaaagaaggaaaaaaatacttacctgacttttatagatcagacctaaacgctgaactagacaaagtttggagttttcaaaaacaattttatcctgaaatcttaaccgaggaattcaaaaaacaccttgaaggaaaaggccaaagggcaacatctgcagcattttggggacaatatggctttaatactgcagaaaacaaaggcagtagagaagaaaaaaaactcaaggcataccaatggcgtagtgaagcagttgaccaacaactaaccaaagaagaggtcgcctacgtgatcacagagataaataacgacttaaacaaaagtagcggatatttaggagcaatatcggacagaagtaaagaattgttttttaacaaacagacagtggggcaatacctgtatcaacaattaaaacaaaacccccatactaggttaaaaggacaagtcttctataggcaagactacttagatgaattcgaaacaatatgggaaacgcaagctaaatttcatcctgaactcaccgcagccctaaaagaagaaataagagatgtaattatcttttaccaacggaaattaaagagtcaaaaaggattaataagtttctgtgaatttgagtcgaaagaaattgaagtagaaaaaaatggtctaaaaataaaaaaacgcataggactaagagttgctccaaaatctagcccactgttccaagaattcaaaatatggcaagtactcaataacctagaatttcgaaacaaatcgtcaaaagaagtattcgtcccagatatgactgctaaacagcaactattcgacgagttaaatatcaaaggtaacttattagcatcagaagcaatcaaaatcttagggtacaaaacgaaagactgggaggcaaattatcacacactagaaggaaatagaactaataaatcattgtacgacgcgtatcttaaaattctggaattagaaggctacgacgaagatctattaaaactaagtggttcggatgatatagatgtaagtaaaatagaaaaatcagccagtgagatcaaacaaatggtacatgctgtctttgaagtactgggaataaatagtacaatcctagactttgacgcagaagcagatggaaaagctttcgaacaacaaacagcatacagattgtggcatttattatatagcgcagaagatgacaacaagaaatacttacaagaggatatttttatatatggtcacgacaacatagggttaaaaaaaaagttatgtgaaagattcggatttagaccggaacatacgaagatcttagtcaatgttgctttttctggcgattacggttcattatccagtaaagccatgcgaaaaatataccctttcataaaagaattaacatacgataaggcatgtcgagaagctgggtacagacacagcgcatcctctctatccaaagaagaaatcgccactaggccactacaaaaacgactaggcttattaaaaaagaatgaattaagatcacctgttgtcgaaaaaatacttaaccaaatggtaaacgtcgtgaacgcactcatagatgatgaaaataaacgaagaaaagcaagaggtctaagcgacgacttccacttcgacgagattcgtatagaactagctcgagaattaaaaaaaaacgccaaagaacgcgccgagatgactacaaatataaacgcagcaaaacaactccacgaaaaaataattaaaatactccaaacccagtttggtgtcagtaatccaagtagaaatgacataattcgatacaaactatacgaagaattaaaaaacaatggatataaggacctatacacaaacacatacatctctccagatattcttttttcaaaacaaatagatatagaccacataataccgcaaatgagcctatttgacgatagcttcagtaataagacagttgtgttccgcaaagataaccaagataaaggaaacaaaaccgcatacgattatatacttggaaaatatggagaacttgctctcgaagaatatatatcgagaatcactagccttttcgaattgggcaaaaaaaataaagaagaaggtattaacaaagccaaattccaaaaattacagaaacgactaatagacataggtgatggttttatcgaaaaagacctaagagagtctcaatatatagcaaagaaagcaaaaaacatgctatatgcaatatgccgatcggtagttgccacatcaggcgaaataacagcgagattaagggaagattgggacctagtaaacgtaatgcaagaaatcaatttaccaaaattccgagcattaggcctaactgagatggtcgagaaaaaagacggaggtcaaaaagaacgaataatagattggacgaaacgaaatgatcatcgacatcatgcgatggacgcattaactatagccttcactagacactcacacatacagtatctaaaccacttaaacgctcgaaaagacgaagccagcaagtggcatccagtagtttctaaaatagaagaaaaagaaaccgacctggtctatgacgatttaggaaatcgtaaaagacgctttaaggctccaatgccaaacttccgagaagttgtaaaagaacatctagaaaatgtactaataagtcacaaagcaaaaaacaaagttgtaacgaaaaataaaaataaaataaaaactgccaaaggcgaaaagataaaaaccgaactcactccgagagggcagctccacaaagaaacaatatatggccgctatagatattacgaaagcaaggaagaaaaagttggtccaaaattcgacgcagaaaccatcggtatggtagtaaacccacaatatcgaaaattactcttagagagactaacaacaaatggaaatgatcctaaaaaagcatttggcggcaaaaatactttaagcaaaaacccattatacatagacgaagctaaacaggaattattaccagaaaaaattttattaagatggttaaacgatgattactcaattcgtaaagacgtaaccccagaaaatctaaaagacgtcaaaacgatagaaaaagtacttgatgaagggattaaaaagatactgctaaaaagattagtcgactttggaaatgatccgaaaaaagcattttcagatttagataaaaaccctatctggttaaacgaagccaagggtataacaataaaaagagtaaccatctcaggagtcaaaaacgccgaagccctacattataagaaagatcatttcggcaatgctatcttaaatgaaaatggaaaattgataccatcctcctttgtctctactggaaataatcaccacgttgccatataccgggacgcagaaggaaatctacaagaacgagtcgttagtttgttcgatgcagtgcaactggtaaacgcgggagaagctgtaatagatagggaatataataaaggtataggttggcaatttttatttacaatgaaacaaaatgaaatgtttgttttcccaaatgaaaagaccggtttcgatcccaaggaaatagatctactaaatacagataatcgaaaactaattagtcctaatttattccgcgttcaaaaaattgctagcaaaaactacttcttcagacaccacttagaaacaaacgtagaagaaagaaaagaactaaaagatatagtatataaaccacaactaggtctgaatgcaatcaaagacgtagtgaaagtcagaataaatcacttaggcaagataatatccgtgggagaatattga

SEQ ID NO: 5653 - RNA, 4281 nt, synthetic construct
  misc_feature 1..4281: note = Cas9 variant
  source 1..4281: mol_type = other RNA
atgcctcgaaagaatatactcggtttagatctcggtacaaccagtataggatttgctaaaataatagaagacgacgactatcaatgctccagcgttgaactaataggagtcagagtcaatcctctaactacagatgagcaaacaaatttcgaaaaaggaaaaccagtatcagtaaatgccgaccggactttaaagaggggaatgagacgtaacttagatcggtatcaattaaggagagactatttaattgagatactacgaacacatcacataataactgcagataccaaattagccgaagatggaaagaacaccacacacaccacttatgcattacgagcactagctgcaacagctgaaataccactggaagcatttgtacgagttttgctagccataaataaaaaaaggggatataaatcgagtcgaaaagctaaaaatgaagatgaaggacagctcatcgacggaatggctatagcaagacgtctttacgaagagagcctaacaccaggacaattttcatatcaactactaaaagaaggcaaaaaatacctaccagatttttatagatcagatctaaataccgaactaaataaagtttggaatttccaaaaacaattttatccagagatactgacggatgaattcaaaaggcatctagaaggaaagggacaaagagcaactgcagtggctttttggggtcaacacggcttcagcatggcggaaaataaaggatctagggaggaaaagaaacttcacgcatataaatggagaagtgaagctgctcacaaacaactaaccaaagaagaagtagcattcgtcataacagaaataaacaatgatcttaataaatctagtgggtatctcggtgccatttcagatcgtagcaaagaattattttttaacaagcaaactgtaggacaatacctccaccaacagctaaaagaaaacccacacacacgattaaagggccaagttttttaccgacaagattatctagatgaatttgaaacaatatgggaaatgcaagcgaaattttattcagcactcacactagaattaaaagaggaagttagggacgtcgttattttctaccaacgaaagttaaaaagtcaaatgggtctaattagcttatgcgaatttgagtcaaaggaaattgaaatcgaaaaaaatggtgaaaaagcaaaaaaaagaattgggctacgagttgcccctaaatcatcgcccttattccaagaattcaaaatatggcaagttctgaacaacctcgaattcagaaataaaaagacaaaagaagtatttgtaccagaaatggcagcaaaacaacaattatttgatgaactaaacataaaaggcaacttattagcaagtgaagccataaaaattttaggatacaaaacaaaagattgggaggcaaactatcacactctagaaggcaacagaacaaacaagagtttatatgatgcttggttaaaaattttagaactcgaaggatatgatgaaaacttattaaaactaagcggatcagacgatatagatgtttcaaaaattgaaaaacctgccctagaaattcggcaaatggttcttgccgttttcgaagtgttggggataagcggagcaatattggacttcgatgcagaagctgatggaaaagcgttcgaacagcaacccgcataccaactctggcatttactctactcagccgaagacgacggaaaaaaatattcacaggaagacatatttacgtacggacacgacaacataggtctaaaaaagaaactatgtgaaaaattcggatttcgaccagaacatacgaaaattctagtaaacgtagtgttttcagacgattacggaaacctaagttcaaaagctatgagaagaatttaccctttcataaaagagctaacatacgacaaagcttgtgctgaagcaggttatcgccatagcgcggcaagcttaaccaaagaagaaatcgctgccagaccactacaaaatagattagacctactaaaaaaaaatgagttacggtctccagttgtagaaaagatactaaatcaaatggtaaatgtggtaaatacattagtcgacgacgaaaaccagaacagaaaagccagaggcctatcggaagatttccattttgacgagataagaattgaattggctagagaactaaaaaaaaacgcaaaggaacgagcagaaatgaccacaaacataaataccgcaaaacaaagtcatgaaaaaatcattagaatactccaaacagaatttggagtgccaaacccaagccgaaatgatattgtaagatacaaactctatgaagaattaaaaaataatggctataaagacctttataccaacacatatatatcgagagacatcttattttccaaacaaatagatgtcgatcacatcattccacaaatgagtttattcgacgacagcttttcaaataagactgttgtctttagaaaggataaccaagataaaggaaataaaacagcttacgactatatcctaggcaaatatggcgaacaagcgctagaagagtatatatcacgtataacctcgctctttgaattaggaaaaaaaaataaagaggaagggattggaaaagcaaagttccagaaattgcagaaaagacttgtagacataggagacggcttcattgaacgagatctaagggaatcacaatacatagctaaaaaagcaaataacatgttatacgccatctgtagaagtgtagtctcgacatccggcgagataaccgctagactacgagaagactgggatctggtaaacgtaatgcaagaaataaacttaccaaagtttagagcgctaggattaacagaaatggtagaaaagaaagatggcgcacaaaaagagagaattacagattggaccaaacgaaatgatcaccgacaccatgccatggacgcattagcaatagcattcacgagacactctcacattcaatacttgaaccacctaaacgcacgaaaagatgaagcaaataaatggcacccagtcgtatcaaaaatagaagaaaaggaaacagttttgatctacgatgacttaggaaatagaaagagaaaattcaaagcacctatgccgaatttccgagaagtagtaaaggaacacctagaaaacgtactcatcagccataaagcaaaaaataaagtcgtgacgaaaaataaaaacaaaataaaaacggtccgaggcgaaaaagtaaaaacagagctaactcctcgtggacaattacacaaagaaacaatctacggacgatacagatactacgaatcaaaggaagaaaaaattggaccaaaatttgacgcagaaatgatcggtatggttactaatccacaatataaaaaactactattagaacgcctagccgcaaacggaaacgatccaaaaaaagcattttggggcaagaatgcgctgaacaagaatcccctttacgttgacgaagcaagacaagaactcctgcccgaaaaaatactattgcggtggttaaatgacgactactcaatacgcaaggacgtaacaccagaaaacttgaaagatataaaaacaatagaaaaaatactagataaaggcgtaaagaaaatattactaaagcgtctcgccgacttcggaaacgatccgaaaaaagccttcagcgatttagataaaaaccctatttggcaaaacgaagcaaaacgcatagccataaaacgagtaaccatatcaggtatcaaaaatgcagcacctcttcatcacaaaaaagatcacctaggcaatgatatattagatgaaaagggtaaacaaataccatcaagttttgtttcaacaggaaataaccaccatgtagcaatttatcgagatgctgaagggaatcttcaggagagggtagtaagcctattcgatgcagtacaactagtaaacggaggagaacctgtaatcgataaggaatacaataaaggaatcggatggcaattcctgtttacaatgaaacaaaacgaaatgttcgtttttccagacgagaaaacaggatttaatcccagagaagttgatctattatcgtcgggcaatagaaagctaatatctccaaatctctttcgagtacaaaaacttgcatcaaagaactacttcttccgccatcacttagaaacgtcagtagaagaaaaaaaagagttaaaaaacatcgcctataaaccccaattaggcctaaacgcactaagcaacatagtaaaagtaaggatcaatcacattggagaaatagttagtgttggagaatattga

SEQ ID NO: 5654 - RNA, 4281 nt, synthetic construct
  misc_feature 1..4281: note = Cas9 variant
  source 1..4281: mol_type = other RNA
atgaaaaatatactcggattagatttgggtatcacatcaattagtttcgcacacatagtagaagatgaaaacaaagaaaaatcagaaataaaagaactaggtgtaaggatcgtttcactaactacggacgaacaaagtgatttcgaaaaaggaaaatcgattaccacaaacgctaatagaacactaaaacacggagccagactcaaccttgatcgataccaacaacgacggaaatatctaatcgatttgttacaaaaagcaaatctaatcacatcatcttcaatactagccgagaatggaaagaatacaacacatagtacctggcaactcagagctaaagcagtaaccgaaagaatagaaaaggaagaatttgccagagttctcttagcaataaacaaaaaaagaggttacaaatcctcaagaaaagcaaaaacagaagatgaaggacaagcaatagacggtatggcaatagctaaaaggttatatgatgaaaacttaacaccaggacaactttcattacaactacttcaacaaaacaaaaaattactacccgatttttacagaagtgatcttcaaagggaatttgatttagtctggaattttcaaaaacaattctacccagacattctaactgactcattctataaagaattacaaggaaaaggaaaagacgcaacatccaaagctttttcaaaaagataccatttcgatacagcagaaaataaaggttcaaaagaatcagtacgattacaagcatatcaatggcgagcagaagcaatatctaaacaactttccaaagaagaggtagcatacgtcttaacagaaatcaacaacaatctcaataacgcgtccggatatctcggagcaatatccgacagatcaaaagaactctactttaaccgccaaacagtgggtcaatatctctacgcacaactacaggaaaacagacataactctctaaaaaataaagttttctatcgacaagattatttagatgaattcgaacgaatatgggaaacgcaggcctcattccataaagagttgacagatgaattaaaaaaacaaatccgagatgttgtaatattctaccagagaaaacttaaaagccaaaaaggactaatatctttttgcgagtttgaatcaaaagaaatagaaattgaaaaagacggcaagaccataaccaaaacaataggagcccgcgtagtaccaaaatcaagcccactgttccaagagtttaaaatttggcaaatactaaataatgtaacttgcaaaagaaagggaatacggaaaaaaaaatcctccgccaaatccacagagctagacctctttaacgagccttcacaaaccatcttttctttagacatggaatgcaaacaattactcttcgacgaattaaatttgaagggcgatctaaaatcagacaaagtactaaagttattgggatactccccacaagaatgggaaataaattacaaccaactagagggaaatcgaacccaaaaagcactctacgaagcctacctaaaaatagtagagatggaggcccatgacgttaaagatatactacaaatcaaatctgcgaaagacgattggtctcttgacgaatcgcccctcagtgctagtgaaataaaagaaaaagttaaagacattttccaagccctcgggatatgtacaaaaattctatactttgacccactgctaccagttaaagaattcgaaaaacaagactcataccaactgtggcatctactatattcttacgaatccgacgattcaacatcaggaaatgaaactctataccgaatcctagaaaagaaatacgctttcaaaagagaacacgcaagaatcctagctaatgtagcactacaagacgactatggttcactatcaactaaagcaatacgaaaaatatacccaaacataaaagaaaaccaatatagcaaagcctgtgaactggcgggatataaacatagcaaattaagcctaaccacagaggaactagaagcaagagagttaaagaacataataccgctcttaaaaaaaaacgcgctaagaaatccggtagtcgaaaaaattcttaaccagatgataaacgtagtaaacgcattaatagaaaaaaatagtgaaagagatgcagaaggaaagatcaccaaatattttcactttgatgaaataagaattgaactagctagagaactcaaaaaaaacgcacagaaaagatacgaaatgacgcaaaacattaacaaagccaaattagagcatcaaaaaatatcagaaatactacaaaagaaattcggaattaagaatcccacaaaaagtgacataattagataccgtttatatcaggaactggaacacaatggctataaagaactttacacaaacgccccaatagcccgtgatatgctgtttagcaagaacatagaaattgaacacatagtaccaaaagcacgggtcttcgacgacagcttctcaaacaaaacactgacctttcacagaattaactctaacaaaggcgagtataccgccttcgactacattacatccctcaattcagaagaggaattaaaccaataccttacaagagtagaaaatgcatataaaaccaaaagtatttcattaacaaaatataaaaatttactgaaaaaggcctccgaaattggagacggattcataaacagagatctacgagacacccaatatatcgctaaaaaagctaaagaaatattatttcaagtaaccaaaaacgttctttcaacctcaggaagtatcacagaccgtctcagagaggactggggattagtcgatgtaatgaaagaactaaacatgccaaaataccagtcactaggtttaactgaagtagaagaacgaaaggaaggtaataaagtaacagttattaagaactggacaaagaggaacgaccaccgacatcatgcaatggacgcactgaccgttgcctttaccaaaccatcctatattcaatatttaaatcacctcaacgcacgaaaagatgaaaacaacaaaaattattcagtcatcctggcaattgaggagaaagaaacaataaaagtaccgaccaacaacggaaaaaacaaacgagtattcattgaaccgattccgaatttcaggcaagtagctaaaaaacacctagaagaaatatttatatcacacaaagcaaaaaacaaagtagtaacaaaaaacgtaaacaaaccagcaggcacggataaacaacagataaccctaaccccaaggggtcaattacataaggaaaccatatacggaaagtaccaatactatgtaaacaaagaagaaaaagtaggagtaaaattcgacgaaagaactataacaaaggtgtcaaacccgctatacagagaagcacttctaaaacgtctgcaagcaaacgataatgacccgaaaaaggcattcacaggaaaaaacgcattatcgaaaaacccaatatacttagatgaaaccaaaacgaaaacattacccgaaaaagtaaaccttacgtatctagaagaggacttctctataagaaaagatatatccccagacaatttcaaggacctaaaatcaatagaaaaagtaatagaccaaggagtaaaaagaatattaatcaaacgattgcaggactacgataatgatccaaaaaaagcattcgtcgatcttgaaaaaaaccccatctggctaaataaagaaaaaggtatagcaattaaacgagttactatcagcggcgtttctaatgcacaaccattacatatcggaaaggaccacctgggtaaaactacattaaacaaggaaggcaacgaaataccagtggactatgtatctaccggaaacaaccatcacgtagctatctaccgagataaagaaggcaacttacaagaacaaatcgtgtctttctttgaagcagtagtacgtacacaacaagggttacctataatagacaagacatataaacaagaagaagggtggcagttcctgttcacgatgaaacaaaacgaaatgtttgtttttccaaatgccacaacagggttcaaccctgcagaaatcgatttactcgatccaaaaaacaaaaaacttatctcccccaacctatttagagtacagaaaatcgcaacaaaagattactttttcagacatcatcttgaaacaaatgtagaaaccgataatgtactcaaaaacaccacatggaaaagagaaggcctaagtggcctaaaagatatagtcaaagttcggataaaccacctaggtgatatagtaagtataggggaatactga

SEQ ID NO: 5655 - RNA, 4281 nt, synthetic construct
  misc_feature 1..4281: note = Cas9 variant
  source 1..4281: mol_type = other RNA
atgaaacacattctgggccttgatttaggaacgaattcaataggatgggcactcattaaacaagatttcgaaaacaagcagggtgaaatcttaggaatgggatctcgaatcataccaatgtcacaagacattctgggcgacttcggtaaaggaaacagtgttagccaaacagcagaaagaaccaaatacagaagcgtacgacgcctaagagaaagatttctgttaagacgcgagcgcttacacagaatattaaacgtcctagggttcctacccgaacactacgcatcacaaattgatttcacaaaaagatttggaaagtttaaggaggaaacagaaccaaaactagtatatagcaacgaaggctttatattcaaaaagtcgtttgaagaaatgttatcagacttcaaaacacatcaaccacaattacttgaggacaacaaaaaaataccatatgattggaccatatactatctccgtaagaaagccttatccagaaaaattgaaaaagaagaactcgcatggatattattaaattttaatcaaaaacgcggctattaccaattacgcggtgaagaagaagaagaaaacccaaataaactaatagaattctattcactaaaaatagtcgacgtattagcagatgaaccgcaaaaaggtaaaagtgacatatggtacagcctgatattagaaaacggatggatatataggagatcttccaaaaccccactgtttgactggaaagagaaaacaagagatttcatcgtaacaatagatctaaatgatgatggctcagtcaaaaccgacaaggagggaaacgagaaaagatcatttagagctcctggagaaaacgattggacattagttaagaaaaaaacggaacaagaaatagactcaagtaggaagactgtaggaacctacatttatgaaacgctacttaaaaaccccaaacagaaaataaaaggaaaattagtacgaacaattgaaagaaaattttacaaaacagagctcaaacaaatccttgagaagcaaaaagaattccaccccgaacttcgacaagacgatctatacagtgattgtgttcgagagctttacaaaaacaacgaagctcaccaactaactttatcaaaaaaagactttgtacacttattcatggaagatatcatcttctaccaaagacctctaggaagtcaaaaatcttcaatctctaactgtaccttagaatttcgaaagtacaaagacgaaaatggcacggaacacacgcaatatctcaaagctatacctaaatcaaatccgtactatcaagaattccgaatatggcaatggatgtataacttaaacatatacaaaaaagaagatgacacgaacgttacaaaagactttttaaacacaaaagcagacttcgagtcactatttgaattccttaataaccgaaaagaagtagatcaaaaggcattgctcaaacattttaaactaaatgacaagacccaccgctggaactatgtagaggataaaaaatatccgtgtaatgaaactaaaaccatgattttatcaagactagataaagtagaaaacataagcgacgactttttaacaagagaaatggaacagaaaatctggcatataatatacagtgtaaacgacaaggtagaatacgaaaaagcattaaaaagttttgcaggcaagaataacttagaagataactccttttttgaagcatttaaaaaattcccaccgtttaagagtgagtatggtgctttctcagaaaaagcgataaaaaaactattaccacttatgaggatgggcaaattttggaattataacaatattagtgaacagagcaaaagcaggattcaaaaaataataacaggagaatacgacgaaaatattaaagacaaggttagagaaaaagccatccatctgacaactgaaacagacttccaaggacttcaactctggctagtccaatatattgtgtatggacgacactctgaagcggcaatgctgggtaaatggaattccgcagacgacttagaagaatttcttaaagaattcaaacaacactcgctaagaaaccccatcgtagaacaagtaataactgaaacgctaagagtagtaaaggacatctggcaaaaatacggaaacggtgccaaagacttcttcagagaaatacacatagaactaggccgggaaatgaaattaccagcagaggaaagagaacgcctaacacgacaaatctcagaaaacgaaaacacaaattttagaatcaaagcgttactagcagaaatgatggatgataatagtgttgagaatgtgagaccattctcgcctatgcaacaagaaatactaaagatatatgaggaaggagtcctaaactcggatatagaaatagaggacgatatactaaagatatcaaaaactgcacaacccagttcgagtgacctcaagagatataaattatggttagaacagaaatacaaatcaccatacacaggtcaaatcataccactaaataaactattcacaccagaatacgaaatagaacacataattccgcagtcgcgttatttcgatgacagcttcacaaacaaaatcatttgtgaaagtgccgtaaacaaactaaaagataattatataggattagaatttattaaaaaattaggtggaagcatagttgaatgcggaaatggaaaatctgtagctatcctaaaacatgacgcatacgaagactttataaagaaacattacgccaacaacagatcaaaaagaaacaaactattacttgaagatatccccgaaaaaatgatagaacgacaaatgaatgacacgcgatatataagcaaatacatctctggagtactatcaaacattgtacgagtcgaagacggcacagacgagggtgttaattccaaaaatatagtcccgggtaatgggaaaataacaacacagcttaaacaagactggggtcttaacgacgtgtggaacgacctaatacttccacggttcgaaagaatgaaccaccttaccaattcaaccgactttacagcatggaatgagaaccaccagaaatttcttcccaccgttcctgtagagttttctaaaggattcagtaaaaaaagaatcgaccatcggcaccatgctttagacgccttggtaatagcatgcgccacaaaagaccacgtcaacttattgaacaaccaatcagctaaatcagacacaaaacggtatgatctaaaaaagaaattaatgaaattcgaaaaagtagcatacaaccacccacaaactggagaaagaattgaaagagaagcaccaaaacaatttctcaaaccatgggaaacgttcactatagatgcaaaaaaccacctcgagacaataatagtatctttcaaacaaaaccttagagtaataaacaaagcaaccaactattatgaaaaatatgtagaaaaagagggaacgaaagttaaagaacgagtagaacaaaaaggaacaaattgggcaataagaaaacctatgcataaagaaactgtatcagggaaaatcgacctaccgagaattaaagtaccaaaagggaaaatattaacagcaacgaggaaatcactagatacaagttttaaccttaaaacgatcggctcaataaccgatacaggcatccaaaaaatactcaaaaactatttacaatataaagataacaacccagaattagcattctcaccagaaggaatagaagacatgaacaaaaatattgaaaaattcaacaacggaaaggcacaccaatctatctcaaaagttagagtatttgaactaggttctaaatttcccctgggccaaagtggtaacaaaaaggaaaaatatgtcgaagccgcaaaaggaaccaacctatttttcgcaatataccaagataagaatggtaaaagatcatatgagacaataccactcaacgaagtcatagaacgacaaaaacaaggcctatcagtagttgacctgaaaggagtagatgatttctacctctcaccaaatgatctagtctacgtgccatccgaagacgagttagaaaatatatccatgattgacttcaataaaatgtcatctgaaaggatatataaagtcgtaagcttcaccggaaaccaaatattcttcgttcgccaagatatagcgacttcagtggtaaacaaagcagaattttctacactaaataaaatggaaagagccatagacgggactatgataaaagaaacatgcgtaaaactccaaatcgatagactaggcaatatttcaaaaatttga

SEQ ID NO: 5656 - RNA, 4281 nt, synthetic construct
  misc_feature 1..4281: note = Cas9 variant
  source 1..4281: mol_type = other RNA
atgtataatataggactagacataggaaccggaagtgtaggctggtgtctaacagacgaaaacggctatctcctcaaagtaaacagaaaaggaaacaatggtaacacctacagaaacagcgcatggggagtacgactcttcgaaagcgctgacacggccgcagattgccgaataaaacgcagcacaagacggcgatacaaaagaaggcgaaccagaatcatagaactcaggaaaataatgagtgacatgataatgccaatagatccaaacttctacgcacgacttgacgaagcttttttatggaatgaggataaaagtgataaggccaaagcaccatttttactatttaacgataacggatatgacgatgtaaaatactacacagactaccctaccatctaccacctaagaaaacatcttttagaaaccaaagagaaggcagatcccaggttcatctatttagcacttcatcatatgatgaaatacagaggacactttttattcgaaggacagtcattcgaagctattgataatatcgaagacacattcatcgaattagagcacctagttaacgtgtatgtaaaagaaaaagaagacacagacaacaacgcagaaaacaacgcactataccaggaaatgaaaaactacctagctgataataaggtaaaaaataaagacaaaaaagaatacataacagacacattcataaaagcagattatgacaacaaatattcaaaagaattagctgcagctgtgttaggatacgagtttaacgtaggtataatagtcaacgacaactcactaactgatgaagacggaaaagcactgaaagccaaatttgcagacgcaaaatatgaagaaaaagaggaaaaattatccgacacattgggagaaagatactacattatagaaacgcttaaaaaaatttatagttggaaagtcttacactcaatactaggcgacaataaatatctaagctatgctatggtcgacaaatacgaaaaacattcagaacaactaaaagccctaaaatacttatttcacaagtatacaagccaggacgaatattcagaatttttccatcaagaaaaaaataaagaagggaaatatattgtaaactatgctaactacattaagggcatcaaaagactcagtaacgaaaccaacaaaaaatataatactaaacaacaattataccagagcataatgaagatcctaggagagagagcggcagacgacgaagtatacaagaaaattttagtagagatggaacaagaaacatttttagaaaaaattaataacgtggacaacagcgccataccctaccaacttaacctaatggaaatggacaaaattttaacacaacaaggtgtctactataaagaacttagagataacaaagaactgttattaaaaatgctaacctccaaaataccttattacgttggaccactaaataacaactcaaacggcaatagaaacttcgcttggatgacaaagaaagacgggaaagagaatgaaaaagtatacccttggaatgttaaagacgtcgtagacatagatgtaacagctgaagacttcataactagaatgacaaattattgcacttatctgcctaatgaaaaagtacttcctaaagagtcactgctttatcagcggtacatgctactggaagaactaagtcaaatcaggatcgatggcagaaaattaagtaaagaagatcgtaaagctataattaacgatcttttcataggcaaagggcgtgtaaaggttagtgacaaagatttcaaggaatatttgaataaagttaattatgtaaaagtaaacggtaaaggatatgacgttaccggatatcaatccgacgacgggttcgcgtgcgctctatcatcatacaataaattcagacgaatacttggacacattgatgaacagaacgaaaaaatgatagaagacatcatctactggataaccgtatttgaagacaaggacatcgtaaaacgaaaaattaacaaacaatacgcagacaggcttagtgcagaacaactgaaaaaaatcctaaaactaaaattcaaaggatggggacgatattcaagtaaactcctaaacggtattaaaggagatatgggtacgacaataattgaaatgttagaagacgcagatgaaagattcgcttactgcgattattgcccaaatttcatgcaaataattaataaggacgaaaaaataaaacagataattgatgataacagaccaagatacgatggaacgaaggatcttttagacgttatacaagatatgcatacaagcccagccaatagaagaggaatttggcaaacaatgaaagcaatagaagaaataattgaatacatgggagaaaaaccccaacaaatatatatagaattcgctagagaggacgacccaaaagcaaaaaacaagagagcagatagtagaaaacgagctatcgataaggccctgaaaaaactgaaagaagatgtagtagacgaatacaacgaaaaggtctacaaagaattaaaacaatacgaaaaaagactggatgaagaaaaagtatatttgtattttatgcaaaatggcaaagacctatactttccagataaagaattaaacttagacgaactcgaaaaactagagatagaccatataatcccatattcgctatcagacgatgactcgttagacaacaaagctcttgtactaaaaggaaataatcaaaataaaggaaacaaaatagtgaaagaagctttcccacaattattctcaaactctggaacagtcaactattggaaaaacctaaaaaaggcaggtcttatatcagaaaagaaatacaataatctacaaaaaaacaatgttgacgacatattaacaaaaggatttattaatcgacaactagtagaaacaaggcaaatagtaaaaagcgtcgcaaatctcatactagactattacaatgagcaaatagacgtcatagaagtcaaagcctcactttccacctcagtaagaaagatgttgacgtatgagaagaaagataacaatggtttttggatagaaaataaggacaattgtatgttttacaagaaccgagacatgaacgactaccatcatgcacatgacgcataccttgcaaatataataggactgtacattcaaaaaaattatccgcgattacaaaaagaattaaattattcacaataccgaagaatatggagaaaatattacgaaaacacaaaaaacaacaacggggtaaattggttcgccaccttaggaaaattctcaagcaacaatgaagaagccgactggtacgggcaagatattatcgcatacatgagaaaaatattttgttatagggacgtactaatatccaaaaaagtggaagaaaacaccggtgcattttacagtgaaaccaagtacccacgcgaagacaaagcgggatcaaaattagtcccccttaaacaaggaaacaacatgaggggagcaaacaatctgaaagaattggacgctcggaaatacgggggatataaaggaggcgaaaaggcctatttcgtactagtaaaatactgtatcgaaaaagcattaaaaaaaaaagtaaaaaaagaatatcatatggaatttgtcgaaattcctgtctatatagcaagaggaatcaagaataaagacataaacctatatgactatgtttgcgacattctaaacgaagctaacaaaaattcagtagcagacgtagaaatactaagaaataaagttcctaaatatcaaatgataataggcgaaaatggcgaagaatattatttagtaagcgcaacagaggtaataaatagcaaacaattcgtattaggaggggccaaccaacaatataatagacttctaaactatatcaaatacggtaaaaatgacaaatggcaatacatacaaacagaactcttagacgaacaattaataggactttacaacttattaatcgcaaaaataaaagatgaatataaaggcttctcgaaagaagcagtaagaatacaggaaaacaactcattcgataaattagacgtaaaagacaaaaaagaatttatcgcagagatgatcaaactggtacaacctgattcagattacccatacttgggaaaatatgctacaggactgtccaacagaatgggcaggaaaacaggggagaaagttgggaaaaaaataacattagtcgataaaagcgttactggactatatgaaaggcgaacaacttttgaactagaagacgattccagcacaaaatcatgttga

SEQ ID NO: 5657 - RNA, 4281 nt, synthetic construct
  misc_feature 1..4281: note = Cas9 variant
  source 1..4281: mol_type = other RNA
atgaaaaatatactcggcttggacctcgggactaccagcataggttttgcgcacatcgtggaagacgaaaacaaagaaaaatcagaaattaaagaactcggagtaagaatagtatcgctaactactgacgaacaaagtgattttgaaaaaggaaaaagcatcaccacaaatgcaaacagaacactaaaacacggagcacgactaaatttagaccgctaccaacaacgacgcaaatacttaattgacctattacaaaaagctaacctaataacaccatcctcaattttagcagaaaatggtaaaaacaccactcatagcacttggcaactaagagcaaaagctgtaacagaaaggatagaaaaagaagaatttgctagaatattattagccataaataagaaaagaggttataaaagcagtcgcaaagctaaaacagaagatgaaggacaagctatagatggaatggctatcgcaaaaagattatatgacgaaaaccttactccaggacaactttcattacaactcctacaacaaaataagaaactattaccagacttctaccgctccgatctgcaaaaagagttcgacctagtatggaactttcaaaaacaattttatccggatattttaacagatattttctacaaagaactacaaggaaaaggaaaagacgcgacatcgaaagcattctctaaaagataccactttgatacaactgaaaataaaggatccaaagaatctgtccgtctgcaagcataccaatggcgtgcggaagcaatatcaaaacaactaagcaaagaagaagttgcatacgtactcacagaaataaacaataacctaaacaacgcaagtggatacctaggtgcaatatcagatagatcgaaagaactatacttcaatcgccaaacagtcggccaatatttatatgcaaaattacaagaaaacagacacaacagtctcaaaaacaaagtattctacagacaagactatctagacgaatttgaaagaatatgggaaacacaagcaagtttccataaagaactgaccgacgaactaaagaaacagattcgagatgttgtgatattttaccaacgtaaaccaaaatcacagaagggactgattagtttttgcgaatttgaatccaaagagatagagatcgaaaaagatggtaaaacaattactaagaatattggagcaagagtcgtaccaaagtcatcccccttattccaagagttcaaaatatggcaaatacttaataatgttatatgtaaaagaaaaggtattcggaaaaagaaaatttccgctaaaacaacgcaactagatctattaaatgaaagcagtcaaacaatatttagtctagacatggagtgcaaacaactcttgtttgatgaactcaatcttaaaggagacctaaaatcagataaagtattaaaactactaggatacagtccccaagaatgggaaataaattacaaccaattggaaggaaatcgaacccaaaaagcattatacgaggcttatctaaaaatcgtcgaaatggaagcgcatgatgtaaaagatatactacaaattaaaagcgccaaagatgactggtcgctagatgaatccccactatcagcatcagaaatacgagaaaaagtaaaagccatatttcaaacactaggcatttgcaccaaaatattatacttcgatccactactccccgtaaaagaatttgaagaacaagactcataccaactatggcatctcctttattcatatgaatcagatgatagcacctctggtaatgaaaccctctatcgtattcttgagaagaaatatgcctttaaaagagaacacgcaaggattttggcaaatgtcgcacttcaagatgactatgggtcactgtcaaccaaagcaatacgcaaaatatacccaaatatcaaagaaaaccaatattccacggcttgcgaaaaagcaggctacaaacattcaaaactttcactcactacagaagaattggaagcgagagaacttaaaaatataataccactactaaagaaaaacgcattaagaaacccagtagttgagaaaatcctaaaccaaatgataaacgtagtaaacgccctaattgagaaaaactctgaaagagatgcagaggggaaaatcacaaaatacttccattttgacgaaatacggatagaattagcaagagaactaaagaaaaatgcacaaaaacgctatgaaatgacccaaaatattaacaaagcaaaattggaacaccagaaaatatcggaaatccttcaaaaagagttcggaatcaaaaaccccactaaatcagacataataagatacaggttataccaagaactcgagcataacggatataaagaactctataccaatgcacctatagcgcgggatatgctattctccaaaaatatcgaaatagagcatatagtccctaaagctcgcgtattcgatgacagcttcagcaacaaaaccttaacattccatagaatcaatagtgataaaggcgaatatacagcttttgactacataacttcgttaaactctgaagaagaattaaaccagtacttaacgagagttgaaaacgcctataaaacaaaatcgataagtcctaccaaatacaaaaacctcctgaagaaagcatccgaaataggagacgatttcataaacagagatttaagagacacccaatatattgccaagaaagcaaaagagattttgtttcaagttactaaaaacgtattatccacatcaggaagtatcactgaccgactaagagaggactggggactcgttgacgtcatgaaagaattaaacatgcctaaataccagagcctagggctaacagaagtagaagagagaaaggatggtaataaagtaactgtaataaagaattggactaagagaaatgatcatcgccatcatgccatggacgcactaacagttgcattcacaaaaccatcttatatccaatacctgaatcatttaaacgctcgcaaagatgagaataacaaaaactacagcgttatattggcgattgaagaaaaagaaaccataaaagtgccaacaaacaacggtaaaaataaaagagtcttcatagaacccataccaaacttccgacaagttgccaagaaacatctagaagaaatattcatatcacataaagctaaaaataaagtcgtcacgaaaaatacaaataaacccgcaggtacagacaaacaacaaataacactcacaccgcgaggtcaactacacaaagaaaccatatacgggaaatatcagtactacataaataaagaggagaaaataggagtcaagtttgacgaacgcacaattgcaaaagtatcaaacccagtatacagagaagctctcctcaaaagactccaggccaacgacaacgacccaaagaaggcttttgcaggtaaaaatgcactatctaagaacccaatctatcttgatgaaagtaaaacgaaaacactaccagaaaaagtaaatttaacatatctagaagaagacttctccatcagaaaagatatatcccccgacaacttcaaagatttaaaatctattgagaaagtcatcgatcaaggagtaaagagaatacttattaaaagacttcaggcatacgataatgaccccaagaaagccttcgtagatcttgagaaaaaccctatatggctgaacaaggaaaaaggaatagctataaaaagagtcacaattagcggagtaaataatgcacaacctctacatattgggaaagatcatctaggcaaaacaacattaaacaaagaaggaaaagaaatacccgtagattacgtatctaccggaaataaccaccacgtagccatttatcgcgataaagaaggcaaccttcaggaacaaatagtatcatttttcgacgcagtagtaagagctcaacaaggaatcccaataatagataaaacatacaaacaagctgaaggctggcaatttctatttaccatgaaacaaaatgagatgtttgtctttccaaatgcaacaaccggatttaacccggcagaaatcgacctgctagatcccaaaaacaagaaactcatatcaccaaacctatttagggtacagaaaatagcaacaaaggattacttctttcgccatcatttagaaacaaacgttgaaaccgacaacatactcaaaaatgtcacctggaaacgtgagggattatctggacttaaagacatagtcaaagtccgaataaaccacctaggagatatagtatccatcggagaatactga

SEQ ID NO: 5658 - RNA, 4281 nt, synthetic construct
  misc_feature 1..4281: note = Cas9 variant
  source 1..4281: mol_type = other RNA
atgaagaacatcctgggtctcgatctaggcacaacaagtataggtttcacacacatagtagaagacgagaacaaagaaaagagcgaaattaaagaactaggagtaaggatcgtttcattaacaacggacgaacaatcagacttcgaaaaaggaaaaagtatatcaacaaacgccaatcgaacattaaaacacggtgcccgcctaaatctagaccgttatcaacaaagaagaaaattcctaatagatttactacaaaaagctaatcttataacttcctcaagtatactcgccgaaaatggaaaaaacacaacacactcaacatggcaacttcgagcaaaagctgtcacagaaagaattgaaaaagaagaattcgctcgcgtattgttagctattaataaaaaaaggggctacaaatcatctagaaaagccaaaaccgaagacgagggacaagcaatcgacggaatggcaatagcaaaaagactttatgacgaaaacttaactccgggccaactctcactacaattattacagcaaaacaaaaagttgttaccggacttttatagatcagatttacaaaaagaattcgacttagtctggaacttccaaaaacagttctacccagatatactgacagactcattctacaaagaacttcaaggaaaaggaaaagatgcaacctcaaaggcttttagtaaacggtatcatttcgacacggcagaaaacaaaggtagtagggaatccgtaagactgcaagcataccagtggagggcagaagccataagcaaacaactatcaaaagaagaagtggcttacgtcctaactgaaataaataacaatctcaataacgcctccgggtacctaggcgctatatcagaccgaagcaaagagctttacttcaacagacaaacagtaggtcaatacctttacgcacagctccaagaaaataaacacaattcattaaaaaacaaggttttttatagacaagactacttagacgaattcgaaagaatatgggaaacccaagcctcattccataaagaattaaccgaagaactaaaaaaacaaataagagatgtagtcatcttctaccaacgaaaattgaagtctcaaaaaggactcataagcttttgcgaatttgaaagtaaagaaatagaaatagaaaaagacgggaagacaatcacaaaaagtatcggagctcgtgttgtgcctaaaagctcaccacttttccaagaattcaaaatatggcaaatattaaacaatgtcacatgcaagagaaaaggcatacgtaaaaagaaaagttccgccaaatctactgaattagacctttttaatgaaccgtcacaaacaatcttcagcctagatatggaatgtaaacagttattatttgaagaattaaatctaaaaggagacctaaaaagcgataaagtattgaaactcttgggatactccccacaggaatgggaaataaattataatcaattagaaggcaaccgcacgcaaaaagcactgtacgaagcgtacttaaaaatagttgagatggaagcgcacgatgttaaagatatcttacagatcaaaagcactaaagacgactgggcattggaagaatcccccctaagcgcatccgaaatccgagaacgagttaaggctatatttcaaacactaggtatatgcacaaaaatactttatttcgacccgctgttaccagtaaaagaattcgaagaacaggattcttaccaattgtggcacctcctatacagttacgaaagcgatgatagtacatccggaaatgaaacactctatagaatactagaaaaaaaatacgcattcaaaagagagcacgctacaatattagcaaacgtaaccttacaagacgactacgggagcttaagtacgaaagcaataagaaaaatatacccgtacataaaagaaaaccaatacagcaccgcgtgcgaaaaagctggatataaacattcaaaactaagcttaacgacagaagaactagaggcccgagaattaaaaaacatcattcccttactaaaaaaaaacgccttacgcaatccagtagtcgaaaaaatactcaaccaaatgataaacgtagtaaatgcattaattgaaaaaaatagtgaacgtgatgcggaaggaaagattacgaaatatttccactttgacgaaataaggatagaattagcaagagaactcaaaaaaaatgcacaagaacgatacgaaatgacacaaaatatcaacaaagcaaaattagaacaccaaaaaatatcaggaatcctacaaaaggaatttggaattaaaaacccaactaagtctgacataacaaggtacagattataccaagaattagcacacaacggatacaatgacctatacacaaatacatatataccgaaagagctccttttcagcaaaaatatagatattgaacatatcgtttctaaggctagagtgtttgatgactcatttagtaataaaacactagcatttagagaatttaacattaaaaaaggagaatccacggcatttgattacataacgtctttaaacaacgaagaagaattaaatcaatacttgaaccgggtagaaaacgcatacaaaaccaagaacatatcacccgccaaatacaagaaccttttaaaaaaggcttctgaaataggagatgggttcatcaatagagatttaagggacacacaatacatagcgaaaaaagctaaagagatactattccaagtaacaaaaaatgtactaagcaccagtggatcaataacggacagactaagggaagactgggggctagttgacgttatgaaagaactgaacatgccaaaataccaaagcctaggtttgaccgaagtcgaagaaagaaaagaaggcaataaagttacagtgatcaaaaattggacaaaaaggaatgatcatcgacatcacgcaatggatgcacttacagtagcatttaccaagcctagttacatacagtatctaaatcacttaaatgcgagaaaagacaagaacaacaagaactactccgtaatcctagcaatagaagaaaaagaaaccataaaagtacccaccaacaacggaaaaaacaaaagagtttttatagaaccaatacccaacttcagacaggttgcaaaaaaacacttagaagaaatattcattagccacaaagcaaaaaataaagtagtaacaaagaatacaaataaacccgcgggaacagacaaacaacaaattaccctgaccccacggggccaattacataaagagacagtatacgggaaatatcaatactatgtaaataaagaagaaaagataggagtaaaattcgataaagaaacaatagccaaagtaagcaacccagtttacagagaagccctattgaaaagattacaggccaatgataatgacccaaaaaaagcatttgccggaaaaaacgcactaagtaaaaaccccatctacctagacgaggccaaaacaaaaacccttaccgaaaaagtaaacctgacctacttagaagaagatttcagtatacgcaaagacatatcacccgacaactttaaggacctaaaaagtatagaaaaagtcattgaccaaggcgttaaacggatactaataaaaagacttcaagattacgataatgacccgaaaaaagcttttgtcgatctagaaaaaaaccccatatggctaaataaagaaaaaggaatcgcaatcaaaagagtcactataagtggtgtcaacaatgcccaaccattgcatataggtaaggaccacctaggtaaaacaaccctaaacaaagaagggaaagaaataccggttgactatgtctccaccggtaataaccaccacgttgcaatataccgagataaagaaggaaacttacaagagcagatagtatcgttcttcgaagcggtggtcggcgcccaacaaggcctaccaatagtagacaaaacgtataaacaagcagaaggttggcagtttctatttacgatgaaacaaaacgaaatgtttgtgtttcctaacgaagctaccggatttaacccagcggaaattgacctactagacccaaaaaacaaaaaacaaatttcacccaatctattcagagtacaaaaaattgctacaaaagattatttcttccgtcatcacctggaaacaaacgtagacacagataacgttctcaaaaacactacatggaaacgagaaggcctatccggcctcaaagacatagtaaaagtaaggataaaccacctgggggatatcgtttcaattggtgagtactga

SEQ ID NO: 5659 - RNA, 4284 nt, synthetic construct
  misc_feature 1..4284: note = Cas9 variant
  source 1..4284: mol_type = other RNA
atgaagaaaatactcggattagaccttggaactagcagtataggctgggcactggtaaatgaagcagaaacgagcgaagagaaaagttcaataataaaattaggagtacgagtaaatcccctaacagtagacgaacttcaaaacttcgaaaaaggcaaaagcataacaacaaacgcagatcgtactgcaggaagatccatgagacgaaatttgcaaagatataaactcagacgagaaaatctaatagaagtattaaaagaatacaacttcattactgacgaaatgatattgagtgaaaacggaaacagaacaacatttgaaacatatcgattaagagcaaaagcagcagtagaagaaataagtctagaacaatttgcaagagtactactaatgatcaataagaaaagaggatataaatcttcaagaaaagcaaaaggagcagaaaatggtacacttatcgacggaatggaagtcgccaagaaaatgtatgatgaaggaataacaccaggagaactttgtctccaactattaacagcgggaaaaagatattttccagacttctatcgaagcgatctacaagcggaatttgatagaatctggaacttccaaaaacaattttatccagatagtttaatagataaagtaaaagatgaagtacgaggtaaaaataaaagccaaacatgggcaatactagccaaatatttcgtttggaaagaagtcgaaaacagctggaacgaagaagaagcgcaaactagaagagtagaaaaagaatacagattagtcggcataaaacgtggagttaaacgagaagaactaaaactagaaaattttcaatggagggtaaaagcgctaagtgaaaggatgaacccagaagaattagcaattgtattacaagaaattaatgaacaaatatctaactcaagcggatatctgggggcaataagcgacagatcaaaagaactatacttcaaccgacaaactgtgggacaataccaaatggcagttctagataacaatcccaacataggactaagaaacatggtattctatagacaagattacctagacgagttcaatacaatatgggagaaacaagcagaatttcacaaagaattgacagaagatctaaagaaagaaattcgcgacatagttatattctaccaaaggagacttaaaagccaaaaaggattaataaatatatgtgagttcgaaagacgacaaatagaagtagaaatagatggcaaaaagaaaataaaaaccataggatcaagagttattccacgcagttccccactatttcaagaatttaaaatatggcaaacactcaatgatatagaggtcagcgtattgggcgttaaaaacaaaagaaagaaacaagatgataactcaaccacactactagactcagcagaaaacatagactcactgaaactcaacgtaagtagaccactagatgcagatgagaaaagtttgctagcaaaagaactatttatccgagacaaacttaccaaaagtgacgtacttaaattgctgttcaacaacccacaaaacttaaacctgaattttaaaaacatcgacggaaaccggaccggcagcgcactatatcaagcatttagtaaaattttagagataagtggccacgaatcgatcaattttaagaaatcagctgacgaaatcgtggaacaagtcaaaactatcttctccgcattaggatggaacactgaagtactttgctttgattcagaaaaagagttagacaaacaaccatactttaaactatggcacctcttgtactcattcgaaggagacagtacaccaacaggtgatggtaacttaatacagaaaattgcggacttgtgcgggttcgaaaaagactacgctagtatactcgcaaatataacattccaggaggactacggatccttaagcacaaaagcaataagaaaaatcttaccccacttaaaagacggaaatcaatatgacgtagcctgcgagtacgcgggctataaacacagcaaatcatcccttaagaaagaggaaatcaaaaataaagtgctcaaagataaattagaactactacctaaaaatagtctgagaaacccagtagtagagaaaatactaaaccagatggttaatgttatcaatgctataataacaacatatggcaaaccagatgaaatacgtatcgagctagcacgggaattaaagaaaaacgctaaagagagagaagaattgaccaaaagtatagtagatactactaaaacacatgaaggaataagagctatactacagaatgacttcgggatgagccatgtatctagaaacgcaattataagatataaattatatgaagaactaaaagataacggatacaaaactctctattccaacacatatataccgaaagaaaaactcttctctaaagatttcgatatagaacatataattcctcaagcaagattattcgacgactcttttagcaacaaaacacttgaagtaaaaagtatcaatatagagaaaggatccaagactgcgtacgatttcgttgaagaaaaatatggcgaacaaggtctacaagaatatcttaaccgatgtgaagtactttttagggacaaaaagaccaaactcagaaagttaaaaatgcaagaaagcgaaataccagaaggattcatagacagagatctgcggaacacacaatacattgccaagaaggctttatcgatgctaaacgaaatatgcaggagagtagtggcaaccaccggagcaatcactgatgagttacgagaggattggcaactggttgatgtaatgaaagaacttaattgggaaaaatacaaagttctcggattagtcgaatatttcgaagacaatgatgggcgattaataggcagaattaaagactggaccaaaagaaacgatcaccgacaccacgcaatggacgcactaacggtagcattcacaaaagatgtttttatacaatactttaacaataaaaatgcatcactcaaaccagataccaatgaagcggcaatacgaaataaatatttccaaaatggaaaagccattcccccaatgagcttggatgagttcagagcagaggccaagaaacatctaaatgacacacttatcagtatcaagacgaaaaataaagtagtcacaataaacttaaaccgaaccaagaagaaaaatggaattaataagaaacagcagcaaacccctcgaggtcaactacatctagaaaccgtatacggatcacacaaacaatatgtcgtaaaagaagaaaaagttaatgcctcattcgatgcggctaaaatagctactgtaaacaaacctgcttacagagatgcacttcttcgtagattacaagaaaacggaaacgatagtaagaaagcatttacaggtaaaaacagtctggacaaacaaccagtatggttagatgcaaaacagaacgaatgcgtacctgaaaaagttaaaacagtgatgttagaaacagtctacacagtcaggaaacctatagatgagaaacttaacgttgataaagtagtagatgcaagaatacgcaaactactacaagatagaatcaaagaatatggaaatgccaaatctgctttcgccaacctcgacgagaacccaatatggctaaataaagaaaaaggaataacgataaaacgagtaagtgttagtggaatctcaaaggctcagagcttacatgaaaagaaagacaaagatgggaatttcatccttgacaaggattcaagacgaatcccagtagactttgtcaacacaggtaataaccatcatgtagccatttatcgcaaaccagtgctcgacaagaaaggtcaagcagtattcgacgaaaacggagagctgaaatttgaacttgaagaagtagtagtaagtttcttcgacgctgtaacaagggtaaatttgagtcaaccaataatcgacaaagactataaaagaagtgaaggatggaaatttctatttagcatgaaacaaaacgaatactttgtttttccaaacgaaaagaccggattcgaccccaaagaaatagatttgctcaaccctgaaaactatgctctaatatcacccaacttattccgagtacagaaaatagccagtaaagactacgtcttccgtcatcacttagaaacggtggtagcggaccgaaaggaattacaagagataacatggaaaagaataagctcactgtcaatattaaatagaataataaaggttagagtaaaccacataggccaaatagttatgatcggtgaatattga

SEQ ID NO: 5660 - RNA, 4284 nt, synthetic construct
  misc_feature 1..4284: note = Cas9 variant
  source 1..4284: mol_type = other RNA
atggcaaaaccgaaagactatacaataggactcgatattggaaccaattcagtgggatgggtagtgaccgatgatcaaaataatatattgcgtataaaaggcaagaaagcgataggagcacgactattcgctgaaggaaaagttgcagccgaacgtagatcattcagaacaacacgccgaagactttcaagaagaaggtggagaataaaattgctcgaagaactcttcgacaaagaaatagcaaaagttgacccctcattcttcgcacgattacatgaatcttggatttcacctaaagacaaaagaaagcgatactcagccatagtctttccatctcctgaagaagataagaaatttcacgaatcttatccgactatataccacttaagggacaaactcatgaaagatgaccaaaaacatgatataagagaaatctatattgccgtacatcaaatgataaaagcaagaggaaatttcttgcacgatgaaagcgtagaaacttacaggtccggaatgtcatctctaggaggaagatcagaacgaactatactgagcgtccaaaccctagaagaattaaatgacttattcgcagaaaacgaaggtacagaagaagctaaattaaatgtagcatcagcagaacaaataaatgatatattgacagggggtcatttgaacgcagattcacaaaaagaaattggtaatttattactcccaagcagctttccatcatttgatgataaagcaaaagaaaaacaagtcaagaaattgatcaaaaatgtagcaacaaatatatcaaaagcatggctcgggtacaaagcagacttttcgactatactaaatctagccaacgtagataaagaccagaagaaaatattcgccttcgcattacaaggaggagatgaagaagataaagtacaagaattagagagcttactagaacaatcacaaacagatatcgtagacagactaatagaaatcaggcacgcaattgtattatcagaaattgtaccggtaggtatgacactaagtgaagctatgatagataaatacgaccaacataaagaagacttaataacactcaaagcggtaattcgtaatacgaaagacaaaaagaaagctgcaaaattacaagcaatttacgatctatatgtcaacaatagacacgcagatcttgctaaagcaatgaaacttacaggaattaagaaacgatctgaactattagaccccgaagaacttaagaaagccatatcatctttattggatgattcacccgaagctgtagaaataaaacaaatgcttgaagagaaaacatttctacccttacaaagatcaaataataacggcgtcatacccaatcaattacatcaagtagaattagatgaaataatcaagaaacaatccaaatactacccatttttagcagagaaaaatcccgatgaatcagaagaagcgcagaagaaagctccaacaaaactagatgcattactaaccttcagggtaccatactacgttggtccgatgataacgaaagaagaacaagaagcacaagacggccacagttttgcgtggatggtaagaagagacccgcaagatcacgaagcaataacaccatggaattttgaaaagaaagtggacaaaatggcaagcgcaactcaatttatcaaaaggatgaccaccaaagatacgtatctactaggtgaagatgttcttccagcctcatcgttaaaatatcaactatttactgttttgaacgaactcaacaacctccgagtaaacggcaagaaattaacaagtgatgaaaaagaacaagtaatagaaggactcttcaagaaacagaaaacggtaaaagccgacaaatttgtaaaatactggcaagcaaaacatataggtgcagatataaaagtaaaaggtctttctgacccatcgaaatttaactctacaatgagtacatacatagattttaagaaaatttttggagaccaattaaatgatgtaaaccgtcagaatgatttcgagaaaataatagaatactctacaatatttgaagaccgcaaaattctagaagataaactaagagcagatttcgcatggttatcagaagaacaaataaaacaactctgtagattacgattacaaggttggggaagactaagcgacaaattacttactagactaactgatgctgatgggcaaaacgtattggaaagactttggaactcaaacgacaattttgtccagatagtaagcgatccaaatattaaagccaaaatagaacaagaaaatcaaaaactactcagagatggtcaatcagatgacgcagttgaatccatcctagatgatgcatatacatcaccacaaaacaagaaagcgattcggcaagtaatgagggtagtgcatgacatagtcaaagcctgcgatggtaacgtacctgctaaattcgcaatagagttcgctcgcagtcaagaagacgatcccaaacgtacaaccgcgagagtaaaccagatgcagaaaatatacgaccaaataagcgatgaggtagtctctcaaggtgttaaagaacagctctcaggtatgaaatcacttaaagacagatattatttatatttcatgcaaggcggacgggatgcatacacaggagccaaattaaacatagatcgactctcagattatgacattgatcatatcatgccccaaagttttgtcaaagatgattcactcgacaaccgtgtcttagttgcaagagcagttaataaccagaaaagcgataaagtaccagcactattatttggaaacaaagttgtagcggacctaggaataactgtacgcgaaatgtgggataaatggcaaaaattaggaatgatttccaaaagaaaattaagtaatcttttaacggacccagacgccctaacagaatatagagctcaaggtttcatacgaagacaacttgtagaaacttcacaggtaataaaattaaccgcaactatcttacaatctgagttccccgactcaaaaataatagaagtgcctgctaaatataacagtatcgtaagaaaacagttcgacctatacaaatcacgagaggtaaatgattaccaccatgcaatcgacgcatatctaagtacaatagtcggaaactatttataccaggtatacccaaacctgagaagaatgttcgtctatggagaatttaagaaattctcatccaatgcggaagaaagcgcatatgacgtagttcggagagtaaaatccatgaatttccttgatgatctgcttcgaggcactcatggagacaatatatattgcagaagcacaggagaaatagtattcaatcgaaatgatataatatccaaactcaaacaggcgtatagcttcaaacaaatgctcgtcacacaggaagtatttacaaagaaatcggcactatttgatcaaaccgtatacccgtctcctgaaagagactccaaaaagagaagtggactaatacccaggaagaaaggaatggatacagaaatatacggaggttacagcggaaacaaagacgcctattttgtactcgctgaggcggtaaaagaaaaaggtcacacattacaaatagtaggagttcccataagagcgctaaataccctcaaaaattcagcaaactattcggagaaactactcgaaataattaaaccacaagtaatgtttaataaagacacaggtaagcctataaaaggtataaaagacgtcaaaatattaatggataaaataccgtgtcgacaacctgtactagaaggagaatcatattacatgttagcatcatctaaataccgatactcactgaaacaaatatcattaagtcaaatgtccatgaaatatattttagattacatagatgacccaaattttaacaaacacgaaatgatcaatatagaccagcaagatgaaaaagagtgtcttctttcagtatacgatgaaatattagagaaaatggacaaatacctacccttatttgacataagatcattcaggaagaaattgcacgacggtagagacgccttcattgcgttaccagtagcatccgaagagaagaaaccaggaaaagtcgatgtcattcgtaaagtcttaaaaggactacatgccaatgccgatataacaaatttagcagagttaggtttcggaactgctgcattaggtgccctagtctcaaccggcggaattaaaataagtgacgatgcagtattcatatatcaatcaccaactggtctattcgaacgaagagtaaaggtaagcgatctgctaaaatga

SEQ ID NO: 5661 - RNA, 4287 nt, synthetic construct
  misc_feature 1..4287: note = Cas9 variant
  source 1..4287: mol_type = other RNA
atgaagaaaatattgggcttagatttaggaactacgagcataggaagtgcatacgtattagaggcagagaaaagcgccgaacagactaaaatagtgtatctaggcactcgaataattctgagctccgcagacgctgaaaatttttccaaaggtttaagctgttctccaactaccgacaggacgttcaaaagatcaatgaggagacgtctacaacgatataagcaaagaagatcatcactcatccaacaatttaagaagattggaattatcacaaacactgaacagataataagagaacccatatcagagacccacgaactactaaggatcagatccaaggccgtctcagaacgtgtatcacttgaagagttcgcaagaatattacttacaatcaataaaagacgagggtataaaagtaatagaaaaacgtcgaagagtacagaagaagacggaaagctcgttgacgcgatggcagtgacaaaagaacttataaaattaaagaaaacaccgggccaatatatgttcgaaagattcaaaagagggaaatatgcagaaatcgacttctacccattcgatctcatcaacgaactaaaacagatatgggaagtacaaggacaaaaatacccggatgtactaactgaagatttactaagctcattacttaaacagaaaactgggaaagccaaagaacttatatacagcaaaagcgacttaaacccagccgaagtaccaatcgactaccaaaaaggtaagaaattacgaaaaacaattctaaacaaatattttgcctacgaatctagaagtttggcagcaactaacataataccagttgaacaagtaataaccgcaattgtagccatatgcaaacaaattaacaatagctcgggatacttaggagccataggtgacagaagcagagtactgtacgccaacaatcaaacaatcgggcaatatctatatgaacgaatcaaagcaaatccccacgacagaatccgaggagaagtattctatagacaggattacttagatgaatttgacagaatatgggaatgccagcaaaattactatccagctatattgacaaatgacagaaaacaatttatacgtaaccgaatcatcttttaccaacgaccgctaaaatccaagaaatcagagctggcattctgcgagttcgaatcaagagaagtagaacacaacggaaagaaatacactgaaggattacacgtagcgcccaaatctagtcctgtattccaacatttccgactatggcaaagactaggccaaatagaagtaagtccactcaggaaatggaacaaacaaagcaacgaactttttgaacaacaaaatgacacagatcaagaacgtatcctaaatactgaagctaagcaaaaactcttctcatacttaaatttgctagaccacctcacagataatgaaatattaaacatactaggttacagtccagataaatggaagatcaacttcagggaaataattggcaataggaccaataactcaatgatgaaagcatttttcaacatgaaagaaatgactgatggcgaacaaataaattgggagaaaaatttaacaaaaataacaaatggacaaagcctaatcagcccagaacaaatcgtagacttaataagacaattctttgaaagagaaggaattacaacatcactattgtactttgaccctacaacagacaattttagagaacaatctcactactccctctggcacctattatacagttatgaagacgacaatagtccaaccggaacaaccagtctctgcaaaacattagctaaaagatatggcataccccatgaactttgccccctgctcgcttcgttaacctttgagcctcaatatggtagcctatcaacaaaagcgatgagaaaaatcctgccatttatgcaagaaaacggttacgacaaagcctgtgaattagccggatacagacacagcgcatggactaccaaagaagaaaacacagaaagaaccctgaagaactcactcccactattacgtaaaggtagtctaaggaacccggtagtagaaaagatactaaatcagatgactcacgtaataaacacacatatatccgaatacgggaaccccgatgaaattagaatagaaatggcacgcgacatgcaagcaaactccaagcaacgaaaagcaatgacaacagccatagctgaagccacaaaaagaaacactcaatttatagaagaaatacaaaaagagttcggtttcaacccaagcaaaaacgatctcatcaaatacaagttatggaaggaattagctcccctaggaagtaaaaccctatactccaatacctacattcctaaagaagaactctttacagcgaaatttgaaatagaacatatcatcccaagggctttgttctatgacgatagcttctctaacaaaacactagaattaaacagcgtaaacaaattaaaaggaaataaaactgcccttgactatatggacacattaagccaagaacaagcaaatgattatataataagagtcgaagaactgaagaaaataggtgccattacacaggcaaaatataaaaagctattaataagagaaaaagacttaggagacgacttcacaaaccgagatctgacaaatacaagatatataatccgacatgctgctgatatgctactacaagtaaccccaagtatagtccacactaatggatcaattaccgcaattcttagaagagactgggaactgctagacatcctaaaagaattgaatctgccgacttacgaatcgatagataggaaaatatcagatccaaaagaaaaactaacggaaagcgttgaaagaaaagacggacaagcgattaaaatgatcaaggactggagtaaacgtgatgaccatagacatcatgcaatggacgcacttataaccgctctaacgacgagaaagcatgtgcaataccttaatggaaaccgaggcgcagaagaaactgataaggttcaaaaactacaacaactcaaagccctacgaaaacagctcatcggaagcgatggccattttataccgccaatgcatgatatcagagtacaagcgaaggaagctctttcaagagttataatctcaacaaaggcaaaaggaaaagtaacaactccaaatactaatattatatgctccagagataaaactactggacgaaaaatctacgtaaaacaaacgacattaaccccaagaggagcgttgcataaagaaatgcaatatggatgtaaccactactatctagagaaacaaataccaataggatccaaactaactgaagaggaaatacgactcgtatcttcaccaaaaattagaagtatgttaagcgaacggcttcaagcatataacaatgacccaaaaagcgcatttaccgggcgaaacagtatggacaaaaagccactagaagacaaaaacaagaaattagtatatacagataagaaagtcaaacaaacaattctagcgaatcggttcgtaaaaagagatagagtaaacagcaaactagacttggacaaagtcatagatacaggaataaaaaggattttagaaagaagactgaaacaatatgggggcaaatatgaaactgccttttctgaccttgaaaacaatccaatatggttaaatgaagaaaaaggaatagcaattaaatcagtacgcattagaggtaaaaataacacaataaccatacgacaaacgaatacatgcagaataaaatacgtagcaaacgataacaatcatcatttagcagtatacgcacttcccgacggtagtatagaagatgacatagtatcattctttgatgctgtagaacgctcgagaaaaggactcccaataatagataaacacaaaaaccaatcactaggatggaaatttttatttagtgtcaaacaaaacgaatattttctactcccacagcaaggagaaaagatagatatagacacaggcgaaatcagcatgcaaacaacattctcaccgaaagacttatcacccgaatatataatgaacccagacaactacgcagaacttgcaccgcatatttttcgagtacaatcgatttcgaaaactccacaaggtaacagagacgtaagaatttacttattcaaacaacagtacatatccggaagccaaaaagattctctacacttaaaaggaataacacataggcaaatcagctcggccaaagacctcgccggtttagtaaaaatccgagtaaatcacttaggtcgaatagtagccgtcggtgaaaaatga

SEQ ID NO: 5662 - RNA, 4287 nt, synthetic construct
  misc_feature 1..4287: note = Cas9 variant
  source 1..4287: mol_type = other RNA
atgaagaaaatcttaggactcgacttgggcaccgcctccattggctctgcatacgtgcttgaagcagaaaaatctgcagatcagacaaaaatcgtctacttaggtaccaggatcatactctcatcagcagatgcagaaaatttttccaaaggcctttcctgctctccaactactgacagaacattcaaaagaagtatgaggcgacgacttcaaagatataaacaaagaaggtcatccctcatacaacaattcaagaaaataggcataataacgaatacagaacaaataataagagaaccaatctcagaaacacatgaattactacgaataagaagtaaagccgtatcagaacgtgtaagtctcgaagagtttgccagaatcctattaacaattaacaaacgtagaggctacaaatcaaatagaaaaacaagtaaatccaccgaagaagacgggaagctagttgacgctatggcagtgaccaaagaactgatcaaattaaagaaaacaccaggtcaatatatgtttgaaaggttcaaacgtggaaaatatgccgaaatcgacttttatccctttgatttaataaatgaattaaaacaaatctgggaagttcaaggacaaaaatatcccgacgtactaacagaggacctactatcaagccttttaaaacagaaaacgggaaaagccaaagaactaatttactcaaaatcagacttaaatccagcagaagtgcctatcgactaccaaaaaggtaaaaagctaagaaaaacaatactgaacaaatattttgcatacgaaagtcgtagtctagcagtgacaaacattatcccagtagagcaagccatcactgccattgtagcaatctgtaagcaaataaataacagctcgggttatctcggagctataggagatagatcaagagtactatatgcgaataatcaaacgataggacaatatctgtacgaaagaattaaagcaaacccacatgacaggatcagaggagaggtattctacaggcaagattacttagatgaatttgatagaatctgggaatgtcaacagaactactatccagcaatactaactaacgatagaaaacaatatatcagaaatcgaataatattttaccaacgcccactcaaaagtaagaaatctgaactagctttttgcgagttcgaaagtcgtgaagtcgaacacaacggaaagaaatacactgaaggcttacatgttgcccccaaaagctcaccagtattccaacattttagactatggcaaagacttgggcaaattgaagtatctccattaagaaaatgggataaacaatcaaatgaactattcgaacaacagaacaatgctgaccgagaaggaatattaaacacagaagcaaaacaaaaactattttcatatttaaacttgctagatcatctgacagataacgaaatccttaacatactaggttactcaccagacaaatggaaaattaatttcagagaaatcatcggaaatagaacaaacaacctaatgatgaaagcattcttttcgatgaaagaaatgacagatggagaacaaatagattgggagaaaaacctcaccaaaatcacaaatggccaaagtttaatatcaccagaacagatcgtcgacttaatcagacaattctttgaaagggaaggaataacaactagcttactatacttcgaccccgctacagacaacttccgcgaacaaagccattactcattatggcacctactatactcttatgaagacgacaactctcccacaggaacaacatctttatgtaaaacattagcaaaacgatacggaataccacacgaactatgccctctcctagccagtcttacattcgaaagacaatatggctctctgagcacaaaagcaatgagaaaactcctgcctttcatgcaagaaaagagatatgatgaagcatgcgaactggctggatatagacactcagcatggatcactaaagaagaaaatgcaaaaagaacattgaaaaacaaactcccattactaagaaaaggctccttaagaaatcctgtcgtagagaaaattctaaaccaaatgacacatgtaatcaatacgcatatagctgaatacggtaatcccgatgaaatacgaatagaaatggcacgagacatgcaggcgaacagcaagcaacgaaaagctatgaccgccgcgatcacggaagccaccaaacgcaatacacaatttattgaagaaatacaaaaagaatttggcttcaacccgagtaaaaacgacttgataaaatataaactgtggaaagagttagctccccttgggaacaaaacattatactccaatatttacataccaaaagaagaactctttacagccaaatttgaaatagaacatatcattccaagagccttattttacgatgactctttttcaaataagactcttgaattaaattcagttaataaacttaaaggtaacaagacggccttagattatttagacacactaggtcaagaaaaagcaaacgattacatactccgagtagaagaattaaagaaaattggtgccataacacaagcaaaatataagaaactactaatacgagaaaaagacctaggggacgacttcacaaacagagacctaaccaatacaaggtacataatcagacatgcagcagacatgttactacaagtaacaccatcaatcgtacataccaatggatccataacagccattttaagaagagattggggattactagatatactaaaagagctaaaccttccaacatacgaaagcatagacagaaaaatatctgacccagaagaaaaactaactcaatccgtggatagaaaagatggacaagccatcaaaatgataaaagattggagtaaaagagatgaccaccggcaccatgcaatggatgcccttattacagcacttacaactaggaaacatgttcaatacctaaacggaaatagcggggccgaagaaacggataaagcgcaaaaactggaacaactaaaggctttaagaaaacaattaatcggaagcgatggtcacttcatcccacccatgcatgatataagggtccaagccaaagaagcattatcaagagtcattatttcaacgaaagttaaaggaaaagtaacgactcccaatacaaatataatatgtagtagggataaaacaactggaagaaaaatatatgtgagacaaacaaccttaacaccgagaggtgctctacatctcgatactaaatacggaataaatcggtactatcaagaaagagaagtttcaataggatcaaaactcacccaagaagagatcagattagtttccagtcctcatattcaatcaatcttacttgaacgcttgagagctttcgataataacccaaaatcagcattcacaggtcgaaactctgtagacaagaaaccactagaagataaaaataaaaagctagtatacactgacaagaaagttaaacaaacaatcctagcaaatagatttgtcaaaagggaccaagtaaattccaaactaaatttagataaagtaatagacaccgggatcaaacggatactagaaggaagattacagcaatatggtggaaaatacgaaacggcattttccgacctagaaaataatccgatatggctaaatgaagaaaaaggcattgcgataaaaagtgtaagaataaggggcaaaaataatgctatccccatccaccaaaccgatacctgccccatagactatgtcgcaaacgataataaccatcacctggcagtatacgtcctaccagatggtaccatagaagacgatatagtaactttcttcgatgccgtagaaagaagccgccagggactaccaatcgtggacaaaaataaaaatcaatcgctaggatggaaattcttattcagcataaaacagaatgaatactttttactccctcaacaagcagagaaaatagatattgatacaggcgaaatcagtacacaaactactttttcaccaaaagacttatcacccgaatacataatgaacccagacaactacgcagaactagcgtcacacattttcagagttcaatcaatatcaaaaacgccacaaggaaatagggatgtaaggatctacctcttcaaacaacaatatatatctggatcacagaaagattcactgcatttaaaaggtataacttacaggcaaatctccagtgctaaagatctagcagagctagtcaaaatacgagttaatcatctaggtagaatcgtaagcgtaggggaaaaatga

SEQ ID NO: 5663 - RNA, 4287 nt, synthetic construct
  misc_feature 1..4287: note = Cas9 variant
  source 1..4287: mol_type = other RNA
atgacgaaaaaaatcttaggcttagaccttggaacaacctcgataggctgggcatacgtaatcgagagcgacaatccagatgagtctgaaattaaacaaataggagttagggtgaacccattgacgaccgatgaacaaaccaactttgaaaaaggcaaaccatttagcattaataaagaacgaactctaaaaagaggagcaagacggaacctcgacagatacaaagacaggagaaacaacctaatagaagtacttaaaaaagcaaatattctcagccaagatagtatactcacagaagaaggacaacacactacacaccaaacttggcaactcagagcaaaagcggcggttgacaaaattgaaaaagaagaacttgctagggttttattagcaattaataaaaaaagaggatataaatcaagcagaaaagcaaaaaatgaggacgaaggccaagccatagacggaatggcagtagccaaaagattatatgatgaacaaataacatgtggccaattagtctaccaactattgcgggaagggaaaaagtcgattccagatttttatagatctgatctacaagcagaattcgacaaagtatggaacttccaaaaacaattttatcccaaaatactaacagacgagttttacaaagaactaaaaggcaagggacaaagagcaacgagtgcccttttttacaaaacatataactttaacacagcagaaaataaaggatcaagagaagaaaaaaaaatacaggcatataagtggcgctcagaagcgatatctcaacagttggaaaaagaggaagttgcttttgtactaactgaaataaataataatttaaacaactctagtggatacttaggagcaatttccgacagaagtaaagaactctattttaataaacaaacagtaggtcaatatttataccaacaattacaggaaaacagacacgctcgcttaaaaaatcaagtattctatagacaagactacttagacgaattcgaagcaatttggaaagaacaggcaaaacaccacacagagttaaccgaggagttaaaggcagaaatccgtgacattatcatattctatcaaaggaaacttaagtcccaaaaaggcctaatatcattttgcgaatttgaaagccgtgaaatccaaatagatggcaaaaaaaaaacaattggattacgagttgcacccaagtcaagtccattatttcaagaatttaaaatatggcagaatctaaacaatgtcttagtcagaaaaaaagggtctagaaaacgcaacgtaaaacaagagatacaaggatcattattcgaagaagaaaaggaaatattcgttttcgatttagaaactaaagaaaaactttttgaagaattaaatcttaaaggaaatctgagcgctaacaaagtgatcgagcttctgggacataaacctacagaatgggaaatcaattattccgcattagaaggaaatcgtactaatcaagctctatacaatgcgtaccttaaaatactagacatagaaggatatgatgaagatctgctcaaactatcagataaagatgatataaacgttgcagatctgaaaacgccagcatcagaaattaaaaacatggtacgagacatatttcaagttctaggaatatcaaccgatatcctagaattcgatgcagaactagacggcaaggatttcgaacaacaagcaagttaccaattatggcaccttctctattcatatgaaggagatgattctcaatcaggaaacgaaaaactgtacgagttactagaaaaaaaatttggattcaaaaaagaacacagccaagtacttgcgaacgtcacattaagcgatgactatggcaatctctcaagtaaagcaatgcgaaaaatatacccatttataaaggaaaataactactcaacagcatgtgaactagcaggttatcgacattctaaacattccctaacaaaagaagaaatagaaaatagacctttagatgataaactagaactcttaaaaaagaatagtctcagacaaccagtagtggaaaaaattctaaatcaaatggtaaacgtggtaaattcactactagagaaaaataggaaagagaatccagattttcgtttcgatgaaatcagaatagaactagcaagagaattaaaaaaaaatgcaaaagaacgagccgagatgacaacaaacatcaactccgccaaaacagagaacgaaaaaatcttcaagcttcttcaagctgaatttggactaaaaaatccaaccagaaacgatattatcaggtatcgcttatatgaagaactaaaaaataatggttataaagatttgtacacaaacaaatatatacccagagaaatattgttcagtaaacaggttgacatagaacatattatcccacaatctagacttttcgacgactcgttctcaaataaaaccatagtataccgggaaacaaacctagataaaggtaatcaaaccgcgtttgattatatagactcaaaatacggaaacgaaaaagtcgaagaatacatactccgaattgaggctctacatgatgcatggaaaaaaaacaaagaagaaggaatctcaaaagcaaaatatcaaaaactacttaaaaaagaaacagaaattggagacggattcatcgaaagagacctaagagaatctcaatacatagccaaaaaggcaaaggaaatgctgtttaaaataacaaggtcagtagtatcaacaagtggatccataacagataaattaagagaagactgggggttaataaatataatgaaagaactaaacctaccaaaatatagaagcttgggattaactgaaatgcaagaacgaaaatttggacaaaaagttgaagtaataaacgactggacaaaaagaaacgatcatcgacaccacgctatggacgcattaacagtagcatttactaaacataatcatatccaatatctaaattatttaaacgcaagaaaaaacgagaaccacaagttacataataatattatcgcaattgaaaatttagaaacagaaacaatgatagacaataatggtagcaaaagaagggtttttaaagcgccaatgccaaatttccgtcaagtggcaaaggagcacttagaaaacgtactaatcagtcataaagccaaaaataaagtggtaacgaaaaacaaaaacaaaatcgccggcaaagtcgcagctcaagaaactctcacaccgagaggacaactccacaaagagacagtatacggcaaatatcaatactacgtcaataaagaagaaaaaattggcacgaagttcgacgaagaaactataaacaaagtttcaaatcctcaatacagaaaattactgctggaaagactatcagcaaacggcaacgatcccaaaaaagcattcagtggtaaaaacgcactctcaaaaaatcctatatacttaaacgaaacaaaaaccgaaacagtacccgaagttgtaaaattaacttggttagaagaagactactcaatcagaaaagacataacaccagacaatttcaaagatgaaaagagtatagataaaatactagatgagggagtaaaaagaatcctaaaaaaaagattaagaaagaacgacaacgatcccaaaaaagcatttagtgatctcgacaagaatccgatatggctcaatgaggaaaaagggataagtataaaacgagtaaccattagcggagtcaacaatgcagaaccgcttcattataaaaaagaccacttcggaaatgatattctagacgaaaaaggcgacaaaatacctgttgactttgtgagcaccggaaacaaccatcacgttgcagtgtaccgagacgaaaagggaaacttacaagaaaatatcgtatccttcttcgaagcagtgatacgagtcaatcaaggactccccataatagacaaggcatataatcaacatttaggatggcagttcttatttacaatgaaacagaacgaaatgtttgtgttccctaatgaaaagagcggatttaatccacaagaaatcgatttactggacccaagcaacaaaaaaaaaataagtccaaacctattcagagtccaaaagatgtcgaaagttatttatggtaattcacctgtccgcgaatatgtctttagacaccacctagaaaccaacgtagatgaaaaaaaggaattaaaagatataacttttaagaacatcaaatcactcggatactttgaagatatagtgaaagtcagaattaatcatcttggtgatatcgtcagcgttggtgaatattga

SEQ ID NO: 5664 - RNA, 4293 nt, synthetic construct
  misc_feature 1..4293: note = Cas9 variant
  source 1..4293: mol_type = other RNA
atgaaacatatactaggattagaccttggcacaaactccatagggtgggcagtcgtaaaagaggctcaaaatgataacgaacaatctgaaatcgtggatgtaggagtccgagtcaacccactaacgacagacgaaaaaactaacttcgagaaaggaaaaccaataagtaccaacgctgaccgaactctcaaaagatcggccaggagaaatttacaaagatataaactgagacgcaaagagctaatcgaacttctgaaagaacatcaattaatttccacagacaccatactcacagaaaatggtaaaggaaccacattccaaacactggagctgagagccaaaagtgcgaaagaaaagatctccctcgaagaattagcacgagtattcttaacgataaataagaaaagaggctacaaaagttctagaaaagccaaaaatgaagacgaaggtcaactaatagacggaatggaaatagcaaaaagactatacgaagaaaatttaacaacaggacaactctcacttcaactcctaaaagaaggcaaaaaatcactccctgactactataggtcagacttgcaatttgaactagataaagtatggaactttcaaaaacaattccacagcgatatacttactgacgaattttatgcccagctcaaaggaaaggggcaacgcgcaaccagcgcactattccttgcgaaatatcaaatttacacagcagaaaacaaaggatcacgtgaagacaagaagctacaagcctaccaatggcgcgtggacgcattatctaaagaattaacacgcgagcagctagcgtttgtaataacagaaatcaacaataatctaaataattcaagcgggtacctcggtgctatctcggacagatccaaagaactatacttcaacaatgagacagttggagaatatctatggaaacaaatagcagctaatcctcatacatcactaaaaaatcaagtattttacagacaagattatttagacgagtttgaacaaatttggaaaacacaaagcgcattttacccagaaatactaacagacgaattaaaaaaagaactaagagatgtagtaatcttctatcaaagaaaattaaagagtcaaaaatccctagtctctttctgtgaatttgaaaataaagagatcgaaattaaaaaagaggacggcacttcaacaaaaaaagtaataggactaaaagtagcaccaaaatcgtccccattattccaagaatttaaaatatggcagaatttgaacaatgtgttaatacgaaaaaaaggaagcaaaacaaaaaaagtagcaaagaaccagcaagccgtcctcttcgaagaagaaaaaacaatatcagagctagacttagaagccaagcaggcactttttaatgaattaaatctgaagggcaatctaaaagccgattattgtttggaaattctaggatattcaccaaaagaatgggaaatgaactatagcgttttagaaggaaatagaactaataaagctctgtacgaagcatacctaaaaattacagatttagagggttatgatgccaaaaaccacctaaaagtaaaactcaataaagacgaagtagaactcgatgacttaaaagtaccagcatccgaaataaaagacatggtgcaagcaatattcaaagaggcgggaatcaatacagatatactacacttcaatgcggaactagacggaaaagatttcgaaaatcaggcatcttatcaactgtggcacttactctattcatatgaaggtgacgattcaaaatcaggaaacgaactactatacaaactattagaaactaaatttggattcaaaaaagaatacgcccaaatacttgcaaatgtttctctgagtgatgattatggaagcctatcaacaaaagcaatgagaaaaatacacccgtacataaaagaaaacaaatttagcacagcatgcgaactagctggctatcgacacagtaaacacagtctaactaaagaagaaaatgacaatcgagtattaaaagattcattagaagtactaaaaaaaaactcactaagacaacccgtagttgaaaaaatactaaaccaaatgataaacctggtaaatgctctcttaaaaaaatatagaacagagaatcctaactttaaattcgacgagatacgtatagaattagcaagagagctaaaaaaaaatgcagaagaacgagctaacatgacggccaatataaataaagcaaaaacagagcatgaaaaaataatcaaaatcctaaaaaacgaatttggattgccaaacccaactagaaatgatatcattcggtatcgattatatgaagaactcaaagcaaatggatataaagacctctatacaaacataaaaataccacaagaaaaattattcaccaaagaaatcgacatagagcacataataccaaaatccagagtgtttgatgatagcttttcaaataaaaccttatcattcagaaaaacaaacctcgataagggagaaagaactgcgtttgactacatggaatctaaattcggcgctgacaaattagaagaatacgtcgcacgggtcgaggatctatacaaaaacaatataatatcaaaagcaaaataccaaaaactattaaaaaaagaatcagaaattggcgacggctttgtcgaacgagatctgagagaaactcaatatatagccaaaaaagcaaaagaaattttgttacaaatcacaccaaatgtactatctacatcaggtggaataacagacagattaagggaagattgggatttaatcaacgtcatgaaagaactcaatctacccaaatatagagccttaggactcacacagatggaagacagaaagtacggacaacaggtcgaagtaataacagattggacaaaaagaaacgaccatagacaccatgcaatggacgcattaacagtagcattcaccaaacacaatcacatacaatacttgaactacctgaatgcgcgtaaaaacgaaaaacacaaggagcatagcaacataatgggcatccaacaactagaaacaattaaagtaactgataaaaacggaaacgaaaaaagagtcttcaaagctccaatgccaaattttcgtcaagtcacaaaagccttcctcgaaaacattctaatatcacataaagccaaaaacaaagtagtaacaaagaacaaaaacaaggtcgccggttcaaataaagtacaagaagtattaacaccaagaggtcaacttcataaagaaacagtatatggaaaataccaatattacgtacaaaaagaagaaaaaataggtgccaaatttgaccttgaaacaatcaagaaggtagctaacccactatatcagtcactattaaaaaaacgcttagaagaaaacggaggtgatccaaaaaaggcgtttacaggaaaaaactcactagcaaaaaatccaatttacctggatgacacacaaaccgaacaacttcctgaaaaagttaaactagtctggctagaaaatagctttagcataaggaaagatataacacccgaaaacttcaaagatgaaaagctcattgataagatccttgacgaaggtgtaaaacgaatcctaaaagaaagactacaatcattcggtaacgatgccaagaaagcgttctcagatctagacaaaaaccccatatggctcaacaaagaaaagggtataacaatcaaaagagtaacaatcagcggggtagccaatgcagaacctctacatacaaaaaaagatcatttaggtaaagaaatcttagataaagaagggaaaccaattccggtagattttatatcaaccggttcaaatcatcacgtagcagtataccgtgacgaaaagggtaatctacaggaaaaagtggtctctgtgttcgaagcagtcgtgagggcaaatcaaggattaccaataatagacaaaacttataatcagcatctcggttgggaattcctcttcacaatgaagcaaaacgaaatgttcgtgtttccaaacgaaagtacggggttcaatcctaatgatatagacctgctagacccaaaaaataagagaataatatcacccaatttattccgagtacaaaaattttcaaaattgcaatacggtaacagtttcgtccgcgaattcgtattccgacatcacttagaaacaaccgtagaagatagaaaggaactgcaaggcataacctataaacaaatgaaaaatagtaccttcttcaatgacatcataaaagtccgaatcaaccacctgggcgatatagtctcgataggagaatattga

SEQ ID NO: 5665 - RNA, 4293 nt, synthetic construct
  misc_feature 1..4293: note = Cas9 variant
  source 1..4293: mol_type = other RNA
atgaaacacattttaggattagacctaggaacaaattcgatcggatgggcagtagtaaaagaggcgcaaaatgataacgaacaaagtgaaatagtcgatgtaggggtccgagtgaatcccctaaccacggatgaaaaaacgaattttgaaaagggaaaacctatatcgacaaacgctgaccgaacactaaaaaggtctgcaagaagaaacctacaaagatataaacttaggagaaaagaactaatagaattactaaaagaacaccaattaatatcaactgatacaattcttaccgaaaatggcaaagggactacatttcaaaccttagaactacgcgctaaatcagcaaaagaaaagatcagcttagaagaattagcacgagttttcctgacgatcaacaaaaaaagggggtacaaaagttcaagaaaagctaaaaatgaagacgaaggacaactaattgacggtatggaaatagccaaaaggctttatgaagaaaatcttacaacaggacaacttagcctacagctattaaaagaaggaaaaaaatcacttccggattactacagatctgatcttcaatttgagcttgacaaggtatggaactttcaaaagcaattccatagccacattttaactgacgaattctacgcccaattaaaaggcaaaggtcaaagagctacatcagccttattcttagcaaaatatcaaatttatacagcggaaaataaaggctccagggaagacaaaaagcttcaagcatatcaatggagagtagatgcattatctaaagaattaacaagagaacaactagcgtttgttatcaccgaaataaacaataacctaaacaacagcagtgggtacctgggcgcgatttcagacagatccaaagaactatattttaataatgaaacagtaggagaatacctatggaaacaaattgcagctaatccacacacaagcttaaaaaatcaagtattttacagacaagattaccttgatgaattcgaacaaatatggaaaactcaatcagccttctaccccgaaatcttgaccgacgaacttaaaaaagaattacgagatgtagttattttctaccaaagaaaactcaaaagccaaaaaagtttagtatccttttgtgaatttgagaataaagaaatcgaaatcaaaaaagaagacggaacatctacaaaaaaagtaataggcttaaaggtagcaccaaaaagctcccccttattccaagaatttaaaatatggcaaaatctaaataatgtgctaattagaaaaaaaggctctaaaacaaaaaaagtcgataaaaaccaacaagctgtactatttgaagaagaaaaaacaatattcgaattagatctagaagctaaacaggccctattcaatgaattaaacttaaagggcaatttaaaagcatactactgcctagaaattctaggatactcaccaaaagaatgggaaatgaactacagtgtacttgagggtaaccgcacgaacaaagcactatacgaagcatatctaaagataacagacttagagggatatgatgcaaagaatcatttgaaagtaaaacttaataaagatgaagtagaactagatgacctaaaggtaccagcgagtgaaataaaagacatggtccaggccattttcaaagaggcgggcatcaacactgacatattacatttcaacgcagaattagacgggaaagactttgaaaatcaagccagttatcaactgtggcacctcttatactcatacgaaggagacgactccaaaagtggcaacgaactgctatacaagcttttagaaactaagtttggatttaaaaaagaatatgcacaaatattagcaaatgttagcttatcagacgattatggaagtctgagtacaaaagcgatgagaaagatacatccctatataaaagaaaataaattctcaacagcctgcgagctagccggatacagacacagtaaacactcattaacaaaggaagaaaatgacaacagagtcctgaaagactcgcttgaagtattaaaaaaaaatagtcttcgacaacccgtagtagaaaaaatcctcaaccaaatgataaacttagttaatgcattattaaaaaaatataggacagaaaatccaaactttaaatttgacgaaataagaatagaactagcaagggaattaaaaaaaaatgcagaagaacgagcaaacatgactgtaaacataaataaagccaaaactgaacatgaaaaaattataaaaatcttaaaaaatgaattcgggttacctaaccctactcgtaacgacatcattagataccgattatacgaagaacttaaagcaaacggatataaagacttatacaccaacgaatacatagaaaagcaagatctatttacaaaaaacattgatatagaacacataatccccaaaagccgagtgttcgatgacagtttctccaataaaacattatctttcagaaaaactaatctcgacaaaggagagcgtacagcttttgactacatcgaaagcaaatttggcgcagataaacttgaagaatatgtagcaagagtggaagacctatacaaaaacaacatcatatccaaagcaaaatatcaaaaattattaaaaaaagaatcagaaataggggatggatttgtcgaacgcgatttaagagaaacccaatacattgctaaaaaagccaaagaaattttactccaaataaccccaaacgtactaagtacatcaggtggcataacagatcgtctaagggaggattgggacttaataaatgtaatgaaagaacttaacttaccaaaatatcgagcactaggactgacacaaatggaagacagaaaatatggacaacaagtagaagtaattatcgattggacaaaacgaaacgatcatcgacatcacgcgatggacgccctaacagttgcatttacaaagcataatcatatacaatacctcaactatctcaatgcaagaaaaaatgaaaaacaccgggaacactcaaacataatgggaatccaacaacttgaaactataaaggtcacagacaaaaacggaaacgaaaaaagggtattcaaagctcccatgccgaactttagacaagtgacgaaagcatttctagaaaacgttctaatctcccataaagccaaaaacaaggtagtaaccaaaaataaaaataaagtagctggatctaataaagtccaagaagtactaacgccaaggggccaattacataaagaaaccgtatatggaaagtatcaatactacgttcaaaaggaagaaaagatcggtggcaaattcgatcttgaaaccatcaagaaagttgcaaaccccctatatcagagcttactaaaaaaaagattagaagaaaatggaggagaccctaaaaaagcattcactggaaaaaatagcctagcaaaaaatccaatatacttagatgatgcacaaacagaacaactaccagagaaagtaaaactcgtatggctcgaaaattcattctccatcagaaaagacattacgccagaaaactttaaagacgaaaagttaatagacaaaatactagatgaaggcgtaaaacgtatacttaaagagagattacaaagtttcgggaatgacgctaagaaggcattcagtgatctcgacaaaaaccccatatggttaaacaaagaaaaaggaatagcaataaaaagagtagccattagtggagtagctaacgctgaaccattacatacaaaaaaggaccatttgggaaaagagatattagataaagaaggaaaatccataccggtcgattttattagcacgggaaacaaccatcatgtagcagtatatagagatgaaaaaggaaacctgcaagaaaaggtggtttcagtttttgaagccgtcgttagggcgaatcaaggactcccaattatagacaaaacctacaatcaacacttgggctgggaattcttatttacaatgaaacaaaacgaaatgtttgttttctcaaatgaatcaacaggcttcaatcccaacgatatcgacttactagacccgaaaaataaaaaaataataagtccaaacttattcagagtccaaaaatttagcaaattacaatatggcaattcatttgtacgtgaatttgtatttagacaccatctagaaacgacagtggaagatcgaaaagaactccaaggaataacttacaaacaaatgaaaaactccgcattcttcaacgacatcataaaagtccgaattaaccatctcggaggcattgtaagcgtgggagaatactga

SEQ ID NO: 5666 - RNA, 4293 nt, synthetic construct
  misc_feature 1..4293: note = Cas9 variant
  source 1..4293: mol_type = other RNA
atgaaggatattctaggacttgatctaggtaccaattcgataggttgggccgtcgtaaaggaagcacaaaatgataatgagacatcagaaatagttgatttaggcgtacgagtaaatccacttaccacagatgaaaaaacaaacttcgagaagggaaaacctatcagtacaaacgcagacagaactttaaaaagaagcgcaaggagaaacttacaacgatataaactccgaagaaaagaacttatcgaactgttaaaagaacaccaattaatctcaactgatacaatactaacggaaaatggaaaaggaacaagttttcagacactcgaactacgtgctaaatcagcaaaagagaaaatctcactggaagaactagctagagttttccttacaattaacaaaaaaaggggatacaaatcgagtcgaaaggcaaaaaatgaagacgaaggccaattgatagatggaatggaaatagcaaaacgcctatacgaagaaaatttaacaacgggacaattgtcattacaactactaaaagaaggaaaaaagtcactcccagattattaccggtcagacctacaatttgagctcgataaagtatggaacttccagaaacaatttcattcacatattttaacagatgaattttatgctcaattaaaaggtaagggtcaacgcgcaacatccgctttatttttagcaaaatatcaaatatataccgcagaaaataaagggagtagggaagacaaaaaattacaagcttatcaatggcgtgtagacgcacttagtaaggaactaacaagagaacaactagcattcgtaataaccgaaattaataacaacctaaataattcaagcggatatttaggggcaatcagcgatcgatcaaaagaactgtatttcaacaacgaaacagttggagaatacctgtggaaacaaattgcagcaaacccgcatacgagtttaaaaaatcaagtattttataggcaagactatctcgatgaattcgaacaaatatggaacacacaagcacaattttatccacaaatactaacagacgaactcaaaaaagagttgcgcgatgtcgtgatattctaccaaagaaaactaaaatcacagaaatcactagtatccttctgtgaattcgaaaataaagaaatagaaatcaaaaaagaggatggaacatcaacaaaaaaagtgataggcctgaaagtagctcccaaaagttcacccttgttccaagaattcaaaatttggcaaaatctaaataacgtactaatacgcaaaaagggtagtaaaaccaaaaaagcagcaaaaaaccaacaagctgtattatttgaagaggaaaagaccatatcagaactagacctcgaagccaaacaagctctattcaatgagctcaatttaaagggaaacctaaaagcagactactgcttagagatactcggatacagtccaaaagaatgggaaatgaactactcagtattagaaggaaatcgaacaaataaagccttatacgaagcatatttaaaaataaccgatcttgaaggatatgatgctaagaatcacctaaaagtaaaactcaacaaagacgaagtagaactggatgatctgaaagttcctgcctctgaaataaaagatatggtgcaagcaatatttaaagaggcaggaataaacactgatatcttacattttaatgctgaattagatggaaaagacttcgaaaaccaagcaagctaccaactatggcacttactatattcatacgagggagacgactccaagtcaggcaatgagttgctttacaaattactagaaacaaaattcggttttaaaaaagaatatgcacagatcctagcaaacgtgtcattatccgatgattacggtagcttatctactaaagcaatgagaaaaatccacccttacattaaagaaaataaattctcgaccgcatgcgaactcgcaggatatcgtcatagcaaacattccttaacaaaagaagaaaatgataatagagtgcttaaggattcactagaggtattaaagaaaaactcactaagacaaccagtagtagaaaaaatcctgaatcaaatgataaatcttgtaaatgccttactaaaaaagtacagaacagaaaatcctaatttcaagtttgatgagataaggattgaattggccagagaattaaaaaaaaacgcagaagaaagagcaaacatgacggcaaacattaacaaagcaaaaacagaacacgaaaaaataattaaaatattaaaaaatgaatttggactgccaaatccgacaagaaatgatataatacgttatcgactatatgaggagctaaaagcaaacggttacaaagacttatacaccaacattaaaataccgcaagaaaaactattcacgaaggaaatagacattgaacatataattccaaaatcgagagtatttgacgattccttttccaacaagacactaagctttagaaaaacaaatctagacaaaggagaaagaaccgcatttgactacatggaaagtaaatttggagccgacaaactagaagaatatgtggcgagagtcgaagacctatacaaaaataatataatctctaaagcaaaataccaaaagctgctcaaaaaagaaagcgagatcggagatggcttcgtcgaacgagacctaagagaaactcaatatatcgcaaaaaaggccaaagaaatattattacaaataaccccgaacgtattatccacatcgggaggaataacagacagactaagagaagattgggacctaataaacgtcatgaaagaattgaacttaccaaaatatagggcacttggactaacagaaatggaagaccgaaagtacggccaacaggtcgaagtaataatagattggacaaaaagaaacgatcatagacatcacgcgatggatgccctaaccgttgcattcaccaaacacaaccatatacaatacctgaattacttaaacgcaagaaaaaatgaaaaacacaaagaacacagcaatatcatgggtatacaacaactagaaacaatcaaagttaccgacaaaaatggtaatgaaaaacgagtattcaaagctccaatgccaaattttagacaagtaactaaagctttcctagaaaacatactcatctcccacaaagcaaaaaacaaagtggtaacaaaaaacaagaataaggtagctggatcgaataaagtacaagaagttctaacaccaagaggacaattacataaagaaacagtatacggaaaatatcagtactacgtacaaaaagaagagaaaataggtggcaaattcgacctagagacaatcaaaaaagttgcgaacccactttaccagtcactactaaaaaaaagactagaagaaaatggcggagatcctaaaaaagcttttacaggaaaatactcactagctaaaaatccgatatacctggacgatgcacaaaccgaacaactccccgaaaaagtcaaactggtatggttagaaaattcattctcaatcagaaaagacataacacccgagaatttcaaagatgaaaaattaatagataaaatactggatgagggagtaaaaagaatactaaaagagagactacaaagcttcggaaacgatgcaaaaaaagcattctcggatttagacaagaaccctatatggttaaataaagagaagggaataacaatcaaacgcgtaactatatcaggagtagccaacgctgaacccttacatacaaaaaaagatcacttaggaaaagagatattagataaagaaggtaaaccaataccagtagattttatttctaccggatcaaaccatcatgtagccgtatatcgcgacgaaaaaggcaatctccaagaaaaagtagtatcagttttcgaagcagtcgtacgcgctaatcaaggattaccgataatagacaagacatataaccaacatctaggatgggagttcttattcacaatgaagcaaaacgaaatgtttgtattccccaatgaaagcaccggatttaatccaaatgatatcgacttactagacccaaaaaataaaagaataataagcccaaacttgtttagagtccaaacgatatctgtagtcaaatacggaaatgccatagtccgagactttaaattccgacatcatctagaaacaacagtagaagacaaaaaagaactacaaggtaaaacataccaacaaataaaatctctatcaccactcaacgatataataaaagtgcgcattaaccacttaggagacatcgtttcggtaggagaatactga

SEQ ID NO: 5667 - RNA, 4293 nt, synthetic construct
  misc_feature 1..4293: note = Cas9 variant
  source 1..4293: mol_type = other RNA
atgaaacacatattgggacttgatcttggtacaaatagtattggatgggcatacgtaaaagaagcggaaaatgacacggaaacatcggaaatcgtagacttaggcgtgcgagtcaatccactaacaacggatgagaaaacaaacttcgaaaaaggaaaacctatttctaccaacgcagatagaacactaaaaagatctgcaagaagaaacctacaaagatataaacttagaagaaaagaattaattgaattactaaaagaacaccaactaatttccgaaaacacaattctcacagaaaacggtaaaggtacaacattccaaactctggaattaagagcgaaaagtgcaaaagagaaaatcagtttaggcgaactggcaagggtgtttttaacaattaataagaaacgcggttataaaagttcaagaaaagccaaaaacgaagatgaaggacaattgattgacggtatggaaatagcaaaaagactatacgaagaaaacttaacaactggacaactatcactacaactgctcaaagaaggcaagaaatcgttacctgattattatagatcagatctgcaatttgaactagataaagtttggaactttcaaaaacaattccattcagacatactgaccgatgagttctacgcacaattaaaagggaaagggcaaagagccacttccgcgctattcctggcaaaataccaaatatacacagccgaaaataaaggcagcagagaagataagaaactacaagcatatcagtggagagtagacgcactatcaaaagaactaactagagaacagctagcctttgttataacagaaataaacaataacctcaataactcgtcaggatacttaggtgcaatatcagaccgctccaaagaattgtatttcaataatgaaactgtaggagaatatctatggaaacaaattgcggcaaacccacacacatcgctgaaaaaccaagtattctacagacaagactatttagacgaatttgaacaaatatggaacacacaagcacaattctacccacagatcctaacagatgaactcaagaaagaacttcgagatgtagtaattttctaccaaagaaaattaaaaagtcagaaaagtctagtcagcttttgcgagttcgaaaataaagaaatagaaataaagaaagaagacggaacctcgacaaagaaagtcattggattaaaagtagcaccaaaatcatcacccttgttccaagagtttaaaatatggcaaaatctcaacaatgtattaatcaggaagaaaggctcaaaaaccaagaaagccgccaaaaaccagcaagcagtattatttgaagaagagaaaactatatccgaattggacttagaagcaaaacaagcactattcaacgaactaaacctaaaaggcaatctgaaagcagactactgtctagaaatactaggatacagccctaaagaatgggaaatgaactactcggtgttggagggaaacagaaccaataaagctctatacgaagcctatctaaaaataacagacctagaagggtatgacgctaaaaaccacttaaaagtaaaactaaacaaagatgaggtcgaattagatgatctaaaagtacctgcatcagaaataaaagagatggtacaagcaatatttaaagaagcggggatcaataccgacatattacacttcaacgcagaattagatggaaaagattttgaaaatcaggcatcatatcaactgtggcatctactatattcatacgaaggcgatgacagcaaaagtggaaacgaattgttatataaattgttagaaaccaaattcggttttaagaaagaatatgcacaaattctagcaaacgtttcattaagtgacgactacggaaacctaagcacgaaagctatgcgaaaaatatatccatatatcaaagaaaataaattctccacagcatgcgaactagcaggctatagacatagtaaacatagtctaacaaaagaagaaaacgacaacagagtactcaaagattctttggaagtacttaaaaagaactctctaagacaacccgtagtcgagaaaatactaaaccaaatgatcaaccttgtaaacgcacttctaaagaaatacagaacagaaaaccctaattttaagtttgacgagatacggatcgaactagcgcgagagcttaagaaaaacgcagaggaacgcgcaaacatgacagccaatataaacaaggctaaaacagaacacgagaaaatcatcaaaattctaaagaatgagttcggtctacctaatcccacccgcaacgacataatccgatatagactatatgaagaacttaaagcaaatggatacaaagacttatacacaaatataaagattccccaagaaaaattattcaccaaagaaatagatatagaacacattatcccgaaatcacgagtattcgatgattcatttagtaacaaaacactctcattccgaaaaacaaatctagacaaaggcgaaaggacagcatttgactatatggaaagtaaattcggtgcagataaactagaagaatacgtagctcgagtcgaagacctctacaaaaacaacattatctctaaagccaaataccaaaaactattaaagaaagaaagtgaaatcggtgatggattcgtagaacgagaccttagagaaacacaatacatagccaagaaagctaaagaaatactacttcaaataacaagaaacgtactttccacaagtggaggcataacagatcggttgagagaagactgggacctggtaaacgtaatgaaggaacttaatttaccgaaatacagagcacttggattaacagaaatggaagaccgaaaatacggacaacaagttgaagtcataatcgattggacaaaacgaaacgatcaccgacaccatgctatggacgcattgacagtagcctttacgaaacacaatcacattcaatatctaaattacctaaatgctagaaagaacgaaaaacacagagaacacagcaacataatgggaatacaacaactcgaaaccataaaagtaacagacaaaaacggcaatgaaaaacgagtttttaaagcaccaatgcccaacttccgccaagttacaaaagcctttctagaaaacgtattaatttcacataaagctaaaaacaaagtagtaacgaaaaataaaaataaagtagccggatctaataaagtacaagaagtactaacgcctagaggacaattacataaagaaacggtctatgggaaataccaatactatgtgcaaaaagaggagaaaatagggggcaaattcgatttagagaccataaagaaagtagccaatccactataccaatccctactaaagaaaagactagaagaaaatggtggtgacccgaaaaaggctttcacagggaaaaatagcttagctaaaaacccaatctatttagacgatgcgcaaacagaacaactaccagaaaaagtaaaattagtctggctcgaaaattcattttcaataagaaaagacataacccccgaaaatttcaaagatgaaaaattgatagacaaaatcttagatgaaggcgtgaaaagaatattgaaagaaagactacaatcattcgggaacgacgcgaaaaaggctttcagcgacctggacaaaaacccaatatggctgaacaaagaaaaaggtataactatcaaaagagtaacaatttctggagttgcaaacgctgaaccactacacactaagaaagaccatctaggaaaagaaatactcgataaagaaggcaaaccaataccggttgactttataagcacaggttcaaatcaccatgtagcagtctatagagatgaaaaaggaaacctccaagagaaagtagtgtccgttttcgaagcagtagtcagagccaatcaaggtttaccaatcatagacaaaacatacaatgaacacttaggatgggagttcttattcacaatgaaacaaaacgaaatgtttgtatttccgaacgaaagcacaggcttcaatcccaacgacattgacctcttagatcctaaaaataaaagaataatcagcccaaacctgttcagagtacaaaccatttcagttgttaaatacggaaacgcgatagttagagacttcaaattccgacatcatctagaaactacagtagaagacaagaaagagttacaaggaaaaacatatcagcaaataaaaagtttatcacctctaaacgacataataaaagtgagaataaaccatctgggagacatagtatcggtaggagaatactga

SEQ ID NO: 5668 - RNA, 4293 nt, synthetic construct
  misc_feature 1..4293: note = Cas9 variant
  source 1..4293: mol_type = other RNA
atggcgcaaaaatacatacttgggctagacctcgggacaaacagtatagggtgggccgtagtaaaggaagccgaaaacgacaacgaacaaagtgaaatcgtagatgtaggagtaagggtaaacccactaacaactgacgaaaaaaccaattttgaaaaaggaaaaccgattagcacaaacgcggatagaacattaaaacgaggagcacgaaggaacttacaaaggtacaaactaagaagaaaagaactaattaaaatattaaaagaacaccagttaatctctgacgatacgatccttgctgaaaatggcaaaggcactacctatcaaacactaaaactacgagcaaaaagctctaaagaaaaaataagcttagaagaattagcacgtgttttcctaacaataaataaaaaaagaggctataagtcatctagaaaaacaaaaaacgaagacgaaggtcaactaatcgatggaatggaaatagcaaaaagactatacgaagaaaatctaacaactggacagctatcacttcaactacttaaggaaggaaagaagagtttgccggactactacagatctgatttagaactggaactagacaaggtatggaactttcagaaacaattccacagtgacatactaactgatgaattttacacacaactaaaagggaaaggacaaagagctacaagcgcactatttcttgaaaagtaccaaatttatacggttgaaaataaaggaaatcgtgaggaaaaaaatttacaagcttaccaatggagagtagacgcattaagcaaagaactaactagagaggaactagcttttgttataactgaaatcaataataacctcaataattcgtcaggttatcttggcgcaataagtgataggtcaaaagaactatattttaataacgaaacagtcggggaatatttatggaaacaaatagcagcgaatccccacacaagtctaaaaaatcaagtattttaccgccaagactatctggacgaatttgaaagaatttggaacacacaagcgcaattttacccacaaatcttaacggaaagtctcaaaaaagaactaagggatgttgttatattttaccagagaaaactaaagagccaaaagtccctcgtatccttctgtgaatttgaaaacaaagaaatagagatcaagaatgaagacggaacaactactaaaaaagtcataggacttaaagtagcaccaaaaagttcacccctatttcaagaattcaaaatatggcaaaatttaaacaatgttcttatacgaaaaaaaggcagcaagacagaaaaagtggcaaagaaccaacaagtagtactattcgaagaagaaaaaactataagcgagctggacttagaagcaaaacaagctttgttcaatgagctcaatttaaaaggtaatctaaaagctgactactgcctggaaatactgggatattcgagcaaggaatgggaaatgaattactcagttctagaaggtaacagaacaaacaaggcactatatgaagcgtacttaaaaatcacggatctagagggatacgacgcaaaaaactacttaaaggtaaaaagtaacaaagacgaagttgaactcgatgacctaaaagttccagcaagtgaaataaaagaaatggtgcaggctattttcaaagaagcaggcatcaacactgacatattacactttgatgcggagttggacggaaaagactttgaaaaccaaggtagttacaaactctggcatttactttattcatacgaaggtgacgatagtaaaagcggcaacgagctgctatacaaactcttagaaacgaaatttggactcaaaaaagaatacgctcaaatattagcaaacatctccttaagtgacgattacggaaaccttagtacgaaagcaatgcgaaaaatacatccatatataaaagaaaacaaattttcaaccgcatgcgaattagcgggttaccggcatagcaaacactccttaaccaaagaagaaaacgagaaaagagtgttaaaagacggattagaagtactaaaaaaaaacagtcttagacaacccgttgtcgaaaaaatactaaaccaaatgattaatttagtaaatgctctgttaaaaaaataccgaacagaaaatcccaactttaaattcgacgaaatacgaatagaattagcgagagaattaaaaaaaaatgctgaagaaagagctaacatgaccgctaacataaacaaggctaagacggagcatgaaaagatcgataaaatactcaaatcagaattcggattgccaaacccaacaagaaatgatatcatcaggtaccgcctttacgaagaactaaaagctaacggatacaaagacctatacacgaaccgatatatatcatctgagaaattattttctaaagaaattgatatagaacacatcatcccaaaatcaagagtgttcgatgacagtttcagcaacaaaacaatagtatataggacagataacttagacaagggcgaacaaacagcatacgattatatagaatcaaagtttggtgccgagaaactaaaagaatacatgacacgcgttaaagatctatatcaaaaaaaaataataagcaaagctaagtatcaaaaactactaaagaaagaaagtgaaattggagacggcttcgtagaacgagaccttagagaaacgcaatacatagcaaaaaaagcaaaagaaattctactacaaataacacataatgtactaagcacttcaggaggcatcacagaccgcctaagaaaagactggggtttagtaaacgttatgaaagaattgaacttaccaaaatatagagccttaggactaacaaaaatggaagaccgaaagtacggacaacaagtagaagtcattacagactggacaaaacggaacgatctacggcatcatgccatggatgctcttactgtagcattcacaaaacacaaccacatacaatacctaaattatctaaacgccagaaaaaatgaaaaacacaaggagcataacaacatcatggcaattcaacaactagaaactataaaagtcacggacgaaaacggaaatgaaaaaagaatcttcaaagcaccaatgccaaattttagacaagtagcaaaaactttcctggaaaatgtactgatctcacacaaggcaaagaacaaggtagttaccaaaaacaaaaataaaatctcaggatccaataaggttcaggaagtgttaacccctagaggacaactacacaaggaaacggtttatggcaaataccaatattatgttcaaaaagaggaaaaaataggagctaaattcgactctgaaaccatagaaaaagtagcaaatccactataccagtcacttttaaagaaaagattagaagaaaacggaggagatccaaaaaaggccttcacagggaaaaactcactcgcaaaaaatcccatctatctagatgatactcaaactgaacaactcccagaaaaagttaaattagtttggttagaaaacagctttagtataagaaaggatattactccagaaaattttaaagacgaaaaattaatagataaaatactagacgagggtgtaaaacggattctgaaagaaagactacaaagtttcggaaatgatgcgaaaaaagcattctccgacctcgaaaaaaacccaatatggctaaataaagagaaagggatagctatcaaaagagtgacaatttctggagtggccaatgctgaaccactacacacaaaaaaggaccatcttggtaaagagatcttagataaagagggaaagcctataccagtagacttcataagtactggaaacaaccaccatgtagcagtttatcgagatgaaaaaggaaatctacaagaaaaggtactatcagtattcgaagccgtagtccgagcgaaccaaggcctgccaataatagaaaaaacttacaaccaacacttaggatgggaatttttgttctcaatgaaacaaaacgaaatgttcgttttcccaaacgaaagtaccggatttaatccaaatgacatagatctcctagaccccaaaaacaagcgtataatatccccaaacctgtttaaagtacagaaactagcaacgaaaaattatatgtttacacaccatttagaaacaaaatccattgatggagacatgctaaaaaacaaaaaagaattatcaggtatactatacaacttcatacaaacaccgcaaaaattatacggaataataaaagtacgaataaatcacctaggagatattgttagtgtaggggaatactga

SEQ ID NO: 5669 - RNA, 4296 nt, synthetic construct
  misc_feature 1..4296: note = Cas9 variant
  source 1..4296: mol_type = other RNA
atgaagagaatactagggttggacttgggatcatcatcgataggatgggcattagtgaatgaagcagaatcaaagaatgaaagatcgtcaatcgtaaaactgggcgtaagagtcaacccactcacagttgatgaaagcattaatttcgaaaaaggaaagtcgataaccacaaacgcggatagaacacttaaaaggagtatgagaagaaatttacatcgatataaactgcgccgtgaagcacttatagaggtacttaaagaatgcaaatttataacggaagatactatcctgtcggaaaatggcaacagaactacgttcgaaacataccggttacgtgtcaaagcacttacagaagaaatatccctagaagaatttgcaagagtattaattatgataaataaaaaaagaggctataaaagtagcagaaaggcaggaggcgcagaagaagacacattaatagacgggatggatatagcaaggaaattatacgatgctaatttgacaccgggagaactatgtctacaattactctcggcaggaaaaaaagtgctaccagatttctacagatcagatttgcagaatgaattggataggatatgggagaagcaaaaagaatattatccaggaatactcacggcagcccttaaagaagaattacgaggtaaaaaacgtgatgcagtatgggcaatttgtgcaaacgcattcgtatggaaggaaacctatactgaatggaacaacgaagaatcaaaaaacgaacagatagaaaaagaacacaaactggaaggtatatacagtaaaagaaaacgcgatgaagctaaaaaagaaaacctgcaatggagagtgtcagggctaaaagaaaaactatcattagaacaacttgtaataatacttcaagaaatcaatacccaaataaacaatagttcaggatatctaggaacaataagtgatcgatcaaaagaactatacttcaacaagcaaacagtaggccaatacttgatggatattctagacaataatcctaacgcgtcattacgaaacatagttttctaccgacaggactacctagatgaattcaacgtactctgggaaaaacaggcagaatttcacaaggaacttacaggagaactaaaaaaagaaataagagacataataattttttaccaaaggaggctcaaatcacaaaaaggcctaattagcttttgtgaatttgaatccagacaaatagaagtaaaaatagacggaaaaagaaaaataagaacagttggaaatcgagtcattccaagaagctctccactattccaagaatttaaaatctggcaaatactgaataacattgaagtaactgcagttggcaacaaaaacaagcaaaggatgcaaaatggaagcaacgaaccggacgatactgaacaattagaactcaatggacgacgctatctataccaagaagaaaaagaactactagcaaaagaattattcgtcagagacaaaatgacaaaactagacgtactaagattactgtttgacaacccggaagaacttgacttaaacttcaaaacaatcgatggaaacaaaactggatacttgttctttcaagcatattctaaaatgatagaaatgtcaggacacgaaccggtagactttaaaaagccgattgaaaaaatagtagaacaagtaaaatcagtctttgtattattaaattggaacactgacatattatccttcgatagcaacaaagaattagataaacaatcatattacaaattatggcatttgttatacagcttcgaaggagacaacacacccacagggaacggatgcctagttcaaaaaataatggacagctatggcttagggaaagaattcgcaaaaatactggcaaatataacgttccaagaagactatggtagcctcagtgcaaaggcaatacataaaattctaccccatttaaaagaaggaaatcagtacgacgtggcatgtgaatatgcaggatatcgccatagtaaaagttcgctgacaaaagaggaaattgccaataaagtattaaaagataaattggaagtactacccagaaattcgcttaggaacccagtagtagaaaaaatactaaaccaaatggtaaacgtaataaacgcaatcatagaagcatacgggagacctgatgaaattagagtagaactagcaagggagctgaaaaaaaacgccaaggaaagagaaaaactcactaaatccatagccgaaacaactaaaacacacgaagcgcacaaaaaacttctacaagaggaatttggattaaaaaacgtggggagaagcgacatcctaagatataaactgtataaggaactagaatccaggggatataagacgctatatagcaatacctacatacctagagaaaagctttttagtaaagaatttgacatagaacatataatcccacaagcaagactgtttgacgactcttttagcaacaagacccttgaagcaagaaatgtaaacattgagaaaggtaatagaactgcgtatgatttcgtaaaagagaaattcggcgaaagtggaacagataacagtctagattgctaccttaataatatagaagtactatttgtaagcggaaagatatcaaaaaccaaatatacaaaattaaagatgactgaacaggatataccaggaggcttcatcgaaagggatctcagaaacacccaatatatcgccaaaaaggcactgagtatgctaaatgaaataagcagatgcgtcgtcgcaacatctggaagtataaccgataaacttcgagaagattggcagttagtagatgtaatgaaagaactaaactgggaaaaatacaaagctttgggattagtagaatacttcgaagataaagacggcaagcaaataggacgtatcaaagattggagcaaaagaaatgatcaccgtcaccatgcaatggatgcgctcacagtagccttcacaaaagaagttttcatacaatacttcaacaacaaaaatgcttcgttgaatcccaatacgaacgaatatgcaattaaaaataagtactttcaaaatggaagagcaatcgcaccaattccactcaacgagttcagggccgaggcaaaaaaacacctagaaaatactctaatctctattaaagcaaaaaacaaagtcataacaaataacataaacaaaacaaaaaaaagaggcggagtaaatacaaaaaagcaacaaacaccaagaggccaacttcacttagaaactatatatggatgctgtaggcaatacttaaccaaagaagaaaaagtgaacgcaagctttgatgtttcaaaaatcgcaacagtatcttcatctgtttatagagatgcactactgaaaaggctacaagaacatcacaacgacccgaaaaaagccttcgctggcagaaactcacttgataaaaaaccagtatggctagacaaagaacaaataagaaaagtacctgagaaggtcaaaacagttaccttcgaaacaatatatacaataagaaaagaaatatcacctgatttgcgtgtcgacaagataatagactcaggagttcgtaagatgttaacgggtagactgaaagaatatgggaacgacgcaaaaaaagcattcagcaacctagacgaaaaaccaatctggttaaacaaggaaaagggcataccaataaaaagagtcactatctcaggaatcagcaacgcgcaaagtttacatgtcaagaaggacaaagacggaaaaccagtcttagatggaaatgggaggaacatccccgtggacttcgtaaacaccggcaacaaccatcacgtagctgtctatcgtagacctgtaatcgataaaaatggacagatggtaatagatgaaaatggaaatctcaaatatgagctagaggaagtagtagtcaccttctttgacgcagtaacgcgagtcaacctaggacaaccaattatagacaaggactacaaggcttcagaaggatggcagttcttattcagtatgaaacaaaatgagtattttgtctttccaaataagaaaacaggattcaaccccaaagaaattgacctactagatgcagacaattatggactaatatcacccaacttattcagagtacaaaaattcacacataaaaattacgtatttagacaccatcttgaaacaacaataaaagacacttcatccatactccgaggaataacatggattgactttcgatcaagcaaagggctagactcaatagtcaaagttcgcgttaaccacataggacagatagtatctgtaggagaatattga

SEQ ID NO: 5670 - RNA, 4299 nt, synthetic construct
  misc_feature 1..4299: note = Cas9 variant
  source 1..4299: mol_type = other RNA
atgaagaaaatcctagggctagacttaggatcgaatagtataggttgggccttggtcaatgaagccgaaaacagggatgaagcaagcagcataattaaattaggtgtccgagtaaatccattaacggtagatgagatgcaaaacttcgaaaaagggaaaagcattacaacaaacgccgaccgtactttaaaaaggtcaatgcgaaggaatcttcaaaggtataaacttcgaagggacgcattaataaaattactcaagaaagtaggtttcatagcggatggtacaatattaagtgaacaaggcaacagaagtacatttgaaacttatagactaagggcaaaagcaccagacgaagagataagtctacaagagctagcgagagtattattgatgataaataagaaaagaggatacaaatcctcaagaaaaattaaagagaaagaagccggaacattaatagatggaatgaaagtcgccaagaaattatacgacgaagatttaactccgggacaattatgtctacaactgctagagtccggaaagaaaagtctaccagacttctatagttcagaccttcaagaagagttcgatcgaatatggaatttccaaaaacaatttaacccaaaagcattctgtgataccgcaaaagaagaaatcaaaggtaaaaataaatcgcaaacctgggcaatacttgcaaagtactttatctggacagatgaaatggtcgtttggaacgaaaaagaaagtaaaacagaacgggtagaaaaagaatgcaagctagtcgggctcaaacgaacagtgaagaaagaagaacaaagaaaagaaaattatcgatggcgagttcaagcattaacagaacaacttgaccttggaaaagtagctgtagtattacaagagattaatggacaaattagtacatcgagcggttatttaggagcaatatctgatagaagcaaagtattatactttaacagacagacagtaggccagtatcaaatggcagaattagagaaaaacccaaatacgtcattacggaacatggtattctaccggcaggactacttagatgaatttgataaaatctgggagaaacaagcagagtttcataaagaattaacagtggaactaaagaaagaaatcagagacataataatattttaccaacgaagactaaaatcacaaaaaggactaataggattctgtgagttcgaaaatagagaaattatggtagagaaaaacggtaaaatgcaagctaaagtcgttggatgcaaagtgattccaagatcccatcccttattccaagaatttaaaatatggcaaaccctaaacaacgtagaagtattcgcaggggaaaagaaatgcaaaagaaaacgtaccgacgccttccccggtttattcgatggaactgaagatacactaatggtagaaggctggaggtatctatatcaggaggaaaaagagatacttgcaaaagaactttctgtgaaaaagagtctcaagaaagaatatattctaaaattactattcgataacccacaagacttagatatgaacttcgagcaaattgaaggcaatgacaccggcaatgtcctatttagcgcatattccaaaatgatagaaaaatatgggtacgagccactcgatttcggaaagtccacagatgaaattatagagagattacaagtgattttcactgatttaggctggaacaccgatcttctattcgtagaccttaacaaagaaggaaaagacttagaaaaacaaccatatttcaaactatggcacctattatatagctttgaaggagataacacgcctacaggaaacggcaaacttgtcgagaaattaatggaattatgtcacgtaggaaaagagtgtgccctcgagctagtcaatattagctttcaaaatgattatggcagcttaagtgccaaagctataaagaaaatattaccgtacctaaaagaaggaaataggtacgatgtagcatgcggttacgcagggtacagacattctaaatctagtcttactaaagaagaaatagaaaataaagttctaaaagataaactagatatactacccaaaaattcattaagaaaccccgttatagagaaaatattgaaccaaatggtaaatgtaattaatgcaataatagatacgtacggtaagccggacgaaattagagtagaattagctagagaactcaagaaaagtgcgaaagaacgagatgaactaacaaaagcaatcgctaaatcaacaagagagcatgaagaaatcagaaaagtacttcaggaagagttcgggatgataaacgtatcacggaatgatataatacgttataaattatacgaagaattaaaagacaatgggtacaaaacattatactcgaatcaatatatacctaaagaaaaagtattttcgaaagaaatcgatatcgaacatatcatacctcaagcaagactctttgacgatagtctatctaataaaaccctagaatacaaagcaattaatatagaaaaaggaaataaaacagcgtacgacttcgttaaagagaaatacggtgaaaaaggtctacaacaatatctaaatagatgtgagagcttattcaaaggccataggactaagttacggaaattaaaaatgggccaggaaaatataccagaaggattcatagatcgcgatctaaggaatacacaatatatcgctaagaaagcactcgctatgttaaacgaaatatgtagaagggtagtcgcaacaacaggaagcataacagaccgactaagagaagactggcaattagttgatgtactgaaagaattaaatctaccaaaatatgaaaccttaggattagttgaagtttatgaagataaagacggacgaaaaataaaaagaataaaagactggacgaagagaaatgaccacagacaccacgcaatggacgcgctcacagtagccttcacaaaggatgtatttattcagtatttcaataataaaaatgcagcttggcaagcagactgcaaagaacacagcgacataattggaataaaaacgaggtattttgaaaacggcagagcattaccgccaatgcctcttgtaagattcagagccgaagcaaaatcccacctagaaacattattagtgtctatcaaagcaaagaacaaggttgtgactaataacgtaaattgtaccaaaagaaaaggaggagagaataagaaattacaacaaacaccaagaggccaacttcacctagaaaccatatacggaagccacagacaatacgtaatgaaagaagaaaaagtgaacgcatcgtttgactcatcaaaaattgcaacagtctgtaaacaagcgtacaggaacgccctactcgaaagacttgccgcattcggaaatgatccaaagaaagcattcacagggaaaaatagtctggagaaaaatcctgtatacctagatagagaacaaactgccagagtgccagaaagagttcgaacagtagagttagaaacagtctacactatacgaaagccagtagatccgaacttatcggtggataaagtcgtagacgccaaagtacgctctatattagaacaaagacttagagaatatgatggagaagccaaaagagccttcgtaaatcttgacgaaaacccgatatggctaaatgaagaaaaaggaatagcaatcaaaagagttaccataaggggaatcaacaaagtacaatcactacatggaaagaaagataaaaatggtaatttaatcctagatgagacaggaaagaaaattccagtagattttgtgaatactgggaataatcaccatgtagcaatttacaggaaaccagtactcgacaaaacgggacaggaaatgttagacaatgaaggaaatcctgtatatgagctcgacgaagtagtagtatcattcttcgaagccgtaactagagtaaacctaggactacccgtaatagacaaaaactataacaaatcagaaggatggcagtttatgttcactatgaaacaaaatgaatactttgtctttccgaatgaaaagacaggattcgatcctaaggaagtagatctattaaatcccgagaattatgcggtcattagtccaaatttatttagagtccagaaaataacagaaaaagattatatgtttcgccatcacctagagactaaagtggtcgatgacaagtttttaaaagaaatcacatggaaaagaatactcactcctaataaattagaaggaatcgtaaaagtacgagttaaccacataggacaaattgtatcagtaggtgaatattga

SEQ ID NO: 5671 - RNA, 4299 nt, synthetic construct
  misc_feature 1..4299: note = Cas9 variant
  source 1..4299: mol_type = other RNA
atgaaaaagatcttaggactggacctcggatctaacagtattggatgggcgctagtgaacgaagctgaaaactctgatgaagtatctagcattatcaagctaggcgtacgagtaaatccactaacagtagatgaaatgcaaaactttgagaaaggcaagtctataaccacgaatgccgaccgaacactgaagagatcgatgcgaagaaacctacaaagatacaaactacgaagagatgcactaataaaattgttgaagaaagtgggcttcatcacagacggaacaatattatccgagcaaggcaacagaacaacgttcgaaacttacagattaagagcaaaagcaccagacgaagagatcagcttacaagaactagctagagtactgctaatgataaacaagaaaagaggatacaaatcctccaggaaaataaaagaaaaagaagccggaacactcatagacgggatggaggtagcgaagaaattatacgacgaagatctaacaccgggacaactatgccttcaattactcgagtcaggtaagaaatcactaccagacttctattcatcagacctacaagaagagttcgacagaatatggaacttccagaaacaattcaatcccaaagcattttgcgataccgcgaaagaagaaataaaaggtaaaaacaaatcacaaacttgggcaatactagccaaatattttatatggacagatgaaatggtggtgtggaacgaaaaagaatcaaaaaccgaaagagtagaaaaagaatgtaaactcgtaggactaaaacgaactgttaaaaaggaagaacaaaggaaagaaaattactgctggcgagtgcaagcgctgacagaacaactagatctagagaaagtagccgtagtactgcaagaaataaatggacaaataagtacaagttcggggtatttaggggcaataagtgatcgaagtaaggtactttatttcaacagacagactgtcggtcaatatcaaatggctgaattagaaaagaacccaaacacatcgttacggaacatggtattttatcgacaagattacctggacgagttcgacaaaatatgggaaaaacaagccgaatttcacaaagaacttaccgtagaattgaaaaaggaaataagagatatcattatcttttaccaacgaaggctaaaatcgcagaagggactcatcggattctgtgagttcgaaaacagagaaataatggtagagaaaaatggaaaaatgcaagcaaaggttgtcggatgcaaagtcattccgcgaagccatccgttattccaagagttcaaaatatggcaaacattgaacaacgttgaagtatttgcgggtgaaaagaaatgtaaaagaaaaagaacagacgcattcccaggcttattcgatggtaccgaagacacactaatggtagaaggttggcgatacctgtaccaagaagaaaaagaaatactagccaaagaattgtctgtaaagaaaagcctaaagaaagaatacatcctcaaattactattcgataatccacaagacttggacatgaacttcgaacaaattgaaggtaatgatactggcaatgtgttatttagtgcatactcgaaaatgatagaaaaatacggatacgaaccgttagatttcggaaaacctacagataaaataattgaacaattacaagtaatctttgcagacttaggatggaatactgacctactgttcgtagaccttaacaaagaaggaaaagacttagaaaaacaaccctattttaaactgtggcaccttttatacagttttgaaggagacaacacaccgacgggaaatggaaagctagtagaaaaactaatggaactctgtcatgtaggtaaagaatgtgcattggaattagtaaatataagttttcaaaacgattacggatcactctctgcaaaagcaattaagaaaatactaccatacctaaaagaaggaaatagatatgacgtagcatgcggatatgctggttatagacactccaaatccagtctcacaaaagaagaaatagaaaataaagtattaaaagacaaattagatatactacctaaaaacagtctgcgaaatccagtagtagagaaaatattaaatcaaatggtcaatgtgataaacgcaataatcgatacttacggcaaaccagacgaaatccgtgtagaactagcccgagaactaaagaaatcagcaaaagaaagagaagaattaaccaaagcaattgcaaaaagcacacgagaacacgaagaaataaggaaagtcctacaagaagagttcgggatgataaatgtcagtagaaatgacataattagatataaactttacgaagaattaaaagataacggctacaaaacattatatagtaaccaatacatacccaaagaaaaagtattcagtaaagaaatcgacatagaacatattattcctcaagctaggctatttgacgacagcctatcaaacaaaacactagaatataaggcgatcaacatagaaaaaggaaataaaactgcatacgattttgtaaaagaaaaatacggagaaaaaggattacaacaatatctcaatcgctgcgagagcttatttaagggacaacgtaccaaacttagaaaacttaagatgggccaagaaaatataccagaaggattcatagacagagacttaagaaatacccaatatattgcaaagaaagctctagcaatgctaaatgaaatatgcagacgagtagttgcaacaaccggaagtataacagataggttaagggaagattggcaacttgtcgacgtactaaaagaattaaatctaccaaaatacgaaactttaggcctagtagaagtttatgaagacaaagacggaagaaaaattaagagaatcaaggattggactaagcggaatgatcatcgacatcacgcgatggatgcactaacagtagcatttacaaaagatgtctttatccaatatttcaataacaaaaatgcagcatggcaagccgattgcaaagaacatagcgatataataggcataaaaacaagatactttgaaaatggaagaagtctgccacctatgcctctcgtaagattcagggcagaagcaaaaagccatcttgaaacacttctagtaagcatcaaagcaaagaacaaagtagttacaaataatgtaaattgcacaaagcgaaaaggtggagaaaacaagaaactacaacaatcacccagaggacaattacatctagaaacaatatatggtagccaccgccaatatgtcacaaaagaagaaaaggtaaatgcctcatttgattcatccaagatcgcgacagtatgcaaacaagcatatagaaacgctctacttgaaagattagccgcatttggaaatgaccccaagaaagcattcactggtaaaaacagtctagagaaaaatccagtatacctaaatagagaacaaacagcaagagtaccagaaagggtaaggacagttgaattagaaacagtgtatacaattagaaagccagtagaccccaacttgtcagttgataaagttgttgatgcaaaggtgcgatcaattctagaacagcgacttagagaatacgacggagaagccaaacgggcctttgtaaatttagatgaaaacccaatctggctaaatgaagaaaaaggaatagctataaaaagagtaacgatcagaggaataaataaagtacaatcactacacggaaagaaagacaaaaatggaaacttaatattggacgaaacaggaaagaaaataccggtagattttgtaaacacaggaaataaccaccacgttgccatctatcgcaaaccggtcctaaacaaaacaggacaagaaatgttagataatgaaggaaatccagtatatgaattagatgaagtagtagtcagtttcttcgaagcggtgaccagagtaaatctaggtctaccagtaatagataaaaattacaataaaagcgaaggatggcaattcatgtttactatgaaacaaaatgagtacttcgtttttccaaatgagaaaacacgcttcgaccctaaagaagtagaccttcttaatccggaaaactatgctgttatctctccgaatctgttcagagttcagaaaataacagaaaaagactatatgtttcgtcaccacttagaaaccaaagttgtagacgacaaatttcttaaagaaataacatggaaacgaatactaacaccaaataaactagaaggaatcgttaaagttagagtaaaccacattggtcaaatcgttagcgtaggggagtattga

SEQ ID NO: 5672 - RNA, 4299 nt, synthetic construct
  misc_feature 1..4299: note = Cas9 variant
  source 1..4299: mol_type = other RNA
atgaaaaacatactcggactagacttaggaacaacatccataggattcgctcacatcgtagaggatgagaacaaagaaaagtcagaaataaaagaattaggagtccgaatagtgtcacttactacagatgaacaaagcgatttcgagaaaggtaaaagcatcactacaaacgcaaacaggactttaaaacacggcgctagactaaacctcgatcgatatcaacaacgtcgaaagtacttaatcgatctattacataaagcaaacctaataacaccaagctcaatactagctgaaaatggtaaaaatacaacccattccacatggcaattacgtgcaaaagcagtaaccgaacgaatagaaaaagaagaattcgcaagaattctacttgcaattaataaaaaaagggggtataagtcctcaagaaaagccaaaacggaagacgaaggacaagcaatagacgggatggctatagcaaaacgcctatatgacgagaacctgactcccggtcaattaagcctgcaactactacaacaaaacaagaagttactaccagacttctaccgaagtgatctacaaaaagaattcgatctcgtctggaactttcaaaaacagttctatcccgacattttaactgatattttttataaagaattacaaggtaaaggcaaagacgcaacatctaaagccttctccaagagatatcatttcgacacggccgaaaataaaggttcaaaagaatccgtaagactacaagcgtaccaatggcgagcagaggccgtatcaaaacaattaagcaaagaagaagtagcctacgtactcactgaaataaacaacaacctaaataatgcgagcggttatttaggagcaatttcagatcgatcaaaagaactatacttcaacagacaaacagtaggtcagtacctttatgcacaacttcaggaaaatcgacacaattccctaaaaaataaagttttctaccgacaagactatctagatgaattcgagaggatatgggagacacaagcgctatttcataaagaattaacggacgaattaaaaaaacaaattagagacgttgtaatattttatcagagaaaaccaaaatcccaaaaaggacttataagtttctgtgaatttgaatccaaagaaatagaaattgaaaaagatggaaaaaccataactaaaaacataggcgcaagagtcgtacctaaatcatcccccctctttcaagagtttaaaatctggcaaatactaaataacgtaatctgcaaaagaaaaggaataagaaaaaaaaaaataagcgcaaaaacaacccaactagatttattaaacgaaagctcccaaactatattcagtctcgatatggaatgcaaacaattactattcgatgaactaaacctaaaaggagacttaaaaagtgataaagtattaaaattattaggctattcgcctcaagaatgggaaataaattacaaccaactagaaggaaacaggactcaaaaagcactttacgaggcctatctgaaaatagtagaaatggaagcccatgatgtaaaagatattctacaaataaagtctacaaaagacgattggagcctagatgaatcacccctaagtgcatccgagataagagaaagtgtaaaagctatattccaagcactaggaatttgcaccaaaatattatatttcgacccgttacttcctgttaaagatttcgaggagcaggattcataccaactctggcatctattatattcctatgaatccgatgattcaacatctggtaacgaaactttataccgtatcttagaaaaaaaatacgcattcaagcgagaacacgctcgtattctagccaatgtagcactacaagacgactacggctcactgagtacaaaagcaataagaaaaatataccctaatataaaagagaaccaatatagcaccgcatgcgaaatggccggttacaaacacagcaaattatcccttactaccgaggaactagaagcaagagaactaaagaatattattccgctattaaaaaaaaacgcattacgcaaccctgtcgtggaaaaaattctaaatcaaatgattaacgttgtaaatgcattaatagaaaaaaacagtgaaagagatgccgaaggaaaaattactaaatacttccactttgatgaaatacgtatcgaattagcaagagaattaaaaaaaaacgcgcaaaaaagatacgaaatgacccaaaacataaataaagcaaaatcggaacaccaaaaaataagtgaaattttacaaaaagaattcggtatcaaaaatccaacaaaaagcgacataatccgctacaggctttataaagagcttgaacataacggatacaaagaattatacacaaatacatacatagccccagacgtgttattttctaaaaatatagatatagaacatatagtaccaaaagcaagagttttcgacgactccttctcaaacaaaacacttgcattcaaggatttcaatattaaaaagggcgagagtaccgcatttgactatatcacatcactaaaaaacgaagaaaaacttaatcagtatctcgcaagagtagaaaacgcatacaaaaccaaaaatatatcccctgcaaaatacaaaaacctcttaaaaaaagcctccgaaataggggacgggtttatcaatagagacttaagagatacacaatacattgcaaaaaaggcaaaagaaattctatttcaagtgactaaaaacgtattaagtacttctggctcgataaccgatagactgcgagaagattggagtctcgttgacgtcatgaaagaattaaatatgcctaagtatcaatcactaggactaacagaagtcgaagaaagaaaagacggaaacaaagtaacagtaatcaaggactggacaaaaagaaacgatcaccgccaccatgccatggacgcactaacagtggccttcaccaaaccctcgtatatacagtatctaaaccatttaaacgcacgaaaagacgaaaacaacaaaaactactcagtaatactagctatagagaaaaaagagacaatcaaagtccccaccaacaacgggaaaaataagcgagtatttatcgaaccaattcctaattttagacaagtcgcaaaaaaacatctcgaagaaatattcatatctcacaaagctaaaaacaaagtagtaacaaaaaatacaaataaacctgcaggaacaaacaaacaacaaataactctgacacctcgaggacaacttcacaaagaaacaatatacggaaaataccaatactacgtcaacaaagaagaaaaagtcggagtaaaattcgataaagaaaccattgcaaaagtaagcaatcccctttaccgcgaagccctattaaaaagactacaggcaaacgataacgacccaaaaaaagcattcacgggtaaaaacgctctctcaaaaaaccccatatacctagatgaggctaagacaaagaccctaccagaaaaggtcaacctgacgtatctagaagaagacttcagtgtcagaaagaaaatagtaccaaaaaacccaacgagcaaagaattcgtacccaaccttaaaagcatagaaaaagtagtagacgaaggagtaagaaacatattaatagaaagactaagagtttacaataatgaccccgaaaaagcgtttgtagacctagaaaaaaatccgatatggttaaataaggagaaaggtatagcgattaaaagagttacaatctcaggtgtaaacaacgcgcaaccgctccacataggaaaagatcatctaggaaaaacaaccctaaacaaagaaggaaaagagatcccagtagactatgtttcgactggtaataaccatcacgtagccatatacagagataaagaagggaatctgcaagaacaaatagtaagcttttttgaagcagtagttagaacacaacaaggcctacctatcatcgacaaaacctataaacaggaagaaggatggcaattcctatttaccatgaaacaaaatgaaatgttcgtgtttcctaacgaagcaaccggcttcaaccccgctgagatagacctattagacccgaagaacaaaaaacagatatctcctaatctattcagagttcaaaaaatagcgacaaaggactattttttccgccatcatttagaaacgaatgttgaaacagacaatgtccttaaaaatactacatggaagagagaaggattaagtgggctaaaagatattgtaaaagttcgaataaaccatctcggagacatagtttctatcggcgaatattga

SEQ ID NO: 5673 - RNA, 4302 nt, synthetic construct
  misc_feature 1..4302: note = Cas9 variant
  source 1..4302: mol_type = other RNA
atgaaaaagattttaggattagacttaggaacaacgagcattggatacgcccaagtaaacgagtcagaagatttcaaagattcgagcatagaaagaataggtgtacgggtaaatccattatcagtcgatgagcaaactaacttcgaaaaaggaaaaccgataagtataaatgctgatcgcaccctaaaaagcggcgcacgccgcacactagaccgctatcaagatcgacgatccaatctaattgacgctctagtaaaaagtgtaataataactgaagatacagtgctggcggaagacggtaaaaacacgactcacagcacattcgcactacgagccaaatccgcgagtgagaaagtagaaaaagcagaatttgcaagaatactattagcaattaataagaaacgaggatacaagtcttcaagaaaaacaaacaacaatgatgacgaaggacaagcaatcgacggaatggcaattgcaaaaaaattatacgatgaaaacttaaccccaggacaactcgcctaccaattactaaaagaagggaaaaaatatctaccagacttttacagaagtgatctacaagcagaatttgataaaatatggacattccaaaaacaattctatccagagatcttaacagatgaacttcaaaaagaactggcagggaaaggccaacgagccacaagtgccatcttttggaagaaatacgatttcaatactgccgaaaataaaggaacgagagaagagaaaaagttaaaagcatatgaatggagaagtacctctgtagataaaaagttacaaaaagaagaagtcgcgtatgtgataacagaaattaacaataacctcacaaactcctcgggatatttgggtgcaattagtgaccggtcaaaagaattatacttcaataaacaaacagtgggtcaatatctattcaaacaaattcagaaaaacccacatacaaaactaaaaaatcaagttttttaccggcaagattattttgatgaatttgaaatcatttgggaaacacaagctaaatttcatcctgaactgactgaagaattaaaaaacaaaatcagagacataatcatcttttaccaaagaaaattaaagtcacaaaaagggttaatctcattctgtgaattcgaacgaaaagaagtagagattgaaaaaggcggaagacgaatgaaaaaaactatagggttaaaagtagctccaaaatcatctcctctatttcaagaatttaaaatctggcaagtcctcaataatgtcttgataagaaaaaaaggatcaaaaaaacgccgagtaaaagaacctgaccaacttaatttagtagaacaagaacaagaagtaatgttcttcgacatgcaaaccaaacaaacactttttgatgaactaaacgtaaaaggaaatcttaaagcaaaaagaattattgaactcataggacaagatgcaaatgactgggaaataaattactctgaaatagaaggtaatcgaaccaacaaagcattgtacgacgcatatttaaaaatactagatctggaaggatacgatacgaaagcgttgttagatgtcaaaacgtcaaaagacgaagtcgaattggatgacattaacatttccggtccagaagtaaaagatctagtcaaacgcatatttgaaagcctcgaaatcgacacacaaatacttgaatttgatgcagaactagacggcgaagtcttcgagaaacaatcttcatacttattatggcatcttctatactcatacgaaggagatgacagccccagcgggaacgaaaaactatataaattattaaaacaaaaatttgggttcaaaaaagaacacgcccaaatccttgcctcaataacacttagcgatgactacggttctttaagcgcaaaagcaatgagaaaaatatatccttatatcagggaacaaacctttgataaagccgcttcactagccggatataggcacagtgcctcaagtttaacgaaggaagaaatcgcaaacagaccactcaaagacaaactggaattaataaaaaaaaacagcttaagaaaccccgtagtagaaaaaatactaaaccaagtagtgaatattgtgaacagtcttatagaagctaactcagaaaaagatagtgacggaaacatcatatcatactttaaatttgacgaaatccgcatagaattagcccgcgaccttaaaaaaaacgcaaaagaacgagcggaaatgacactaaacatcaatgctgcaaaaatagtacacgaaaagattttcaaattactacaagcagaattcggagtaaaaaatccaacaagaaacgatataataagatacaagctatacgaggaactaaaaaacaacggatataaagatttatacactaatatctacataccacgtgaaatactcttttcgaaacaaatcgacatcgaacacattataccacagtctaaaatgtttgacgattcgttcagcaataaaacaatagtttttagaaaagataatctagataaaggaaattcaacagcattcgactatattgactcaagattcggtaaggacaaactaacagactttgaacaaaggatagaatttttattcgagcaaggaaaaaaaaacaaagaagaaggtatatcaaaggctaaataccagaaattactgaaaagggaagccgatatcggagacggatttatagaaagagacttacgagatactcagtatatagcaaagaaggccagaaacctattgtacgaaatttgcagaatagtcactcccacgactggtagtattacagatagattgagagaagattgggatctagtaaatataatgcaagaattaaatttagacaaatttaaaaaattaggcctaacagaaatggtagaaaaaaaagacggttctttcaaggaacgaatagtggactggtcgaaaagaaacgaccataggcatcacgctatggacgcgttaacaatcgcatttaccaaacacagtcacatacaatacttaaactatctcaatgctagaaagaacgagaaccacaaacaacaccacaatataatcggcatagaaaggaaagaaacagaattcgtaatagatgatcttggaaacaaaaagagaaaattccacttaccattaccaaactttagagaggaagccaaaaaacatctggaaaacgtattagtctccttcaaagctaaaaacaaagtagtgacaaaaaataagaacaagaccgcaagcagtaagggagaaaaaataaaagtagaactaaccccccggggacaactacataaagaaaccgtttatggaaaatataaattctatgtatcaaaagaagaaagaattggcggaaaatttgatcaacgaactattgaacgggttgccaacagtacccacaaacgtctcttactacaacgtctattagagaatgacaacgatgcgaagaaagccttcacaggaaaaaacgcactagctaaaaaccccatataccttgacgacactaaaaccctaaccttaccagagatcgtaaaattaacctggctagaagaagactatagtataagaaaagatattacaccagagaatttcaaagatataaaagtaatcgacaaaatactagatgaaggagtaaaaaggatattaaaagaaagattagctaaacacaacaataacccaaaagaagcattttccgacctcgaaaaaaaccccatatggctgaacgagaaaaaaagtatcagtataaaaaaagtaaaaataagcggtataaataacgcagaagctctacattataaaaaaaatcacttgggaattgagatactggacgatgaaaaaaaaagaataccagtagacttcgtaagtactggcaataaccatcacgtagcaatatatagagatgagaaaggcaatctacaagaagatgtggtaagtttctttgaagctgtagcacgcgtaaaccagaacctcccaataatagacaaaacactcaaagcatacctggggtggaccttcctattcacaatgaaacagaacgagtactttatattccccaacaaacaaacgggattcaatcctacagaaatagatttactagattcaatgaacaacaaactaatatcaccaaacctcttcagagttcaaaaatttacagttaaagactacttcttccgccatcatctagaaacaaacgtcgaagatgacagtaaactaaaaaatacaacctggaaacgtgaaggactaggcggaataggtaacatcgtcaaagtacgtatcaatcacataggccaaatagtaaagataggagaatactga

SEQ ID NO: 5674 - RNA, 4305 nt, synthetic construct
  misc_feature 1..4305: note = Cas9 variant
  source 1..4305: mol_type = other RNA
atgaaaaacatcctaggcctcgacttaggcacaaacagtattgggtgggcgtacgtgaaacaagcccaaaacgattcagaaaagagtgaaatagcagaactaggagtaagggtcaacccacttacagtggacgagaaaacaaactttgaaaaaggcaaaccaattagtacaaacgcagatcgcaccctcaaaagaggagcacgtaggaatctccagagatacaaattgagaagacaagaactgatagagctattaaaagactaccaagttataagcgataaaacaatacttgcagaggatggcaaagaaaccacattcgaaacgttacgtctaagagtaaaatctgcaaaagaacaagtatctctagaagaacttgctcggatactcctaatgataaataagaaacgcggatacaaaagttcccgcaaagccaagaatgaggacgagggacaacttattgatggaatggaaatagcccgtagactctatgacgaaaacttgacaactggtcagctatcactacaattattaaaagaaggtaaaaagtcactaccagattactacagatcggacttacaacatgagctcgacaaagtatggaatttccaaaaacaatttcatcccgacatactaacagatgagttctacacgtctattcaagggaaagggcaaaaagctacgagagaaagtttctcaagtaaatatggaattgacacagcagaaaataaaggaagtcgggaagaaaagaaactccaagcataccaatggagagcagacgcgacacataaagaacttacaaaagaagaactagcatttgtaatcaccgagataaacaataacataaacaactcctcagggtacttaggagcgatatccgacagatcaaaagagctaatttttgcaaatgaaacagtaggtgaatatctttggaaacaaatccaaaatgatccccatacatccctaaagaaccaagtattctatagacaagattacttcgacgagttcgaacgcatttgggaaacacaaagcggcttttatccacaaatactaacagagtcattaaagaacgaactacgggatattctcatattttaccagagaaaactcaaatctcaaaaagcattggtatccatttgcgaatttgaaagtaaagaaatacccttaaaagacaaacaaggcaacccaatatctaaaaacggtattcctgtcaccaaacttgttggcccaaaagttgcacccaaatcgtctcctctgttccaagagttcaaaatatggcagaatctgaataatgtcctggtcagacccaaaggatcacgcaaaagaaaagtaacgactaaccaacaaagcacactattagaaggccaagaaccggtatttgaactcaatctagaacaaaaagaactattattcgaagaactaaatctaaaaggtaaccttaaaacggactattgcctcgaattaataggctactcagctaaagaatgggaaatgaattaccccacacttgaaggcaataaaaccaataaagcactatacgaggcttacctaaaaatcatcgactctgagggatacgatgccaagaaactcctaaaagtcaaaacagacaaagatgatataaacttagatgacataaaagtaagcgcatccgaaataaaaacaatgatctcggacatcttcaacgaactgggcataaatacgaaaatcctcgatttcgacgcagaattggaaaggaaacaatttgaagcccaagcatcctatcgattatggcacttactatacagttacgaaggagacgacagtaaaagtggtaatgaacttctatacagacttcttgaagacaaattcggttttaaaagggaacacagcaaaaccctcgcaaatgtcagtctccttagtgattacgggaatctatcaaccaaggcaatacgaacaatatacccttacattaaagaaaacaaattctccacagcctgcgaattagcaggttacagacactctaaactatcaatctcaaaagaagagaacgagaatagaactctaaaagacaccctcgacgtcctcaaaaagaactcgttacgtcaaccagtagtagagaaaatattaaatcaaatgatcaacttaataaacgaactaatcgaaaaacacagcgaaaaagatgaaaaaggaaacatcgttaaatatttcaaatttgatgaaatacatatcgaactagcaagggaactcaagaaaaatgcagaggaaagacgagaattagatagtaaagtcagagaaggtaaagatagaaacgagaaaataataactatacttaaatctgaatttgggctaccatatcctactaaaaacgacatcacaagatacagattgtacgaagaactgaaagataatggatacaaagatctatatacaaacacatatatcccaagagaaaaattattctcaaaggaaatagacatagaacatataatcccaaaaagtagattattcaacgatagtttttcaaataagacaatatgttacaggcaagataatctgaacaagggagaaagaacagcatacgattacatcgaaggactaggaaaaacacagttagatgaatatctaaacagagtcgaaaatttatacacgaataaatttataaccaaagcaaaatatcgtaacctccttaaaaaggaaagcgagattggagacggattcatagaaagagacttaagagagacacaatatatagctaaaaaggctaaagaaatgctcttacaaataaccaggcacgtcgtttcaactacaggcagtataactgacagactccgagatgactgggagctagttaatgtaatgcgagaactcaaccttcccaaatacaaagtactcgggctcacggaaatacaagaaagaaagaacggccaaaccgtagaagttatcacagactggacaaaaagaaatgaccatagacaccatgcaatggacgctctaactgttgcatttactaagcatagtcatattcagtacctaaacttcctaaatgcacgaaaagacgaaaagcacaaggaatacagtaacataatgggcatacaacaattggaaacagagaaaacaacagacaaagacggaaaggaccgacgagtttttaaaaccccaatacctaactttcgacaagtagcaaaagaacacttagaatccatcctaatctcgcataaaactaaaaataaagttgtcacaagagcaacgaataaaatagcaggatcaaagaaacaacaagaaacactaagtcctcgtggacaactacacaaagagactgtctacgggaaatatcgcaggtacgttcaaaaagaagagaaaatcggaagtaagttcgatttacaaaccatcgaacgtgtagcaaatccactctataagagacttctaacgaaaaggcttgaagaaaacggaggtgacccgaagaaagcatttacaggcaaaaacgcattagcaaaatctcctatttaccttgatgaaacacaaacacaacaactcccagaaaaagtaaaactcgtttggctagaaacagatttttctatacgtaaagatataaccccagacaactttaaagatgaaaagtcaatagacaaagttttggatgaaggaataaaacgcatactaaaagacagactaaaaagtttcgacggtgacgccaagagagcattcacagaccttgaacaaaaccctatctggctaaacaaagaaaaaggcatcgcaataaaacgcgtaacaatcagtggtgtaagtaacgctgaaccactgcatacaaagaaagaccacctgggaaatgaaatcttcgatgacaccggaaaacccatacctgtagactatgtttcaactgggaataaccatcacattgcaatctatagagacgaaaatggaaacctacaagaaaaggctgtatcatttttcgaagcagtaaccagagccaaccaaggcctccccacagtagataaaacatataatcaacacttaggttggcaattcctatttacgatgaaacaaaatgaaatgtttgtctttcctaataaagaaacagggttcgacccccaagaaatagatcttctagatccgaaaaataagaaattaataagcccaaatttattcagggttcagaaaataagcactaaaaactacttctttagacaccacttagaaacatcagtagaaacacacaatgcactcaatggagtaacatacaaatcccaacttggcttaaacggaatcacagacataatcaaagtaagaataaaccacttaggagatatagtacatatcggagaatactga

SEQ ID NO: 5675 - RNA, 4308 nt, synthetic construct
  misc_feature 1..4308: note = Cas9 variant
  source 1..4308: mol_type = other RNA
atgcttggatgcgaaaggaaaagaaaaagaagagaaaaagagaaaatggcgaaacccaaagattatacaatcggactagatataggaacgaactccgtaggttgggtagtaacagacgatcaaaataacatactaaggataaaaggaaagaaagctattggcgcaaggctctttaccgaaggtaaagtagccgctgaaagaagatcatttaggaccacgaggaggagactgtcacgaagaagatggcggataaaaatgctagaagaactgtttgatgaagagatagctaaagtagatcccagctttttcgccagattacacgaaagttggataagccctaaggataaacgaaaaagatattcagcaatagtgtttccaagccctgaagaagacaagaaattccatgaaagttacccaactatctaccatttaagagacaaattaatgaaagacgatcaaaaacacgacatcagagaaatatacatagcggtacatcagatgatcaaagcacgtggaaactttctacacgacgaatcagtagaaacatacagaagcggaatgagctcattgggaggccggtctgaaagaaatatactatcagttcaaactttagaggaactcaatgacctattcgccgaaaatgaaggaaccgaagaagttgaactaaatgtcgcaagcgcagaacaaattaacgatatcctaacaggtggacacctcaatgctgactcgcaaaaggaaatatcaaacttattattaccttcgagctttccatcatttgatgataaagccaaagaaaaacaagttaagaaactaattaataatgtagcgaccaatatcagtaaagcgtggctaggatacaaagccgacttctcgacgatactcaatttagctaaagtagataaagatcaaaagaaaatattcgctttcgccctacagggaggagatgaagaagataaagtacaagaactagaatccctactcgaacaaagccagacggacatcgttgaccgattaatcgagataagacacgcaatagtactgtcagagatagtccccgtaggaatgacattatcagaagcaatgatagacaaatacgatcagcacaaagaggacctaattacgctaaaagcagtaatcagaaatacgaaagacaaaaagaaagctgcaaaacttcaggccatttatgacctttacgtcaaaaatagacacgcagatctagcaaaagcaatgaaactaactggaattaagaaaagaagtgaactcttagatccagaagaacttaagaaaggaatatctagtcttctagatgactcaccagaagcggtagaaataaaacaaagactggaagagaaaacatttttacccttgcaacgatccaataacaatggcgtaataccaaatcaactacaccaagtagagttagatgaaatcataaagaaacaaagtaaatactacccttttcttgccgagaaaaacccggatgaatcagaagaggcccaaaagaaagccccaacaaaactagatgcgttacttacgttccgagtaccctattatgtaggtcctatgatcactaaagaagaacaagaggcacaaaatggacactcattcgcatggatggttcgacgtgaccctcaagaccatgaagcaataacaccatggaatttcgaaaagaaagtcgataaaatggcaagtgcaacacaatttataaaacggatgacaaccaaagatacttatcttttaggcgaagacgtattaccagctagttcattaaaataccaattattcacagtactcaatgagttaaataatttacgagtgaatggaaagaaattaacaagtgacgaaaaagaacaggttatagaaggcctgttcaagaaacagaaaacggtaaaagcagataaattcgttaaatactggcaagcaaaacatataggggcggatatcaaagtaaaagggttatccgacccaagcaaattcaactccacaatgtcaacttacatagacttcaagaaaattttcggagatcaactaaatgatgtcaacagacaaaacgatttcgagaaaatcattgaatattcaacaatattcgaagatagaaaaatattagaagataaactcagagttgactttgcttggctttcagaagaacaaataaaacaactatgcaggttacgacttcaaggatggggaagactatcagataaattgctcacccgcctcacagatgcggacggacaaaatgtattagaaagactatggaatagtaatgacaattttgttcaaatagtatcagatcctaatataaaagcaaaaattgaacaagaaaatcagaaactattaagagattcccaatcagataatgcagtagaaagcatacttgacgatgcatatacgagcccacagaacaagaaagcgataagacaagtaatgcgagtagtacatgacatagtgaaagcctgtgatggaaacgtaccagctaaatttgcaatcgaatttgcaagatctcaagaagatgacccaaaacgtactacagcaagggttaatcaaatgcagaaaatctacgatcaaatctcagatgaagtagtatcacaaggcgtcaaagagcaactcagtggaatgaaaagtttaaaagatagatactacttatactttatgcaagggggtcgggatgcatacacaggtgcaaaattaaacatcgatcgattaagtgattacgatgtagatcatatcatgccacaatcatttgtaaaagacgactcactggacaatagagttcttgtagctagagcggtaaacaaccaaaaatcagacaaagtaccagcactattatttgggaataaggtagtagctgatctaggtatcacagttagggaaatgtgggacaaatggcaaaaattaggaatgatttcaaaaagaaaactttccaacctattaacagattcagatgcactaactgagtacagagcacaaggatttatcagaaggcaattagttgaaacttcacaagtgataaaattaacggcaactatattacaaagcgagttcccggattcaaaaatcatagaagttcccgcaaaatataatagcatagtcagaaaacagttcgacttatacaaatcaagagaagtaaacgacttccaccatgcgatcgatgcttatctaagcacaatcgttggcaactacttgtaccaagtataccctaatttaagaagaatgttcgtctacggagagttcaagaaatttagttcgaacgctgaagaaagcgcacatgatgtagcacgaagggtaaaatcaatgaatttcttagatgacctattaaggggaacacacggtgataatatctactgtaggagtacaggtgaaatagtatttaatagaaatgatatcatatcaaaactcaaacaagcatacagtttcaagcaaatgttagtcacacaagaagttttcacgaagaaatcagcactatttaaccaaacagtctatcctagtcccaaaagagacggatccaaacgaagcggtcttataccaagaaaaagaggaatggacccggaaatatacgggggatatgctcataaccaagactcatattttgtgctggcgaaaattgaaaaggtaaaaggttatacattacaaatagttggcgtacctatccgaagtctggaaatcataaacaaggctgaagacttttccacggcgctactcgacataataaaaagtaaagtgatgtataatgagaaaacaggtcaaccaaagcggggaatcaaaaatgttgaaatactcgtcaacaaattaccatatcgccaacccatacttgaaaaggatgtatcatacatgttaggcagttctgcttacaaatataacataaaacagataacactctcgcgccagtcaatgaagtacatattggattatatagacgatccaaacttcacaaaacatgaaatgacaatgatagatgaacaaaatgaacgagaatgcctgttaagtgtctatgatgaaatccttgaaaaagtagataaatatctccctttgtttgacggaaataaatttagagagaaactccattctgcaagaaaagagttcgtatccttgtctgttgacgatgaggcatccgccatagagaaaatcttaagaggacttcatgcgaatagcgaaatgccctccttagaaaatctcaaaataaaacctgcattaggattctttcaaatgaaaaatggaattacactgtccaacgacgcagttttactttatcaatcacccactggattatttgagagaagggttaaagtgtcagacttactaaagtga

SEQ ID NO: 5676 - RNA, 4308 nt, synthetic construct
  misc_feature 1..4308: note = Cas9 variant
  source 1..4308: mol_type = other RNA
atgaaaaatatactgggattagaccttggtacaacatcaataggttttgcacacatagtcgaagacgaaaacaaagagaaaagtgaaattaaagaactaggagttcgcatagtgccactaactacagacgaacaaagtgacttcgaaaaaggaaaatctattacaactaatgcaaatcgcacattaaaacacggagcacgtttaaatcttgacagatatcaacaaagaagaaaatacctgatagacctattacaaaaagctaatttaataacatcaagttcaattttagcagaaaatggcaaaaatactacgcactctacctggcaattaagagctaaagcagtaacagaacggatagaaaaagaagagttcgcaagggtattactagcaataaataagaaaagaggatataaaagttctagaaaagcaaaaactgaagatgaaggacaagctattgacggtatggccatagccaaacgcttatacgacgaaaatctcaccacaggacaattatcccttcagctacttcaacagaacaagaaactcttacccgacttttatcgctcagacctgcaaaaagaatttgatttagtgtggaatttccaaaaacaattctatcccgatattctaaccgactcattttataaagaattacaaggaaaaggaaaagacgctaccagtaaagcattctctaaaagatatcacttcgacacagctgaaaataaaggatctaaagaatcagtacgcttacaagcataccaatggcgagtcgaagcgatatctaaacaattgagtaaagaagaagtcgcatatgttttaaccgaaattaacaataacttaaacaatgcctccggatatcttggggcaatatcagatagaagcaaagaactctacttcaatagacaaacggtaggccaatacttatacgcacaactacaggaaaacagacacaactctcttaaaaataaagtattttatcgacaggactatttagacgaatttgaaagaatatgggaaacacaagcatcattccataaagaactgacggaagagttaaagaaacaaatccgagacgtagtgattttctatcaacgaaaaccaaaatcccaaaaaggtttaataagtttctgtgagttcgaatcaaaagaaatcgaaattgaaaaagacggaaaaacgataacgaaaacaatcggcgcacgagtcgtccctaaatcatctcctctatttcaagaatttaaaatatggcaaattctgaacaacgtgatatgtaaacgaaaaggaatcaggaagaagaaagtaagcgccaaaacaacccaattagatttattaaatgaatcatcgcaaaccatatttagcctagacatggaatgtaaacaattgctattcgaggaacttaacctaaaaggggatctaaaatccgacaaagttctaaaacttcttggttactcacctcaagagtgggaaatcaattataaccaactagaaggaaaccgaacgcaaaaagccctatacgaggcttaccttaaaatagttgaaatggaagctcacgatgtaaaagatattcttcaaattaaatccgcaaaagatgactggagcctcgacgaaagccctttatcagctagtgagattagagaaagcgtaaaagccatattccaggccctaggaatttgcactaaaatactatatttcgatccgttgcttcctgtaaaagagtttgaaaaacaagacagttatcaactatggcatctattatattcgtacgaatctgatgacagtacaagcggaaacgagacactatacagaatacttgagaagaaatacgccttcaaaagagaacacgtacgaattttagcaaacgtagcacttcaggatgactatggaagtttaagcaccaaagcgatacgcaaaatctatcccaacataaaagaaaaccagtacagtatagcctgtgaaatggcaggatacaaacactccaaacttagcttaactacagaggaacttgaagcccgagaactgaaaaatataataccgctactaaagaaaaacgctctacgaaaccctgttgtcgagaaaatattaaaccaaatgatcaatgtcgtaaatgcactaattgagaaaaatagcgaacgagacgcagaaggaaaaataacaaaatatttccactttgatgaaataagaatagaactagctagagaattaaagaaaaacgcacagaaaagatacgagatgactcaaaacataaacaaagctaaacttgaacatcagaaaataagtgagatacttcaaaaacagtttggaatcaaaaatccaacaaaaagtgacataataagatacagattatatcaagaattagaacataatggatataaagaactatatacgaacgcatatatagcacctgacgtcctattcagcaaaaatatagacatagagcatattgttcccaaagcaagggtatttgacgatagcttcagtaacaaaaccttagcattccgagagttcaacatcaagaaaggcgaatcaacagccttcgactatatcaccagtctaaattcggaagaggaattaaaccaatacctcacaagagttgaaaatgcttataaaacaaaaagcatctcaccaacaaaatacaaaaacctgttgaagaaagcatcagagataggtgacgacttcattaatcgagacttacgtgacacacaatacatagccaagaaagcaaaagaaatattatttcaagtaacgaaaaacgtcctaagtacatcaggaagcattacagatcgtttacgcgaagattggggcttagtagatgtcatgaaagaactaaacatgcccaaatatcaatcactaggactcacagaagtggaagaaagaaaagatggaaataaagtgacagtaatcaaaaactggactaaaaggaacgaccacagacatcacgctatggacgcattaacagtagcattcaccaaaccaagctacatacaatatcttaaccacttaaacgcacgtaaagacgaaaataataaaaactactccgtcatactagcaattgaagaaaaagaaacaatcaaagtccgtacgaataatggcaaaaataaaagggtcttcatagaaccgatccccaacttcaggcaagtcgccaagaaacacctagaagaaatttttatctcacataaaactaaaaataaagtagtaaccaaaaacgtaaacaaaccagccggtaccgacaaacaacaaatcacgcttactccccggggacaattacacaaagaaacaatatatggcaaatatcaatattacgtaaacaaagaagagaaaataggggtaaaattcgataaagaaacaatagccaaagtctcaaatccgctatatagagaagcactattgaaaagactacaagctaacgacaatgatcccaagaaagcatttacaggcaaaaacgcattaagcaagaaaccaatctacctagacgaatcgaaaactaaaactctaccagaaaaagtaaatcttacgtatttagaagaagactttagcattagaaaagacattagcccggataatttcaaagacctaaaatctatagaaaaagttatagatcaaggcgtaaaaagaatactaatcaaacgtctccaagcatacgacaatgatcccaagaaagcatttgtcgacctagagaaaaatccaatctggctcaataaagaaaaaggcatcgcaataaaaagagttaccatatccggagtgaacaatgctcagccgctacacataggaaaagaccaccttggtaaaacaacactcaacaaagaaggaaaagaaataccagtcgattatgtaagcacaggaaacaaccaccatgtagcaatttacagagacaaggagggcaacttgcaagagcaaattgtatcattctttgatgcggtggtaagagcccaacaggggcttccaataatcgacaaaacatataaacaagcagaaggatggcaattcatgttcactatgaaacaaaatgaaatgttcgttttcccaaatgaaacaaccggattcaatccggctgaaatcgatttactagatccaaagaataagaaacttatatcacccaatctattccgagtccaaacaatatcggtagtaaaatacggaaactcagtagtccgagacttcaaatttagacatcatctcgaaacaactttacaagatgacaaaatactacagggaattacatttcaacaaattaaatcactagaaccattacgaaacattgtaaaagtcagaatcaaccacctaggagatatagtaagtatcggcgaatattga

SEQ ID NO: 5677 - RNA, 4308 nt, synthetic construct
  misc_feature 1..4308: note = Cas9 variant
  source 1..4308: mol_type = other RNA
atgaaaaacatacttggattagatttaggaactacatcaataggatttgcacatatagtagaagatgaaaataaagaaaaatccgaaataaaagaactcggtgtgcgtatagtatcattagcaacagacgaacaatccgacttcgaaaaaggaaaatctataagcacaaatgcaaaccggacattaaaacatggcgcaagattaaacttagatagatatcaacaaagacgaaaatttcttatagatcttctacaaaaagcgaatctaataacaagtgcaagcatattagctgaaaatggcaaaaatacaacgcattcaacttggcaactccgagcgaaagctgtaaccgaaagaatagaaaaagaagaatttgcaagagttctattagcgataaataagaaacgaggatacaaaaatagcagaaaaactaaaacggaagatgaaggacaagcaatcgacggaatggcgatcgcaaaatgtttatacgatgaaaaccttacaccaggccaactgagcctacaactactacaacaaaacaagaaactactaccagacttctacagatctgacttacaaaaagagttcgatctagtttggaatctccaaaaacaattctatccagatatattaacggattccttctataaagaactccaaggaaaaggaaaagatgcaacatctaaggcgtttagtaaaagatatcatttcgacactgcagaaaacaaaggtagtaaagaatcagttcgactacaagcataccaatggcgagcagaagcaatatcgaaacagcttagtaaagaagaagtagcgtacgtcttgacagaaatcaacaacaaccttaacaacagttccggctacctaggtgctatatctgatagatcgaaagaactctactttaacaggcaaacagttggacaatacctctacgctcaacttcaagaaaatagacataacagcctaaagaataaagtattttaccgacaagattatcttgatgagttcgaaagaatatgggaaacccaggcttcatttcataaagaattaacagatgaactgaaaaagcaaattagagacgtcgtcatcttctatcaacgaaaattaaaaagccaaaaaggacttgtcagcttctgcgaatttgaaagcaaagaaatagaaatagaaaaagatggtaaagccataaccaaaagcataggggcaagagtagtcccaaaatcatcaccattatttcaagagttcaagatatggcaaatactcaataacgtcacttgcaaaagaaaaggcatccgcaagaagaaatcatcggcaaaatccaccgaacttgatctatttaatgaaccttcacaatccatatttagcctagatatggaatgtaaacagttactattcgacgaactaaatctgaaaggcgacctaaaatcagacaaagtactaaaactactcggttactctccccaagagtgggaaattaactataaccagcttgaaggcaacagaactcaaaagagcttatacgaggcttaccttaaaatcatcgaaatcgaaggttatgaagtaaaagacatactccagatcaagtcaacaaaagacgactggagtttagacgaatccccactatcagcgtcagaaattagagagagagtaaaagtcatcttccaaacactagggatttgtaccaaaatactatactttgaccccctactaccagtcaaagaatttgaacaacagtactcataccaactgtggcatctgctctacagctacgaaagcgacgacagtactagcggtaatgaaactctttaccgcatactggagaagaaatacgcatttaaacgagaacacgcaactatactcgcaaacgtagcattacaagacgactacggcagccttagcaccaaagcaataaggaaaatatatccatacataaaagaaaaccaatatagcacggcatgcgaactagctggctataaacacagtaaactatcactaactaccgaagaattagaagccagagaactgaaaaatataataccattactcaagaaaaatgcactccgaaacccagttgttgagaaaatccttaaccagatgataaacgttgtaaacgcattaatcgagaaaaattccgaaagggacgccgaaggaaaaataaccaaatactttcactttgatgaaatacgcatcgaactggccagagaacttaagaaaaacgcccaagaacgatatgaaatgacacagaacataaataaggccaaactagaacaccagaaaatttccgaaaaattacaaaaacaatttggaatcaaaaatcctacaaaaagcgacatcataagatacagattatatcaagaactggaacacaacggatacaaagagctgtacaccaatacatacatcgcaccagacgtcttattcagtaaaaatatagacatcgaacacatagtccccaaagctagggtatttgacgactcattcagcaataagacactggcctttaaagagttcaacataaagaaaggggaaagcacagcttttgattacataacctcactaaattgcgagggtgagctaaaccaataccttacacgagttgaaaacgcatacaaaaccaaatctataagtctaacaaaatataaaaatctactcaagaaagcaagcgaaatcggggacggtttcataaacagagatctaagggacacccaatatatagccaagaaagctaaagagatactctttcaagtcaccaaaaacgtcctgtccacttctggctccataaccgaccgacttagggaagattggggacttgtagacgtaatgaaagaactcaatatgcctaaataccaatcattaggattaacagaagtagaagaaagaaaagacggaaataaagttacagtaataaaggattggactaaaagaaatgatcacagacaccacgcaatggatgcgttaacagtagcatttacaaaaccaagctatatacaatatctaaaccacttaaatgcacgaaaagacgaaaacaacaaaaattacagtgtcatactagccatagaaaagaaagaaacaataaaagtaccaataaacaatggcaaaaacaaaagagtctttatcgaacctatactaaacttccgacaagtggccaagaaacacctagaagagatattcatatcccataaagccaaaaataaagtagttaccaaaaatataaataaacctgccggaaccgacaaacaacaaatcaccctaacccctcgagggcaacttcataaagaaacaatatacggaaaataccaatattatgtaaataaagaggaaaaagttggagtaaaattcgacgaaagaactataacaaaggtaagcaacccattatacagggaagccctactgaaaagacttcaagccaatgataatgatcccaagaaagcatttgccggcaaaaatgcgttaagcaaaaatccaatctaccttgacgaagcaaagacaaaaacattaccagagaaagtaaacttaacatatctagaagaagatttcagtatacgaaaggatatatcaccggacaacttcaaagacctaaaatcaatagaaaaagtcatagaccaaggagttaaaagaatattaataaaacgcttacaagcatacgataatgaccccaagaaagcctttgtggacctcgaaaagaaccccatctggctaaacaaagaaaaaggcatagcaattaagcgcgtaaccataagtggcgtatcaaatgcgcaacccctacatatagggaaagaccacctaggaaaaacgaccttaaataaagaaggcaaagaagtacccgttgattacgtatcgacaggaaataatcaccatgtcgcgatatatagagataaggaagggaatttacaagaacaaatagtcagcttctttgaagcagttgtccgcgcacaacaaggactacctattattgacaaaaattacaaacaggctgaaggatggcaattcatgtttacaatgaaacaaaacgaaatgttcgtattccccaatgaagccaccgggttcaatccagcggaaatagatctacttgaccctaaaaacaagaaattaatatcacccaaccttttcagagtacaaacaatctccattgtaaaatatggaaatagcgtcgtcagagactttaaattcagacatcacttagaaactaccttacaagacgataaaatcttacaaggtattacatttcaacaaataaaatcactagaacctctacgaaatattgttaaagtccgaataaaccatttaggggatatagtcaacataggtgaatattga

SEQ ID NO: 5678 - RNA, 4311 nt, synthetic construct
  misc_feature 1..4311: note = Cas9 variant
  source 1..4311: mol_type = other RNA
atgaaaaggattttaggtctagatttgggaacaaactcaataggatgggcgctagtaaacgaggcagaaaacaaagatgaaagatcttcaatagtcaaacttggagtaagggtaaaccccctaaccgtagacgaattaacaaacttcgaaaaaggaaaaagtataacaactaacgccgaccgaacactcaaacgaggaatgagacgaaatctccaacgatataagttgcgccgtgaaaccctaactgaagtattaaaagaacacaaattaataaccgaagataccatattaagcgagaatggtaataggaccactttcgagacctatagactgcgtgcaaaagcagtaacggaggaaatatcattagaagagttcgcgagggtattactaatgataaacaagaaaagaggttacaaatcgtcgagaaaagcaaaaggagtcgaagaaggaacgctaattgatgggatggatatagctagagaactgtataataataacttgactccgggagaattatgcttacaattacttgatgcagggaagaaattcttaccagacttttaccgaagtgacttacaaaacgaattagatagaatatgggaaaaacagaaagaatactatcccgaaatcctgacagacgtcttaaaagaggagctgagggggaagaaaagagacgcagtctgggcaatatgcgcaaaatactttgtctggaaagaaaattataccgaatggaacaaagagaaaggaaaaacagaacaacaagaaagagaacacaaattagagggaatatactctaaacggaaacgagacgaagccaaaagagagaacctacaatggcgagtaaacggcttaaaggaaaagctaagcctcgaacaactcgtgatagtatttcaagaaatgaatacacaaattaataactcaagcggatatttaggagcaatatcagacagaagcaaagaattatactttaacaagcaaaccgttggacaatatcaaatggaaatgctagacaaaaacccaaacgcctcacttagaaatatggtattttaccgacaagattatttggacgagtttaatatgctatgggaaaagcaggccgtataccataaagaactaaccgaggaactaaagaaagaaataagagacatcataatcttctaccaaaggagattaaaatctcagaaaggtcttatcggcttctgtgagttcgaatcacgccagatagaagtagacatagatggtaaaaagaaaataaaaacagtgggcaatagagttatatcgcgaagtagcccattatttcaagagttcaaaatatggcaaattttaaataacatagaagtcacagttgtaggaaagaaaagaaaaagaagaaagctaaaggaaaactactctgcattatttgaggaactcaatgatgccgaacaacttgaactaaatggatcaagacgtctatgccaagaagagaaagaattattagcgcaagaacttttcgtgagagataagatgacaaaatcagaagttctcaaactcctattcgataatccccaagaactggatttaaactttaaaacgatagacggaaacaagacgggttatgcactctttcaggcttacagcaaaatgatagaaatgtcaggacacgaacccgtcgatttcaagaaaccagttgaaaaagttgtagaatacattaaagcagtattcgatctcttaaactggaacaccgacatattaggatttaattcaaacgaagaattagataatcaatcgtactataaactatggcatctattgtattcattcgaaggagacaacacgccaacaggcaacggcaggctaatccagaaaatgacagaactatatggtttcgaaaaagaatacgcgactatactagcaaatgtcagcttccaagacgactatggaagtctaagcgcaaaagcaattcacaaaatacttccccacttaaaagagggtaacagatacgatgtggcctgcgtctacgcaggataccgccacagcgaatcgagtttgacccgagaagaaattgcaaacaaggtacttaaagatagactaatgctccttcccaaaaattcactccataatcctgttgtagagaaaatcctcaatcaaatggtaaacgtaataaatgtgataatagatatttacggaaaacccgacgaaataagagttgaattagcaagggaattaaagaaaaatgctaaagaacgagaagaactaacaaaaagcatagctcaaacaacaaaagcacacgaggaatacaaaacactactacaaactgagttcggactaacaaacgtatcccgaacggacatattacgctataaactatataaagaactagaaagctgcggctacaaaacattatacagcaatacatacataagtagagagaaactattctcaaaagagttcgacatagaacacattataccgcaagcacgattgtttgacgatagtttctccaataaaaccttagaagctagatcagtaaacattgaaaaaggcaacaatacagcatatgactttgttaaagaaaaatttggagaatctggcgctgacaattctttagaacaatacctaaacaatatagaagatttatttaaatccggaaaaatctccaaaacaaagtacaataaattaaaaatggcagaacaagatataccagatggttttatagagagagatctaaggaacacccaatacatcgccaagaaagccttatcaatgctaaatgaaatctcccatagagtagtagccacatcaggatcagtaaccgataaactacgggaagattggcaacttatagatgtaatgaaagaacttaactgggagaagtataaggcactaggtctagtagagtattttgaggatagagacggaagacaaatcgggagaataaaagattggacaaagagaaatgaccatagacaccacgcaatggatgccctgactgtagcattcaccaaagatgtatttattcaatacttcaataataaaaatgccagcttagacccaaatgcaaacgaacacgcaattaaaaacaaatatttccaaaacggcagagctatagcaccaatgccactaagggagttccgagctgaagcaaagaaacacttagaaaatactttaatatcgataaaagctaaaaacaaagtaataactggaaacataaataaaacaaggaagaaaggaggagtaaataaaaacatgcaacaaactccaagaggacaattacacttagaaacaatttatggaagcggaaaacaatatcttacaaaagaagaaaaagttaacgcatccttcgatatgagaaaaatcggcacagtatctaaaagcgcatacagggacgcattattaaaaagactatacgaaaatgacaatgacccgaaaaaggcgtttgctggcaaaaacagtctagacaaacaacccatctggcttgacaaagaacaaatgcgcaaagtaccggagaaagtaaaaatagtaactttagaagctatatacacgatcagaaaagaaataagtccagatttaaaagtagataaagtaatcgacgtcggagtaagaaaaatactaattgatcgactcaacgagtatggaaacgatgcaaagaaagccttctcaaacctagacgaaaaccctatatggcttaacaaagagaaaggtataagtatcaaaagggtaacgataagtggcatctcaaacgcacaatcattgcacgtaaagaaagacaaagatggaaaaccaatactagacgaaaatggcagaaacattcccgtagacttcgttaatacagggaataaccaccatgtagcagtatactatcgtcccgtcatagataaacgtggccaacttgttgtagatgaggcaggaaatcctaaatacgaactcgaagaggtggtagtgagcttcttcgaggctgtaacacgagcaaacttgggacaaccaataatagataaagactacaaaacaacagaaggctggcaattcctattcagtatgaaacagaatgaatattttgtatttccaaatgagaaaactggatttaaccccaaagaaattgatttgctagacgtagaaaactacggactaataagtccgaacctatttagagtccaaaagttctcactcaagaattatgtattccgccatcacctagaaacaacaataaaagatacaagttcaattttaaggggaataacctggatagatttcagaagctccaaaggactagatactattgtgaaagtaagagtaaaccatataggtcaaatcgtctccgttggcgagtattga

SEQ ID NO: 5679 - RNA, 4311 nt, synthetic construct
  misc_feature 1..4311: note = Cas9 variant
  source 1..4311: mol_type = other RNA
atgaagcgaatactaggactagacttaggaacgaatagtattggatgggcacttgtaaacgaagcagaaaataaggatgagagatcgtcgatagtaaaactcggagtacgagtaaatcccctaacagtagacgaattaacgaacttcgaaaaaggaaaatctataaccacgaacgcagaccgaaccctcaaaagaggaatgagaagaaatctgcaaagatataagctaagaagggagacattgacagaagtgttaaaagaacacaaactcataaccgaagacaccatactgagtgaaaatggtaacaggactactttcgagacatatcgacttagagcaaaagctgtaactgaagaaataagtttagaggagttcgccagagtactactaatgataaataagaaaagaggttataaaagttcaagaaaagccaaaggcgttgaagaaggtacgctaatcgacgggatggacatagcaagagaattatacaataacaacctaacccccggggaattgtgtctacaactactagacgcaggaaagaaatttctaccagacttttatagaagcgatcttcaaaatgaattagacagaatatgggaaaaacaaaaagaatattatcctgaaatactaacagatgttttgaaagaggaactacgaggaaagaaacgagacgcagtatgggcaatctgcgcaaaatatttcgtatggaaagaaaactacaccgaatggaacaaagagaaaggaaaaaccgaacaacaagaacgagaacataaattggagggtatatatagtaaacggaaacgagatgaggcgaaacgagaaaacttacaatggcgagtaaatggactgaaagaaaaactttcactggaacagttagtcatagtattccaagaaatgaatacacaaatcaacaatagttcaggttacttgggagcgatatcagacaggagtaaagaactttattttaataagcaaaccgtcggacaatatcaaatggaaatgctcgacaaaaatcctaacgcttctcttagaaacatggtcttctatcgacaagactatttagacgaatttaacatgctctgggagaagcaagcagtatatcataaagaattaaccgaagaacttaagaaagaaattagggatatcataatattttaccaaaggcgcttgaaatcacaaaaagggcttattggattctgtgaatttgaatctagacagatcgaggtagacattgacggaaagaagaaaataaaaacagtaggcaaccgcgtcatctcccgttcttcaccactatttcaagagttcaaaatctggcaaatattaaacaatatagaagttactgtagtaggaaagaaacgaaaaagaagaaaattaaaagaaaattattctgcactcttcgaagaattaaacgatgccgagcaattagaactaaatggatcacgcagactctgccaagaagaaaaagaacttttagcacaagaactgtttataagagataaaatgacaaaaagcgaagtattaaaattactattcgacaatccacaagagttagacctcaactttaaaacaattgatggaaataaaacaggatacgcattatttcaggcttacagcaaaatgattgaaatgtcaggacatgaaccagtagactttaagaaaccagtagaaaaagtagtagaatacataaaagcagttttcgacctcttgaactggaatactgacatactcggatttaacagcaacgaagagttagataatcaaccatactataaactatggcacctgttatacagttttgaaggagacaataccccgacaggaaacggcagactcatccagaaaatgacagaactatacgggttcgaaaaagaatatgcaaccatattggcaaacgtaagttttcaagatgattatggatcattatccgcaaaagcaattcataaaattctaccacacctgaaagaaggaaacaggtatgatgttgcatgcgtatacgctggctatcgtcacagtgagagctctctcactagagaagaaatcgcaaataaagtactaaaagatcgattaatgttattgccgaaaaactccctgcataacccagtagtagagaaaatactaaatcaaatggtaaatgtaatcaatgtgataattgacatatatggtaaaccagatgaaatcagagtagaactcgcaagagaacttaagaaaaatgcaaaagaacgggaagaactcaccaaaagtatagcacaaacaacgaaagcccacgaagaatataaaacgcttctacaaacagagttcggcctaacgaatgtaagtagaacagacatcttaagatacaaactatataaagaattagaatcgtgcggatacaaaacattatatagcaacacatacatatcccgtgaaaaactgttctcaaaagaatttgatatagaacacataatacctcaagcacgcttatttgacgactcattctcaaataaaacacttgaagcaagatcggtaaacatagagaaaggaaataaaacagcctatgatttcgtcaaagaaaaattcggagaatcaggagcagataattccctagagcactatttaaataacatcgaagacctatttaaaagtggaaaaatttcaaaaacaaaatataataaattaaaaatggcagaacaagacatacccgacggatttatagagagagacctaagaaatacacaatatattgccaagaaagccctgtccatgctaaatgaaatatctcatagagtagttgccacatcaggaagcgtaacagacaaactgcgagaagattggcaactaatagatgtaatgaaagaacttaattgggaaaaatataaggcccttggacttgttgaatattttgaggacagagatggtagacaaataggaagaataaaagactggacaaaaagaaatgaccataggcatcatgcaatggatgcactaactgtcgctttcacgaaagatgtttttattcaatattttaataacaaaaatgcaagcctcgacccaaacgcaaacgaacatgcaatcaaaaataaatactttcaaaatggcagagccatcgcacctatgccgctaagagaatttcgagcagaagctaagaaacacttagaaaacactttgattagcataaaagcgaaaaataaagtaataacgggaaatataaataagacccgcaagaaaggaggagttaacaaaaatatgcagcaaacacccagaggtcaactccaccttgaaacaatttacggaagcgggaaacaatacttaaccaaagaagaaaaagtaaatgcatcattcgacatgcgcaagattggaacagtatccaaaagcgcatatcgtgacgcattattaaaaaggttgtacgagaatgacaatgacccaaagaaagccttcgctggtaaaaatagcctcgataagcaaccaatctggctagataaagaacaaatgagaaaagtacccgaaaaagtgaaaatagtaacccttgaagcaatatacacaatacgaaaagaaattagcccggacttaaaagtcgacaaagttatagatgtaggcgtaagaaaaattctaatcgaccgactaaacgaatatggaaatgacgctaagaaagcgtttagcaacttagacaaaaacccaatatggttaaataaagaaaaaggaatatcgataaaaagagtaacaattagcggcatctctaatgcacaatcgttacacgtcaagaaagacaaagacgggaaacctatactagatgaaaacggtcgaaacataccagtcgacttcgtaaacacaggtaacaatcaccacgtagcagtatattaccgaccagtaatcgataaaagaggacaattagtagtcgatgaagctggaaacccgaaatacgaactagaagaggttgttgtaagtttctttgaagccgtaactagagcaaatctgggtctcccgataatagacaaagactataaaacaacagaaggctggcagttcttgttttctatgaaacaaaatgagtatttcgtcttcccaaacgagaaaaccggatttaatccaaaggaaatagacctactagacgtagaaaactatggtctaatctcgccaaaccttttccgagtccaaaaattttcgctcaaaaactatgtgtttcgacatcacctagaaacgacaattaaggacaccagttctatactaagaggtataacatggatagatttccgatcatcaaaaggactagacacaatagtaaaagtaagggtcaatcatataggccagatcgtaagcgtaggagaatactga

SEQ ID NO: 5680 - RNA, 4311 nt, synthetic construct
  misc_feature 1..4311: note = Cas9 variant
  source 1..4311: mol_type = other RNA
atgaagaggattctaggactagatttaggcactaattcaattggatgggcactcgttaacgaagcggaaaataaagatgaaagaagttcaatagttaaattgggcgtgagagttaacccactcacagtagacgagctaacaaactttgaaaaaggcaaatcaatcaccacaaatgcagaccgaacattaaaacgcggcatgagaaggaatctgcaaagatacaaattaaggagggaaacattgacagaagtattaaaggagcacaagctaatcacagaagataccatattgagcgagaatggcaatcgaactacatttgaaacatacagattaagagctaaagcagtcacagaagaaataagcctcgaagaatttgccagagtgttattaatgataaacaagaaaagaggatacaaatcgagtcgaaaagccaaaggagtagaagaaggtaccctgatcgacggaatggatatcgctagagagttatacaataacaatctaacgcctggagaattatgtctgcaattactcgacgcaggcaagaaattcttacctgacttctatagatcggatctacaaaatgaattagacagaatttgggaaaaacaaaaagaatattatccagaaatacttacagatgtcttaaaagaggaactacgaggcaagaaaagagatgcagtctgggccatatgcgcaaaatacttcgtttggaaagagaactatacggagtggaataaagaaaaaggaaaaacagaacagcaggagcgagaacacaagctagagggaatttatagcaaaagaaagcgggacgaggcaaaacgagaaaatttacagtggcgagtaaacggactaaaagaaaaattgagtctggagcagctagttattgtattccaagaaatgaacacccaaatcaacaacagttccggatacttaggagcaataagtgatcgaagtaaagaattatatttcaataaacaaacagttggtcaatatcaaatggaaatgctagataaaaatcctaacgcgagcctaagaaacatggtattttatcgacaagattatctggacgagttcaacatgttatgggaaaaacaagcagtctaccataaagaattaacagaagaacttaagaaagaaatacgcgacatcataatattctatcaaagaagattaaaatcacaaaaaggattaatcggattctgcgaatttgaatcccgacaaatagaagtggacatagacggaaagaagaaaatcaaaaccgtaggaaacagagtcatatcacggtcctcaccacttttccaagaatttaaaatatggcaaatacttaacaacatagaagtcacagtagtaggaaagaaaagaaaaagacgtaaactaaaagaaaattacagtgcattgtttgaagaattaaatgatgcagaacaattggaactaaatggctcaagacgcctatgtcaagaagagaaagaactattagcacaagaattgttcatacgagataaaatgactaaaagcgaagttcttaaactactctttgacaatccacaagagctcgatttgaacttcaaaactatagacggaaataaaacaggctacgcattatttcaggcttactcgaaaatgatagagatgagtggacacgaaccagttgattttaagaaacctgttgaaaaagttgtagaatatattaaagcggtctttgatctgttaaattggaatacggatatcctaggttttaactcaaacgaagaactagataaccaatcatattacaaactatggcatctactgtactccttcgaaggagataacactccaaccggaaatggaagactcatacagaaaatgacagaactatatggattcgaaaaggaatacgcgacaatattagcgaatgtcagtttccaagacgactacggatcactctcagcaaaagccatccacaaaatacttccacacttaaaagagggaaatagatacgacgtagcatgcgtctacgcaggataccggcattcggagtcgtcactaacaagagaagagatagcaaacaaagttttaaaagatagattaatgttattacctaaaaattctctgcataatccagtagtagagaaaatcctaaaccaaatggtaaatgtaataaatgtaataatcgacatatacggaaaaccagatgaaataagggttgaattagctcgagaattgaagaaaaacgcgaaagaacgagaggaattgaccaaatcaattgcacaaacaaccaaagcccacgaagaatataaaacattactgcaaaccgagttcggcttaacaaatgtttcaaggacagacattttaagatacaaactctacaaggaactggaaagctgcggatacaaaacattgtattcaaacacatacattagtagagaaaaactgttttctaaagaatttgatattgaacacataattcctcaagcgagactatttgacgattcattctcaaacaaaacattagaagcaagaagcgtaaatatagagaaaggaaataaaacggcctacgactttgtaaaagaaaaattcggagaaagtggagccgataactcactggagcactatctaaataacatagaggatctatttaaaagtggcaaaatctcaaagacaaaatacaataaactaaaaatggctgaacaagacatcccggatggtttcatcgaaagagacttaagaaacacccaatatatagccaaaaaggcgttatcaatgctaaacgagatatcacaccgcgttgtagctacatctggctcagttacagataaattaagggaagattggcaattaatagacgtaatgaaagaattaaattgggaaaaatacaaagcattaggattggtagaatattttgaagacagagatggtaggcaaataggtagaataaaggattggaccaaaagaaacgaccaccgacatcatgcaatggatgcattaacagtggcatttacaaaagacgtatttattcaatatttcaataacaagaacgccagcttagacccgaatgccaacgaacacgcaatcaaaaacaagtactttcaaaatggacgtgccatagcgccaatgccattaagagagttcagagctgaagctaaaaagcatctagaaaatacactaataagcataaaagccaaaaataaagtcataaccggaaacattaataaaacacgaaagaaaggtggtgtaaataaaaatatgcaacaaactcctagagggcaattgcatctcgaaacaatatacggctcgggaaaacaatacttaactaaagaagagaaagtcaacgcatcatttgatatgagaaaaatagggacagtatctaaattagcatatagagacgctttacttaaaaggttatatgaaaacgacaacgacccaaagaaagcattcgcaggcaaaaattcactagataaacaacccatatggctcgataaagaacaaatgcgaaaagtacccgaaaaagtaaaaatagtaacattagaagctatatatactataagaaaagaaatcagcccggatctcaaagtcgataaggttatagacgtcggagttagaaaaatattaatagacagactgaatgaatatggtaacgacgctaaaaaggcattcagtaatttggatgaaaacccaatatggttgaataaagaaaaaggaatcagtataaaacgagtaacaataagcggaataagtaacgcacaatcattacacgtaaagaaagataaagatggaaaacctatattagacgaaaacggaagaaacataccagtagatttcgtcaatacaggcaataatcatcacgtcgcagtatattacagaccagttattgacaaaagaggacagctagtcgtggatgaagcaggtaacccaaagtatgaattagaagaagttgttgtatcctttttcgaggccgtgacacgagcaaatttaggtcaaccaataatagataaggattataaaactaccgaaggatggcaattcctatttagcatgaaacaaaatgaatactttgtttttccaaacgagaaaacaggattcaatccgaaagaaattgatctgcttgacgtggaaaattacggattaataagtcctaatttattccgagtacaaaaattctcactaaagaattatgttttccgacatcacttagaaaccacaataaaagatacaagtagcatactcagagggattacttggatagattttagaagtagtaaaggcctagatacaatagtaaaagtaagagttaatcacataggacaaatagtaagtgtgggggaatattga

SEQ ID NO: 5681 - RNA, 4311 nt, synthetic construct
  misc_feature 1..4311: note = Cas9 variant
  source 1..4311: mol_type = other RNA
atgaaaagaatattgggactagatctcggaactaattcaataggatgggctcttgttaatgaagcagagaataaagatgaacgaagttcaatagtcaagctaggtgtacgggtaaatccactcacggtcgatgaactaacgaacttcgaaaaaggcaaatcaataaccacaaatgcagatcggacactaaaaagggggatgcgacgaaatttacaacggtataaactcagaagagaaacattaacagaagttttaaaagaacacaaattaatcacagaagacaccatactaagcgagaacggcaacagaaccactttcgaaacatatagattaagagcaaaagcagtaacagaagaaataagtctagaggaatttgccagagttttactgatgattaataagaaaagaggctataaaagtagccgaaaagctaaaggagttgaagaagggaccttgatagacgggatggatatagcaagagaactatacaacaacaacttaacacccggagaactttgtctccagcttttggatgcaggcaaaaagttcttacctgacttttacagaagcgacctccaaaacgaactcgatcgaatatgggaaaaacaaaaagaatattaccctgagatcctaactgatgttcttaaagaagaattaagaggaaagaaaagagatgccgtatgggccatatgtgccaagtatttcgtatggaaagaaacatacacagaatggaacaaagaaaaaggaaaaacagaacaacaggaaagagaacataaactagagggaatttacagcaaaagaaaaagagatgaagcaaaacgagaaaatttacaatggagagttaacggactaaaagaaaaactaagtttagaacagctagtaattgtttttcaagaaatgaacacacaaatcaataattcatcaggatatctaggggcaatttcagatcgttcaaaagaactctacttcaataaacaaaccgtcggacaataccagatggaaatgttagacaaaaatccaaacgcatcactcagaaatatggtattttatcgtcaagattatttagatgagttcaatatgctctgggaaaaacaggcagtttaccacaaggaacttactgaagaattaaagaaagagattagagatatcataatattctatcaaagaagattgaaaagtcaaaaagggctaataggtttctgcgaatttgaaagtaggcaaatagaagtagacatcgacggaaagaagaaaataaaaacggtaggtaacagagtaataagcagatccagtccgctatttcaggagtttaaaatctggcagatattaaacaacatagaagtaaccgtcgttggaaagaaaagaaaacgcagaaaattgaaagaaaattactcagcgatattcgaagaactaaatgatgccgaacaactagaattaaacggaagccgaagattatgccaggaagaaaaagaactattagcacaagaactatttgtacgagataaaatgaccaaaagtgaagtacttaaactattatttgataacccacaggaattagacctaaactttaaaacgatcgacggtaacaaaacaggttacgccttatttcaagcctattcaaaaatgatagaaatgtcaggacacgaaccagtcgacttcaagaaaccagtcgaaaaagtagtggagtatataaaagctgtatttgacctattaaattggaacacagatatactaggatttaactcaaacgaagaactggacaaccaatcctattacaaattatggcacttactctacagttttgaaggagataatactccaacaggtaatggacgtttaattcagaaaatgacagaattatacggtttcgaaaaagaatacgccacaatattagccaatgtgtcatttcaagacgattacggaagtctatcagccaaggctatacacaagatattgccacacctgaaggaaggaaatagatatgacgtagcttgcgtatatgccggttaccgccattctgaaagctcacttacacgagaagaaatcgcgaataaggttttaaaagatagactcatgctacttcctaaaaattcgcttcataatccagtagtcgaaaagatattaaatcaaatggtcaatgtcattaacgtaataatagacatttacggaaaaccagacgaaatacgcgttgaattagcacgagagttaaagaaaaacgcaaaagagagagaagagttaaccaaaagtatagcacaaacaacgaaagctaatgaggaatataagacactactacaaaccgaatttggcctcacaaacgtaagccgaactgacatcctacgttataaactatataaagaattagaaagctgcggttataaaacgttatactcgaacacttatatatcaagggaaaagctattttccaaagagttcgacattgaacacattatcccacaagcacgactgttcgatgactcgttttcaaataaaactttggaagcccgatcagtaaatatagaaaaaggcaataagacagcatacgacttcgtaaaagaaaaattcggcgaatctggagctgataacagcctagaacattatctaaacaacatagaagatctgttcaaatcaggtaaaataagtaaaaccaaatataataaactaaaaatggcaaaacaagatataccagatggatttattgagagagatctgaggaatactcaatatatagccaagaaggccttaagcatgctcaacgaaatatctcacagggtcgtggcgacatcaggttccgtaacagataaattaagagaggactggcaattaattgacgtaatgaaggaactcaattgggaaaaatataaagcattgggtttggtggagtacttcgaagatagagatggacgacaaatcggaagaatcaaagattggacaaaaagaaatgatcatcgacaccatgcaatggacgccctaacggtagcttttaccaaggatgtttttatacaatacttcaataataaaaatgcgagtttagacccaaatgctaacgaacacgctattaaaaacaaatactttcaaaatggacgtgccatagcaccaatgccactgcgagaatttagagcagaagcaaagaaacacctagaaaacactctaataagtataaaagcgaaaaataaagtaataacaggtaacataaacaaaacaaggaaaaagggaggggtaaacaaaaacatgcaacaaacaccaaggggccaactgcatctcgaaacgatttacgggtcaggaaaacaatacctaacaaaagaagaaagagtcaacgccagcttcgatatgagaaaaatcgaaactgtttcgaaaagcgcatatagagacgcattactgaaaagactatatgagaatgacaatgaccccaagaaagcatttgcaggtaaaaatagcctagataaacaaccaatatggctagataaagaacaaaaacgaaaagtacccgaaaaagttaaaatagtaactttagaggcaatctatacaatcaggaaagaaataagcccagacttgaaagtcgataaagtaatagatgtgggagttagaaaaatcctaatagacagacttaatgaatatgggaatgatgcaaagaaagcatttagcaatttagatgaaaatccaatctggctaaacaaagaaaaaggtataagtataaagcgagtgacaataagtggaatatcaaacgcacaatccctacatgtaaagaaagacaaagatggcaaacccattttggatgaaaacggtagaaacataccggttgattttgtaaatactggtaacaaccatcatgtagcagtttattataggcccgtaatcgataaacgagggcaactggtagtagacgaagcaggaaacccaaaatatgagctagaagaagtggtagttagtttcttcgaagcagtgactagggctaatctggggcaaccaataattgacaaagattacaaaaccacagaaggatggcaatttcttttcagtatgaaacaaaatgaatattttgtattccctaatgagaaaactggattcaaccccaaagaaatagacttattggatgtagaaaattatggcttaatctctccaaatttattcagagttcaaaaattctcactgaaaaattatgttttccgacaccacctcgaaacaacaataaaagataccagttcaatcctaagaggaatcacctggatagattttagatcaagtaaaggcttagacaccatagttaaagtaagagtcaatcacatcggacaaatagtcagcgtaggagaatactga

SEQ ID NO: 5682 - RNA, 4311 nt, synthetic construct
  misc_feature 1..4311: note = Cas9 variant
  source 1..4311: mol_type = other RNA
atgaaacgtatacttggtctagacctgggaaccaactctatcggatgggcgctagtgaacgaagcagaaaataaagatgaacgaagctcaatagttaaactgggagtaagagtaaacccactcacagttgatgaactaactaactttgagaaaggaaaaagcataaccactaacgcagataggacattgaaaaggggaatgaggagaaatctacaaaggtacaaactgagacgcgaaaccctaaccgaagtactaaaagaacacaaattaatcaccgaagacacaattctctcagaaaacggtaatagaactacattcgaaacatatcgacttagagcaaaagcggtaaccgaagaaatctcattagaagagttcgctcgtgttttactgatgattaataagaaacgaggttataaatcctcaagaaaggctaaaggcgtggaagaaggaacacttatagacggcatggatatagcgcgcgaactatacaataataacctgacacccggagaactctgcttacaacttttagacgctggtaagaaattcctacctgacttttataggagtgatttgcaaaacgaactcgatagaatatgggaaaaacaaaaagaatattatccagaaatattaaccgatgttcttaaagaagaattacggggaaagaagcgagacgcggtatgggcaatatgtgccaaatactttgtatggaaagagacttatacagaatggaataaagaaaaaggaaaaaccgagcaacaagaaaaagagcacaaattagagggcatatactcaaaaagaaagcgagatgaagcaaaacgggaaaacttacaatggcgagtgaatggcctcaaagaaaaactaagtctagaacagctagtaatcgtattccaagaaatgaacacccaaatcaacaactcaagtggatacctaggtgcgatcagtgataggagtaaagaactatattttaataagcaaacagtaggacaataccaaatggagatgctggataagaatccaaacgcatcgttaaggaatatggtattctacagacaagactacctcgacgagttcaatatgctgtgggaaaaacaagcagtataccataaagaactaacagaagaactcaagaaagaaattcgagatattatcatattttaccaaagaagactgaaatcacaaaaaggacttattggattctgtgaatttgaaagtcgtcaaatagaagtagatatcgatggaaagaagaaaataaaaacagttggaaatagagtaataagtagatcatctccactattccaagagttcaaaatctggcaaatattaaataatatagaagttacagtcgttggcaagaaacgaaaaagaagaaaactcaaagaaaactatagtgcacttttcgaagaacttaatgatgccgaacaacttgaactaaacggaagcagaagactatgtcaagaagaaaaagaattactcgcacaagaactattcatacgagacaaaatgacgaaaagtgaagtactaaaattattattcgataacccacaagaactagatctaaacttcaaaaccatagacggaaataaaactgggtatgcgctgtttcaagcgtattctaaaatgatagaaatgtcaggacatgaacctgtagattttaagaaacccgtcgaaaaagtggttgaatatatcaaggccgtgttcgacttactaaattggaatactgacatattaggatttaacagcaacgaagaactagacaatcagtcgtactataaactctggcatctattatacagcttcgaaggagataacacaccaacaggaaatggccgcctcatccagaaaatgacagagctatacgggttcgaaaaagagtacgcaacaattctagcgaacgttagttttcaagatgattacggttctctgtcagcaaaagcaatacataaaatattgccacatctaaaagaaggaaaccgatatgacgtagcatgcgtttacgccggatacaggcattcagaaagttcactaacaagagaagaaatagccaataaagttttaaaagacagattaatgctattacctaagaactcacttcataatccagttgtggagaaaatattgaatcaaatggtaaacgtcattaatgtaattatagacatatacggcaaacccgatgaaatacgcgtcgaattagcaagggaactgaagaaaaacgcaaaagaaagggaagaattgaccaaaagcattgcccaaaccacaaaagcacatgaagaatacaaaacgctattacaaactgagtttggactaaccaacgtttcgagaacggacatactaagatacaaattgtataaagaattagaaagttgtggttataaaacactatacagtaacacttacatatcaagagaaaaactattctcaaaagaatttgatatagaacacataataccacaagctagactattcgatgactcatttagtaataaaacactggaagcaagaagtgtaaacatagagaaagggaataaaactgcgtacgacttcgtgaaagaaaaatttggagagagcggggcagacaattctcttgagcactacttaaacaatatagaagatttattcaaaagcggaaaaatatcaaaaacaaaatataacaaacttaagatggctgaacaagatatccctgatggattcattgaaagagatttaagaaatacgcaatacatagcaaagaaagccctatcaatgttaaacgaaataagccacagagtagtcgcaacaagtggatcagttacagataaactaagggaagattggcaattaattgacgtgatgaaagaactcaactgggaaaaatataaagccttaggattagtagaatacttcgaagatcgcgacggtagacaaataggccgaataaaagattggaccaaaagaaatgaccatcgacatcacgcaatggacgcactaaccgttgcgttcacaaaagacgtcttcatacaatacttcaacaacaaaaacgcaagcctagaccctaacgcaaacgaacatgccataaagaacaaatattttcaaaacggtagagcgatagcacccatgccgttaagagagttccgagcagaagcaaagaaacacttggaaaacactctaataagcataaaggccaaaaacaaggtaataacaggaaacattaacaagacaaggaagaaaggaggcgtaaacaaaaatatgcaacaaacccccaggggacaacttcatctcgaaacaatatatggcagtggtaaacaatacttgacaaaagaagaaaaagttaacgcatccttcgacatgcggaaaataggtacagtaagcaaattagcatatagagacgctctactgaaaagattatacgagaatgacaacgatccaaagaaagcattcgcaggcaaaaacagcttagacaaacaaccaatatggcttgataaagagcaaatgagaaaagtaccagaaaaagtaaaaatcgtaaccttagaggcaatttacacaatacgtaaagaaatatctccggatctcaaagtcgataaagtaattgacgtgggagtaaggaaaatcctgatcgatagactaaacgaatacggaaacgacgcaaagaaggcattctctaacctcgatgaaaaccctatctggttaaataaagaaaaaggaatttcaataaaaagagtgacaatctctggaatatcaaacgcccaatctctccatgttaaaaaggacaaagacggaaagccgattctcgatgagaatggtaggaatatcccagtagactttgtaaatactggtaacaaccatcacgtagcagtttactaccgcccagtaatagataaacgaggacaattagtagtagatgaagcaggaaatccaaaatatgaactagaagaagtcgtagtatcattctttgaagcagtcacacgggccaacctaggacaaccaataattgacaaagactataaaacaaccgaaggatggcaatttctattcagcatgaaacagaatgaatattttgtcttccccaacgagaaaacgggcttcaaccccaaagaaatcgacctgctggacgtcgaaaattacggccttataagtccaaacctattcagggtacagaaattctctctcaagaattacgtattccgacaccatctagaaactacaatcaaagatacatctagtatattacgcggaataacatggatagattttagatccagtaaaggtctcgatacgatagtgaaagtgagagttaaccacataggacagattgtaagtgtgggggaatactga

SEQ ID NO: 5683 - RNA, 4311 nt, synthetic construct
  misc_feature 1..4311: note = Cas9 variant
  source 1..4311: mol_type = other RNA
atgaaaagaatacttggtttagacctagggacaaacagtataggatgggcactcgtaaacgaagcagagaataaagacgaaagaagctctattgtaaaactcggtgtccgtgtcaacccactaactgtagatgaattaacaaacttcgaaaaaggaaagagcataacaaccaatgcggaccgtacactaaaaagaggcatgcggagaaacctacagaggtataaactaagacgtgagacattgactgaagtactaaaagagcacaaattaattacagaagatacaatcctctccgaaaacggaaatcgtacaacgttcgaaacatatcgactacgcgcaaaagcagttactgaagaaattagcctcgaagaatttgcaagagtacttctaatgataaacaagaaaagaggttacaagtcatcccgaaaagcaaagggagtagaagaaggaaccttaatagacggtatggatatagctagagaactttacaacaacaaccttactccaggtgaactctgcctccagttattagatgcagggaagaaatttttaccggacttttacaggtcagacttacaaaatgagttagatagaatctgggagaaacaaaaagagtattatccagaaattttaactgacgtactgaaagaggaacttagaggaaagaaaagagatgctgtatgggcaatatgtgcaaaatatttcgtatggaaagaaaattacactgaatggaataaagaaaaaggaaaaactgaacaacaagagagggaacataaacttgaaggaatctattctaaaagaaaaagagatgaagccaaaagagaaaatttgcaatggagggttaacggcctaaaagaaaaactaagcctagaacaactcgtgattgtttttcaagaaatgaacacacagataaacaactcctcagggtacctaggcgctatctcagacagaagtaaagaactttattttaacaagcaaacagtaggacaataccaaatggaaatgttagacaaaaaccctaacgcatcattaaggaatatggtattttacagacaagattaccttgacgagttcaatatgctatgggaaaaacaagcagtttaccataaagaattaactgaagaattaaagaaagagataagggacataataattttctaccaaagacgtttgaaatcacaaaaaggactcattggattctgtgaatttgaaagtagacaaatagaagtagacattgacggtaaaaagaaaataaaaacagtaggaaaccgagtaataagtagatcatcacccttatttcaagagttcaaaatttggcaaatactcaacaacatagaagtaacagtagttggaaagaaaaggaaacgccggaaacttaaagaaaattacagtgcactatttgaagaacttaatgatgcagaacaacttgaactaaatggaagcagaagattatgtcaagaagaaaaagaattacttgctcaagaactatttatccgggacaaaatgaccaaaagcgaagtgttaaaattactgtttgacaacccacaggaactagacttaaactttaaaacgatagatggtaacaaaactggatacgcacttttccaagcgtattcaaaaatgatagaaatgtccggacacgaacctgtcgactttaagaaaccagtagaaaaagttgtagaatacattaaagcagtattcgacctacttaattggaatactgatatacttggcttcaattccaatgaagaattagacaatcaaccttattacaaattgtggcatctattatacagttttgaaggtgacaatacgcccacaggcaatggaagactgatacagaaaatgacagaactttacggattcgagaaagaatacgcaacaatattagcaaatgtttcattccaagacgattatggatcactctcagctaaagcaatccataaaatcctaccacatctaaaagaaggtaacagatatgatgtagcatgcgtatatgcaggatatagacactcggagtcatcgttaacaagagaagaaattgcgaataaagttttgaaagacagactaatgctattacccaaaaattctctccataatccggttgtcgagaaaatactgaaccaaatggtgaacgttataaatgtcattatcgatatatatggaaaacctgacgaaatacgagtagaacttgcccgagaactgaagaaaaacgcaaaagaacgtgaagaactaactaaaagtattgcccaaacaacaaaagcgcatgaagaatacaaaactctattgcaaacagagttcggattgactaatgtatccagaaccgatatactacgatataaactatataaagaactcgagagctgtggatacaaaacactatatagtaacacatacatatcccgagaaaaactcttttccaaagagttcgatatcgaacatatcatacctcaagcgagattatttgatgatagcttttcaaataaaaccttggaagcaagatcagttaacattgagaaagggaataagacagcatatgacttcgtaaaagaaaaatttggagaatctggtgctgataacagcctagagcactatctaaataatatagaagatctctttaaatcaggaaaaatctcaaaaaccaaatacaataaactaaagatggcagaacaagacataccggacggattcattgaacgagatctacgcaatacacaatacattgctaagaaggctctaagcatgttaaacgaaatatcacatagggttgtcgccaccagtggttcagtaacagataaattaagagaagactggcaattaatagatgttatgaaagaacttaactgggagaagtacaaagcattagggctagtggaatattttgaagaccgcgatggaagacaaattggaaggataaaagactggacaaaacgtaatgaccaccgccatcatgccatggatgcattaacagtagcttttactaaagacgtatttatacaatactttaacaataaaaacgcaagtttagatccaaacgcgaacgaacacgcaattaaaaacaaatactttcaaaatggacgcgccatagcaccaatgccactccgtgagttcagagctgaagcaaagaaacatctcgaaaacaccctaatcagcataaaagccaaaaacaaagttataacaggcaatattaacaaaacaagaaagaaaggaggcgttaataaaaacatgcagcaaacaccaagaggacaactgcacctggaaactatttatggttcaggaaaacaatacttaactaaagaagaaaaagtaaatgcatcctttgacatgagaaaaatcgggacggtcagcaaaagtgcttaccgagatgctttactaaaaagactttatgaaaatgataatgacccaaagaaagcattcgcaggcaaaaatagtctagataaacaaccaatatggttagataaagaacaaatgagaaaagttcctgaaaaagtaaaaatagtaacactggaagctatctatacaataagaaaagaaatatcaagcgatttaaaagtagacaaagtcatagatgtcggagtacgaaaaattttgatagatagattaaatgaatatggaaacgatgcaaagaaagcgttctcgaatctagataaaaacccaatatggttaaacaaagagaaaggtattagtataaaaagagtaaccatatcaggaatctccaacgcacaatctttacatgtaaagaaagacaaagacggtaaacccatactcgacgaaaacggacgaaatatacctgtagatttcgtcaatacaggaaacaaccatcacgtagcagtatactataggccagtaattgataaaagaggacaactggtagtagatgaggcaggtaacccgaaatatgaactggaagaagtagtagtctcgtttttcgaagcagtaacaagagccaatctagggcttccgatcatagataaagactacaagacgaccgagggttggcaattcttattttcaatgaaacaaaatgaatactttgtatttcccaacgagaaaacaggttttaaccctaaagaaattgatcttttggatgtggaaaactacggtcttatttcgccaaacctatttcgtgtacaaaaattcagccttaaaaactacgtgtttagacaccatctagaaacaacaataaaggatacttcttcaatcctaaggggcataacctggatagattttagaagttcaaaaggcttagatactatagtaaaagtccgagtaaaccatataggacaaatagtgtcagtcggcgaatactga

SEQ ID NO: 5684 - RNA, 4311 nt, synthetic construct
  misc_feature 1..4311: note = Cas9 variant
  source 1..4311: mol_type = other RNA
atgaaaagaatactaggcctcgacttagggacgaactcaatcggatgggctctagttaacgaggcagaaaacaaagatgaacgaagcagcatagtgaaactaggagtaagagtaaatcctttaactgtagatgagctaacaaatttcgaaaagggtaaatcaataacaaccaatgcagatagaacattaaaaaggggaatgagacgtaatttacagaggtataaactcagacgcgaaacactaacggaagtcttaaaggaacataaattaatcacagaagacacaatactgagcgaaaacggaaacagaactacattcgagacatacaggctgagagcaaaagctgtaaccgaagaaatttccctcgaagagttcgcacgagtattgcttatgataaacaagaaaagaggatataaaagttctagaaaagctaaaggtgtcgaagaaggtacactaatagatggtatggacatcgccagagaactgtacaacaataacttaacaccgggagaattatgtctccaactcctagatgcgggcaagaaatttctcccagacttttacagatctgacttacaaaatgaactggataggatatgggaaaaacaaaaagaatattacccggaaattctaactgatgtactaaaagaagaactaagaggaaagaaaagagacgcagtatgggccatatgtgcaaaatacttcgtttggaaagaaaattatactgaatggaacaaagaaaaaggaaaaaccgaacaacaggaacgagagcacaaattagaaggaatatatagtaaaagaaaacgagatgaagcaaaacgtgaaaatttacaatggcgagtgaatggactaaaagagaaactttccctggaacagctagtaatagtatttcaagaaatgaatacacaaatcaataattcgagtggatatctaggtgccattagcgatagaagtaaagaattatacttcaacaaacaaacggtgggacaatgccaaatggagatgctcgacaaaaatccaaatgctagtttacgaaatatggtgttttataggcaggattatttagatgagttcaacatgttatgggaaaaacaagcagtttatcataaagaactaacagaagaattaaagaaagaaatacgtgacatcataatattttaccaaagaaggctaaaatcccaaaaaggtctaataggcttttgcgagttcgaaagtcggcaaatagaagtagatattgacggaaagaagaaaataaaaaccgtaggaaatagagtaataagtaggtcatcaccactatttcaagaatttaaaatttggcaaatattaaacaacatagaagttactgtggtgggaaagaaacgaaaaagaagaaaactgaaagaaaactattctgcactattcgaagaactcaatgacgcagaacaacttgaacttaatggatcaagaagactttgtcaagaagaaaaagaactccttgcacaagaattatttatacgagacaagatgacaaaaagcgaggttttaaaattactatttgataaccctcaggagctggacttgaacttcaaaacaattgacggaaataaaacaggatatgcactttttcaggcttattcaaagatgattgaaatgtctggacacgaaccagtagatttcaagaaacctgttgaaaaagttgtagagtatataaaagcagtatttgacttactaaactggaatacggatatcctaggattcaatagcaatgaagaactggacaatcaaccatattataagttatggcacttactatacagtttcgaaggagacaacacaccaactggcaatggaaggttgattcagaaaatgacggaactatacggttttgaaaaagaatacgctactatactcgctaatgtaagttttcaagacgactacggcagcttgtcagctaaggctatacataaaatattaccccatttaaaagaaggaaacaggtatgatgtagcttgtgtttatgctggatatagacatagtgaaagctcgctaaccagagaagaaatagcaaacaaagtgctaaaagacagactcatgctcctacctaaaaattccctacacaatccagtagtggagaaaatactaaatcaaatggtcaatgttataaatgtaataatagacatatacggaaaacccgatgaaataagagtcgaactagcaagagaactaaagaaaaacgcgaaagaaagagaagaattaacaaaaagtatcgcgcaaaccacaaaagcacacgaagaatataaaacactactgcaaacagagttcggactgaccaacgtttcgcgaacagacattctaaggtacaaattatataaagaactcgaatcatgcggctacaaaacactatactcgaatacatacatatcacgtgaaaaactattttcaaaagagttcgacatagaacatataattccccaagccagattattcgacgatagtttctccaacaagaccttggaagcaagaagcgtaaacatagaaaagggaaataaaacagcatatgacttcgtaaaggaaaaattcggcgaatctggagccgataattctctagaacattacctcaataatatagaagatttatttaaaagtggaaaaatatcgaagactaaatacaacaaactgaaaatggcagaacaagatatccctgacggattcatagaacgagatttaagaaacacgcaatacattgccaagaaggctctaagtatgctaaatgagattagtcaccgtgtagttgcaacttctggatctgtaaccgacaaactaagagaagattggcagctaatcgatgtgatgaaagaattaaactgggaaaaatacaaggcgctcggtctagtagaatacttcgaagaccgggacggaaggcaaatcggacgaataaaagactggacaaaaagaaacgaccacagacatcatgctatggatgctttaacagtggccttcacaaaagacgtatttattcaatacttcaataacaaaaatgccagcctagacccaaatgcgaatgaacatgcaatcaaaaataagtattttcaaaacggcagagctatagcacctatgccactgcgagagttcagagcagaagctaagaaacatttagaaaatactctgataagcatcaaagcgaaaaacaaagtaataaccggaaatataaacaaaacacgaaagaaaggaggagtaaataaaaacatgcaacaaacaccgagaggacagttacacttagaaacaatatatggaagcggaaaacaatacttaaccaaagaagagaaagtcaatgcaagtttcgacatgagaaaaataggaacagtaagcaaatcagcataccgggatgcacttctcaaaagattatatgaaaacgataatgatccaaagaaagcattcgccgggaaaaactcgttagacaaacaacctatatggttagacaaagaacaaatgagaaaagtaccagagaaagtaaaaatcgtaactttggaagctatatatacgatcaggaaagaaatttcacccgatttaaaagtagacaaagtaatagacgtaggggtaagaaaaatattaatagatcggttaaacgaatacggaaatgacgcaaagaaagcattttcaaatctagacaaaaacccaatatggctaaataaagaaaaaggaatatcgattaaacgcgtcacgatcagtggaatctcgaatgcacaaagtctgcacgtgaagaaagataaagatggaaaacccatactcgatgaaaacggaagaaatatacccgtagactttgtcaataccggaaacaaccatcatgttgcagtctactacagacctgtgatagacaaacgaggacaattagtagtagatgaggcaggaaatccaaaatacgaattagaagaagtggtagtctcatttttcgaagcggtaacaagagctaatttaggacttccgattatagataaagattacaaaacaacagaaggatggcaattcttattctccatgaaacagaacgagtacttcgtttttccaaatgagaaaacgggatttaatccaaaagaaatagatctgctcgatgttgaaaattacggcctcatctccccaaacttgtttagagttcaaaaattctcattgaaaaattacgtgttccggcaccaccttgaaacaacaataaaagatacgtcgtcaatactcagaggaataacttggattgacttcagaagctcaaaaggattagacactatagtgaaagtacgagtaaatcacataggtcaaatagtatcagtaggcgaatattga

SEQ ID NO: 5685 - RNA, 4311 nt, synthetic construct
  misc_feature 1..4311: note = Cas9 variant
  source 1..4311: mol_type = other RNA
atgaaaaggatattaggcctagacttaggcactaattcaataggctgggccctagtaaacgaagcagaaaacaaagatgagagaagttcaattgtaaaacttggtgttagggttaacccactaaccgtagatgagttaacaaacttcgaaaaaggcaaatcaataaccacaaatgcagaccgtacactaaaaagaggaatgcgtagaaatttgcaaaggtacaaactaagaagggagacactaactgaagtattgaaagaacacaaactaatcaccgaagacaccatactttccgaaaatggcaaccgaaccacatttgaaacgtatcgattaagggcaaaagcagttaccgaagaaatatcccttgaggaatttgcacgagtgctcttaatgatcaacaagaaaaggggttacaaatccagcagaaaagctaaaggagttgaagaaggaacattaatagatggtatggatatcgctagagaattatataacaacaatctaacaccaggagaactatgcttacaactactagacgcaggtaagaaatttcttcccgatttctatagaagcgacctgcaaaacgaactagatcggatttgggaaaaacaaaaagaatattatccagaaatattgacagatgtcttaaaagaagaactaagaggaaagaaaagagatgctgtgtgggcaatctgtgcaaaatacttcgtatggaaagaaacctataccgaatggaacaaagagaaaggcaaaaccgaacaacaagagcgggaacacaaattagaaggaatatacagcaaaagaaaaagggatgaggcgaaaagagaaaatctacaatggagagtaaatgggctaaaagaaaaactcagtcttgaacagctagtaatagtatttcaagagatgaacacgcaaattaataattcatcaggatacctcggagcgatctcagacaggtcaaaagaactatactttaataaacaaacagtaggccaataccagatggaaatgcttgataaaaaccctaatgcatccctccggaacatggttttctatagacaagactacttagatgaatttaatatgctgtgggaaaaacaagcagtctaccataaagaactaactgaggaactgaagaaagagatcagagatattataattttctaccaacgtagactcaaaagccaaaaaggattaataggattttgcgagttcgaaagtcgacagattgaagtagacatagatggtaagaagaagataaaaacagtaggaaatagggtaatatcgcgatcatctccactatttcaagagttcaaaatttggcaaattttaaataacatagaagtaaccgttgtaggaaagaaaagaaaacgaagaaaacttaaagaaaattactcagctatctttgaagaactaaatgatgcagaacaattagaactaaatggttcacggcggttatgccaggaagaaaaagaactactcgcgcaagaattattcgttagagacaagatgacaaagagtgaagttctaaagttactcttcgataatccacaggaacttgacctaaacttcaaaactattgacggaaacaaaacaggatacgcactattccaagcatactcaaagatgattgaaatgtctggacatgaaccagtagactttaagaaacccgttgaaaaagttgtggaatatataaaagcagtttttgatctattgaactggaatacagatatattaggttttaattcaaacgaagaacttgacaaccaatcgtactacaaactttggcatctgctatacagcttcgaaggggataatacgcccacaggaaatggtagactaatccagaaaatgaccgaattgtatggattcgaaaaagaatatgcaacaatcctggcaaacgttagcttccaggatgactacggaagtttatcagccaaagctatccacaaaatactaccacacctaaaagaaggaaacagatacgatgttgcttgtgtctatgctggatatagacattcagaaagttcccttacaagggaagaaattgccaataaagtattaaaggacagactaatgttactacccaaaaacagcctgcataatccggtagttgaaaagatactcaaccaaatggtaaacgtaatcaatgttataatagatatatacggaaaacctgatgaaattagagtagaattagcgcgagaactgaagaaaaatgcaaaagaaagagaagagttgacaaaatcgatagcacaaacgacaaaggcaaacgaagaatacaaaaccctattacaaacagaatttggattgaccaatgtaagtagaactgatattttacgatataagttatataaagaattggaaagctgtggttataaaacactatatagcaatacatacatttcacgagaaaaactatttagtaaagagttcgatatagaacatataataccgcaagctagactatttgatgattctttcagtaacaaaacattagaagctcgctcagtaaatatagaaaaaggaaataaaaccgcatacgatttcgtcaaagaaaaatttggagaatccggcgccgataacagtttagagcactaccttaacaacattgaagacctattcaaatcaggaaaaatatcgaaaacaaaatacaacaagttaaaaatggcagagcaagatataccagacggatttatcgaacgagatttacgaaacacacaatatatagccaaaaaggcactatcaatgctcaatgaaataagtcatcgagtagttgcaacatcaggaagtgtaacagataagttaagagaagattggcaactaatagatgtaatgaaagaattaaattgggaaaaatacaaagcactcgggctcgtagaatacttcgaagacagggacggacgccaaataggcagaatcaaagattggacgaaaagaaatgaccaccgacaccacgccatggacgctctaaccgtggccttcacaaaagatgtttttattcaatatttcaataacaaaaatgcaagccttgacccaaacgcaaacgagcacgcgatcaaaaacaaatacttccaaaacggtagagcaatcgcgccaatgccactacgagagttccgagctgaagctaagaaacatctagaaaacactctaataagtataaaagccaaaaataaagtcataactggaaacataaacaaaacaagaaagaaaggaggagtaaacaaaaacatgcaacaaaccccacgaggacaattacatttagaaactatatatggaagtggaaaacaatacctaacgaaagaagaaaaagtcaacgccagctttgatatgagaaaaatagaaacagtaagtaaatcagcatatagagacgcactcttgaaaagactatatgaaaatgataatgatccaaagaaagcatttgcggggaaaaactcactagataaacagccaatatggctagataaagagcagatgagaaaagtccctgaaaaagtaaaaatagtgacattagaagccatatatacaataagaaaagaaataagccccgacttaaaagtagacaaagttatagatgtaggtgtccgaaaaatcctaatagacagattgaatgaatacggaaacgacgcaaagaaagccttcagtaatcttgataaaaacccaatatggctaaataaagaaaaaggcatatcaatcaaacgagtaactatttcaggcataagcaatgcacaaagtttacacgtaaagaaagacaaagatggaaaaccgatattagatgaaaacggaagaaatataccggttgatttcgtaaacacaggaaataatcaccacgttgcagtgtactatcgaccagttatagataaacgaggccagctagtcgtcgacgaagcgggtaaccctaaatacgaattagaggaagtagttgtatcattctttgaagcagtaacacgagcaaatctaggattaccgatcatcgataaagactataaaacaactgagggctggcaatttctgtttagtatgaaacaaaacgaatatttcgtcttcccaaatgagaaaatcggctttaacccaaaagaaatagatctactcgatgttgaaaactacggattaatctcgccgaatttattcagagtacaaaaatttagtttaaagaactatgtatttcgccatcacctagaaacgacaattaaagacacatcatcaattctaagaggaataacatggattgacttccgatcatcgaaaggtctcgatacaatagtaaaagtgagggtgaatcacataggccaaatcgtaagtgtcggcgaatattga

SEQ ID NO: 5686 - RNA, 4311 nt, synthetic construct
  misc_feature 1..4311: note = Cas9 variant
  source 1..4311: mol_type = other RNA
atgaaaaggatattaggactagacttaggcactaattcaattggctgggcattggtcgatgaagcagaaaataaagacgaacgaagtagtatagtaaaactaggagttagagtaaatccactcacagtagacgaactaacaaatttcgagaaaggaaaaagtataacaacgaacgccgacagaacattaaagagaggaatgagacgaaaccttcaacgatacaaactcagaagagaaacactaatggaagtactcaaggaacacaaattaattacggaagacactattctgtccgaaaatggtaaccgaacgacatttgagacttatagactaagagcaaaagccgcaactgaaaagatatcactcgaagaatttgccagggtactactgatgataaataagaaaagagggtacaaaagttgtagaaaagccaagggtgcagaagaaggcacattaattgacggaatggacattgccagagaactgtataacaataacttaactccaggagaactatgtcttcaactattagatgcaggtaaaaagtatttaccagatttttatcgaagtgacctgcaaaatgaactagaccgaatttgggaaaaacaaaaggaatactaccctgagatattgaccgaagtactaaaggaagaactacgcggtaagaaaagagatgcagtgtgggcaatatgcgcaaaatcattcgtttgggaagaatactataccgaatggaataaagaaaaaggaaaaaccgaacaacaagaaagagaacataaattagaaggaatttacagcaaacgcaaacgtgacgaagctaaacgcgaaaatttacaatggagagttaacggcctaaaagaaaaactctctttagaacaattagtaatagtattacaagaaatgaatatacagataaacaactctagcggatatttgggtgccatatctgatagatcgaaagaattatacttcaacaaacaaactgtaggacaatatcaaatggagatgttagacaaaaaccctaacgcatcattaagaaatatggtcttttaccgacaagactacttagacgaatttaacaccctttgggaaaaacaagcagaataccacaaagaattgactggagaactaaagaaagaaattagagacatagtcatattctaccaaagaagactaaaatcacaaaaagggttagtagggttttgcgagtttgaatctagacaaatagaagtagagatagatggaaagaagaaaataaaaacagtagggaatcgcgtaatacctcgctcaagtccattatttcaagagttcaaaatatggcaaatattaaacaacatagaagtaaccgtcgtaggaaagaaaggaaaacgccgtaaacaaaaagacaattcaccaacactgtttgatgggttagatgatactgaacaacttgaattgaacggatccagatatctgtaccaagaagagaaagaattactcgcccaagaactattcgtaagagacaaaatgaccaaaagtgacgttttaaaactactatttgacaacccacaggaattagacttaaacttcaaaacaatagacggtaataaaacaggctacacactatttcaagcatattcaaaaatgatcgagatgtccggccatgaaccggttgactttaagaaaacagtagaaaaagttgtagaacatgtaaaagccgtattcgatttacttaattggaacacggacattctaggctttaactctaacgaagaactagacaatcagagctactacaaattatggcatctactatacagtttcgaaggagacaacacgcctacaggaaatgcgcgcctcgtccagaaaataacggaattatacggatttgagaaagaatatgcgatcatcttagcaaatgtaacttttcaagatgattatggatcgttgtctgctaaagccattcacaaaatattaccacatctaaaagaaggaaacagatacgacgtagcatgcgcttacgcaggatacaaacacagcgaaagttcattaacaaaagaagaaattgctaacaaagcactaaaagatcgattaaccctattacctaaaaacaaccttagaaacccagtagtagaaaagatactaaatcaaatggtgaacgtaattaacgctataatagacacttatggaaaaccagacgaaatacgggtggaactcgcaagagaactaaagaaaaacgcaaaagaaagagaagaactgacaaaattcatagctgagacaacacgaaaacatgaggagttcaaaatacttctacaaagtgaatttggattaacgaacgtttcacgaacagacattcttagatacaaactctataaagaacttgaatcttgtggttataaaacattatacagcaatacttacataccaagagagaaattattctccaaagagttcgacattgaacacatcataccacaagcaagactattcgatgacagcttctcaaacaaaactcttgaagcaagatcaatcaacttggaaaaaggaaacaaaacggcatacgatttcgtaaaagaaaaattcggagaatctggcgcagacaatagcttagaccattacctcaataacatagaagatttattcaaaagtgggaaaatctcgaaaacaaaatacaacaaattaaaaatggcagaacaagacataccagacggatttataaatagagacttacggaacacacaatatatagccaagaaagcattatcaatgttaaacgaaatatcaagacgagtagtagcaacaagtggaacaattacagataaacttcgacaagattggcaattggttgatgtaatgaaagaattgaactgggaaaaatataaagcattgggcctcgttgaatactttgaggataaggatggaaggcaaattggaaggataaaagattggacaaaacgaaacgatcaccgccatcacgcgatggacgcactgacagtcgcattcacaaaagacatatttatacaatactttaataacaaaaatgcgtctctcaactctaacacgaacgaatatgcaatcaaaaataaatacttccaaaatggcagagcaatagcacccataccattaagagagttcagagtggaagcgaagaaacacttagaaaacactctaataagcataaaagctaaaaacaaagtagtaacagggaacataaacaaaacgaagaaacgaggaggagtcaacaaatacctgcaacaaacaccgagaggtcaactacatctggaaactatatacggatctggaaaacaatatctaacaaaagaagaaaaagtcaatgcatccttcgatatgaagaaaatagcaacagttagtaaatcagcatatcgtgacgtactacttaaacgactacatgagaatgataatgatccaaagaaagcgttcactggcaaaaattcattagataaacaaccaatatggctagacaaagagcaaacaagaaaagtaccggaaaaagtaaagaccgtaactctagaaacaatatacacagtacgcaaagaaatctcaccagacttaaaagtagataaagtaattgatgcaggagtaagaaaaatattaacagggcgattaaacgagtatggcaatgacgcaaagaaagcattttcaaacttggacgaaaacccgatatggttaaacaaagagaaaggaattagcataaaaagagtaactatcagtggaatatccaatgctcaatctctacacgtcaagaaagataaagacggcaaacccatcttagacgaagacagtcgcaacataccagttgactttgtaaacacaggaaacaaccaccacgttgcagtatatagacgaccagtaatagataaacgtggtcagctagtaattgatgaggcagggaaccctaaatatgaattagaagaagtggtagtatcattctttgaagcagtaacaagggcgaatctagggcaaccaataattgacaaagattataaaacgtcggaaggttggcaatttctattctctatgaaacagaatgagtacttcgtcttccccaacgagaaaactggattcaatcccaaagaaattgatctactcgatgcagaaaactacggagtcatctcaccaaacttatttagagtacaaaaatttgctcataagaattacgtatttagacaccatttagaaacgaccataaaagacacatcaagtatcctcaaaggaataacatggatagactttagatcctctaaaggtctcgacgcaatagtaaaagtaagggtaaatcacataggacaaatagtatccgtaggggaatactga

SEQ ID NO: 5687 - RNA, 4311 nt, synthetic construct
  misc_feature 1..4311: note = Cas9 variant
  source 1..4311: mol_type = other RNA
atgaaatatataaaatacatattagggttagatattgggagcaattcaataggatgggcacttattcaattagacttactccagaaaacaaaaagaataatagcagcgggtagcagaataatacccatggatcaaaaagtactttcagattttggaaaaggtataacaatatcaccaacagcccaacgaacgtcatatcgcaacgcacgacactgtagagaacgacaccttctaagaagagaaagattgcacagagttttgcacatactgggctttcttcccactcactatgacaaacaaattgacttctccaaaagatacggaaaatttgtagataacactgaaccaaaaatagcctataacgaaggtaaatttctatttatggacagctttcaagaaatgctatccgatttcaaaagtcatcaaccagacctattttataccaagaaaaacggagaagaaagcaaaataccatatgattggacaatttactacctaagaaagaaagcactatcacagaaaatatccaaagaagaattagcatggattattttgaattttaatcaaaaacgaggttactaccaattgagggaagaagaaggtaacaaagaaaacgacttcgaaataattagcagcaaaataatttcagttatcaagaaagataaagacaagaaatataataaatattggtacgacattattctagaaaacggcctggtataccaagcagcattctataacgacttcgtctataattggatcaaccaagaccgagagttcatcatagaacgaacatcactaaagaacggtgccgaaaaagtaaaattaagctatttacccacattcgatgaaatcgataaaatggacaagaaagaacaagataaatactacaagaaaattaaaataaaaacagagaactcaataggtaacaaaacagtaggttgttacatttacgaccacatcctacaaaaccccaatgagaaaataaaaggtaaactggtaagaactatagaaagaaaatattataaagaagaactcaaagcaatactcgaaaaacaaatcgctttacaacccgaattattcacagaccaattactagcagactgcattcgagaattgtatagtaaaaatgaagcgcaacaaagaaacttagcagcgcgagactttgtccacttactcgtagaagacataattttctatcaaagacccttacggcgacagaaaagcactctagcaaactgctctctagaatcacgaagttatatagacaaagacagtcacaccagaaaagaagcaccattaaaagtctgtccaaaaagtaatccttactaccaagaatttcgagtcctacaatggttgcaaaacttaaaaatatatgaaatagatagcgatcaagaagtaacacaccaatttatcaaaacgctagaagacaaacaacaattattcgaatttttaatggcccaaaaagaaatagactgtgaggaactattaaaatatttcctcaaccaaacatatccaaatgcaaaagaaaaagcactgaaatcagaactaaagaaatggaaagacacctacagatggaattacgtatacgacataggcgaaaaatcatcaaagaaataccccatgaatgaaacgcggtacgaactaaaaagacacctagaaaaagttgcaaatttgccagacgattttctttcatcagaagttgaatatcttctatggcacctgatatactctgtaaaagataaagtcgcgtacgagaaaggactaaagaaattcgcgcaaaaacaccatctagacaaagactccttcgtggagagctttaagaaatttaacccatacccatcagaatatgggtcattttccgaaaaagcaataaggaaactactccccctgatgcgctttggagctcattgggacttcaaccacatagataagaacacccaaaaacgaatagaggatttaataactggcgtcgaaaacgaagaaataagaactattctcagagaaaaagctgaaaaataccaattagaaaaagaaactgatttccaagaccttccgctatggctagcccaatatattgtttataacagacacgccgaagcatcatcactcgaaaaatggacatctgtaaatgacttagaaacatacttgaacgaatttaaacaacactcattaagaaatccaatcgtagagcaagtagtaatggaaacgctaagagttgttagagacatatggcaacaatatggacaaggccaagcatccttctttaatgaaatccatattgagttaggaagagaattaaagaaaacagcaaaagaacgagaaaaattgagtaaacaaaatcagaaaaatgaagatataaatctatcgataaaagaaaaattaaaagaattagaaaagtacaacacaagggcctactcaatcacacaccaagaaaaatacaaattatggctagagcaaaaacacatttcaccgtacacgggacaaatcatctcacccgaaaatctattcacagacaattacgaaatcgaacatattattccgcaaagccgattcttcgatgattcattatcaaacaaagtcgtatgcgaaagtatagttaataaagctccatataaagatcgacaacttggcttagaatttataaagaaccaaggaggccgaatagttaaagaactatcaaaagaaaacaaaacaataaaaatattcacagaagaacaatacagaacattcataaaagagcattactcaaacaatccagaaaagaccaagaaattactattagaagaaatccctgagaaaatggtagcacgtcagatgaatgatacatgttatataagcaagttcattagtgaaatattatcgaaaatagtaagatccgacgaacaagatgagggagtccatagcaaaaatgtcatattatgtacaggaaaaatcacttccatactcaggcaagactggggccttaatgatatttgggacaacctcatcttaccgagatttgaacgaatgaataatctattacagaaagaaaaattcactatctactcaatagaaaaacagaagaaaataccagttgtaccaatcaatgatcaatttaaaagtttccagaagaaacgcattgatcatagacaccatgcaatggacgccatcataatagcatgtacaacaagagaacacattaactatataaataatcagcatgctttggaaaaagaaaaagataagaaagagaaacaagaagaaagagataaactaagagaaaagttatgtatcaagaaatataataaccgctcagaaggtaattactcctggatatttaagaaaccctgggatacatttacacaggaagtgagagtcgcactagaagatattgtagtctcattcaaacaaaatttacgagtaattaacaaagcaaccaactactatgaacgatgggtagaagaaaatgggaaatacatcaagaaaatggtaaaacaagaaggcactaattgggctatacgaaaaccactacatgaagaaacaatatcaggcaaaatttatctagatcgtgaaaagatcaccaaaaacgacatactcacagccacgagaaaaacggtcgacagttcattcgacgataagagaatcaagaaaataactgatacaggtatacagaaaatcctcttaaattatcttaagtacaaaggcagtcccgaaattgctttcagcccagagggattagaggaactaaacaaaaacctatcgatatacaacgatggaaagccacataaaccaatatataaagtaagaatttatgaaaaaggatctggaagatttgcattgggtgaaaaaggccgaaaatataaaaagtacgtacaaggtgcaagcaacttatacttcggaatataccaaggagcaaagaggagcttcgcaacgatcccattgaatgaagtaatagaaagacaaaagcaaggcttgcctagtgttcccgaatacaacgaaaaaggggatctactacttttctccctaagccctaatgatctagtctacgtaccaatagaaggagaaattatcgaaaacattgatttcagaaatttatccaaggaacaaaaagaacgaatatacaacgtcaatgacttcagttctacatgctattttactccaaaccgaatagctaaagcaattttccctaaagaagtcgacttacaaagaaaaggagataaactatcaggtagttacgatacaaagaccgcgtcattagaaggaatacaaatcaaagaagtatgcataaaactaaaggtagatagactcggtaacatatcaaaagcatga

SEQ ID NO: 5688 - RNA, 4314 nt, synthetic construct
  misc_feature 1..4314: note = Cas9 variant
  source 1..4314: mol_type = other RNA
atgaaatacataaaatacattcttggactcgatataggaagcaactcgataggatgggcattaatacagctagacttgttacaaaagacaaagagaataatagccacagggtcgaggataatacccatggatcagaaagtattatcagatttcgggaaagggataactataagtccaactgcacaacgaaccagttacagaaacgcaagacattgccgtgagcgacacctattacgacgcgaacgtcttcacagagtactgcacatacttggatttttgccaacacactacgacaaacagatagacttctcaaaacgatacggtaaatttgtagacaatacagaaccaaaaatcgcatataatgaacgaaaattcctctttatggatagcttccaggaaatgctcgctgattttaaaatacaccaacctgatctattctacaccaagaaaaatggagaggaatcaaaaataccgtatgattggactatatactatttaaggaagaaagccctctcaagaaaaatcagcaaagaagaactagcatggatcatactaaatttcaatcagaaaagaggttattatcaactaagagaggaagaagaagaaaataaagagaatgactttgaaataattagcagcaaaataatcagtgtcatcaagaaagataaagataagaaatacaataaatattggtatgacataatactagaaaacggcctagtctaccaagccgcattttataacgactttgtatacaattggataaatcaagaccgggagttcataatagaaagaatatcattgaaaaatggaacggaaaaagtgaaactatcctacttaccgacattcgatgaaatagacaaaatggacaagaaagaacaagataaatactacaagaaaataaaaataaaaacagaaaatagtattggaaacaaaaccgtcggttgctatatttatgatcacatactgcaaaatcccaatgagaaaatcaaaggaaaattagtacgaactatagaaagaaaatactacaaagaagaattaaaagcaatactggaaaaacaagtagcattacaacccgaactattcacagaccaattatttgcagactgcataagagaactatacagcaaaaatgaagcacaacaaagaaatttagcagcacgagactttgtgcatctctttgttgaagatatcattttctaccaacgctcgttgcgaagacaaaaatctacattagcaaattgctccttagaaagccgaagctatatagataaagacagccacacccgtaaagaagctcccctaaaagtatgccctaaaagcaacccctattaccaggagttccgagtattacaatggctccagaatttaaaaatttatgaaatagacaccgatcaagaagtaacacatgagttcataaaaacgcttgaagataaacaacaatttttcgatttcttaatgaaccaaaaagaaatagattgcgaagaattactcaaatacttcctaaaccaaacatacccaaatgccagagaaaaagccctaaaaagcgaactgaagaaatggaaagacacataccgctggaattatgtctatgacatcggagaaaaatcatccaagaaatatcctatgaatgaaacacgctacgaattgaaacgacatctcgaaaaagtagctaatctacccgatgacttcttatcatcagaagtagaatatttattgtggcatttaatatacagtgtaaaagataaagtagcatacgagaaaggtttaaaaacctttgcgcaaaaacaccacctggacaaagattcatttgtggagagcttcaaaaagtttaaaccttacccatcagaatacggatccttttcagaaaaagcgataaggaagttattaccacttatgagattcggatcatattgggatttcaatcacatagataaaaacactcagaaaagaattgaagacttaatcaccggcgtcgaaaacgaagaaatcagaacaatactacgagaaaaagcagaaaagtaccagttggaaaaagaaacagactttcaagatctaccattatggcttgcgcaatacatagtatacaatagacatgccgaagcaagcagcctagaaaaatggacgtcagttaacgacttagaaacttacctgaacgagttcaaacaatacagccttagaaatcccatagtggaacaagtagtcatggagacactaagagtcgtccgagacatatggcaacaatacggccagggacaagcctcgttctttgatgaaatacatatagaattaggtagagaactcaagaaaactgccaaagagagagaaaaacttagtaaacaaaaccagaaaaacgaagatataaacctgtcaattaaagaaaaactgaaagaattagagaaatataacaccagagcatacagcataacacaccaagaaaaatataaactctggctcgaacaaaaacatatatcaccctacacaggacaaataatcagtcccgagaacttattcacagacaactacgaaatcgaacacataataccacaatcgcgattctttgacgactcgctatcaaataaagtcgtatgtgaatcaatagtaaacaaagcaccatacaaagacagacaattaggactagagtttatcaaaaatcaaggcggtagaattgtcaaggaactatctaccgaaaacaaaaccatcaaaatatttacagaggaacaatataggacattcatcaaggaacactactctaacaacccagagaaaactaagaaacttttactagaagaaatcccagagaaaatggtagcacggcaaatgaatgatacctgctacattagcaaatttataagtgaaatcttatccaaaattgtaagatcggacgaacaagatgaaggagtgcatagcaaaaacgtaattctatgtacaggaaaaatcacaagtgctttaaaacaagattggggagtaaacgacgtatggaatgatctaatactacctcggtttgaacgaatgaatgatctaacacaatcgaccttatttacaacatataatgaaaaatatcaaaaatatttaccaactgtccccatggaatacagtaacggcttccaaaagaaaagaatagatcacagacatcacgcaatggacgctatcataatagcttgcgcaacacgtgaacatataaattacataaataaccagcatgccctcgaaaaaggaaaagataagaaagaaaaacaaaaagaacatgataaattaagggaaaaattgtgcataaagaaagataacaaaggcagtgaagaaaattactcttggatcttcaagaaaccatgggatacatttacacaagaagtacaggcagcacttgaaggaatagtcgtatcattcaaacaaaatttaagagttatcaataaagcaactaactattacgaaaggtgggtagaagaaaatggaaaatatattaagaaaatggtcaaacaagaagggaccaactgggccatacgcaaaccgctacacgaagaaactatatcaggaaaaatatatttggacagagaagaaataaccaaaaatgatatccttacagcaacgcgtaaaaccgtagattcctccttcgacgaaaaacgaataaagaaaataaccgacaccggtattcagaaaattctcctcaattacctcaaatataaagggtcaccagaaatagccttcagtccagaaggactggaggaacttaataaaaacctgagcatctataacgacggaaaaccacataaaccaatatacaaagtccgaatatatgaaaaaggatcaggaagatttgctcttggagaaaaaggacgaaaatacaagaaatacgtacaaggagcaccaaacttatacttcggaatataccaaggtgcaaacaaaagatcattcgcgactataccactaaacgaagtaattgaacgacaaaaacaaggccggccatccatcccggaatataatgaaaaaggtgatcccctattattctctctcagcccaaatgacctagtatacgtgccagtagaaggcgaaataatagaagacatagactttcaaaatttatcaaaagaacagaaagaaagaatatataatgtaaacgatttctcaagcacatgctactttacaccaaatcgaatagcgaaggcaatattccccaaggaagtagacttacaaaggaaaggtgataaacttccaggttcctacgatacaaaaaccgcttcactagaaggaatccaaataaaagaggtctgcataaaactaaaaatcgatagattaggaaatataagcaaagcctga

SEQ ID NO: 5689 - RNA, 4317 nt, synthetic construct
  misc_feature 1..4317: note = Cas9 variant
  source 1..4317: mol_type = other RNA
atgaaaactattttaggcctagatctgggtacaaactccataggttgggcactgattaaacaaaacttcgaaaataaatacggcgaaatattaggaatgggatccagaatcattcccatgtcgcaagacatattaggagagttcggaaaaggaaattctgtttcgcaaactgcggcccgtactgattacagagctacaagaaggttaagagaacgttttctgctgcgaagagaacgattacatagggtactcaatgttttaaatttccttccagaacattacgcttctcaaatagactttgacaaacggttcggaaaatttaaagtagaaacagaaccaaaacttgcctggaaaaacattgatggaaaattctcattcttgttccaaacaagttttaacgaaatgctcgaagacttcaaagcacacggccaagatctaaaagtaccatatgactggacaatatattaccttaggaagaaagccttaagtcagaaaatagaaaaagaagaacttgtatggatactactaaattttaaccaaaaacgtggatactaccaactaagaggtgaagaagaagaagaaaacccaaataaactaatcgaattttatagtctaaaaataattgacgtactagccgatgaaccccaaaaagggaaatcagacatatggtactccctggtactcgaaaacggatggatttacagaagatcgtcaaaaacaagtctactcgactggaaagataaaattagagacttcatcgtaaccaccgacctaaacgatgatggatcagttaaaacggacaaagaaggaaatgagaaaagatcatttagagctccaggagaaaacgactggaccttagtaaaaacaaaaactgaacaagaaatcgaccgaagtcggaaaacagtcggaaattacatctatgaaacactcctacaaaaccccaaacagaaaatcaaaggaaaattagtgagaactatagaacgcaaattttataaagaagaactaaaacgtattctagaaaaacaaaaagaatttcatagagaactggaatcaaatgacctatacaacgattgtatccgcgaactatataggaataatgaagcacatcaattaacattaagcaagaaagacttcgtccatctgttcatggaagatataatcttctatcaacgacccctcaaaagtcaaaaatcaagcataagtaactgcactctagaatttcgaaaatataaagacgaaaacggaattgaacacacacaattcctcaaagctatacctaaatcaaatccttattaccaagagttcagaatatggcaatggatatttaatttaaatatatataagaaagacaacgatgataatgtcacaaaagaatttttaaatacaactcgcgactttgaaaatctattcgaatttctaaataatcgtaaagaaattgaacaaaaaccactcttaaaattcctattagaacagaaagaatttaagggaaaactactaaacgccgaaacggaaaaattcaggtggaactacgttgaagacaagaaatacccatgtaatgaaacacgaacaatgatatcagaacgtctcaagaaagtagaaaacatttctgacgactttttaacaagagaaatggaacagaaaatctggcacatcatctactcagtgaatgacaaaactgaatatgaaaaagcattaaaatcattcgcagagaaaaacaatctcgacgaaaatagtctatttgaagcattcaagaaattgcctccatttaaatcggaatacggatcatttagtgaaaaagctatcaagaaactcttacctctaatgagacttggcaaatattggtcctacgcgaaaattgacctctactctaaaaaccgaatacagaaaataataaccggggaatttgacgaaaatattaaagacagagttagggaaaaagcgatcagactaacagcagaaaacgatttccaaggactacaactgtggttagctcaatatattgtgtatggacgacactcagaggcttcaatgataggaaaatggaactctgctgacgacctcgaagagttcttaaaagagttcaaacaacactcattacgtaatccaatagttgaacaagtcatcacggaaaccctcagaatagtaaaagacatatggttaaaatacggcaatggagcaaaagacttctttaatgaaattcatatagaactaggacgagaaatgaaacaaacaaaagatgaacgagcaaatgcaacaaagacgataactgagaatgagaataccaatttgcgaatcaaagcattattagcagaaatgatgaatgatcattctgtagaaaatgtacgaccatacagcccaatgcaacaagaaatacttaaaatatacgaagatggaatattaaaaagtgatattgaaatagacgatgatatattaaaaatctcaaaaaccgcacaaccttcatcaagtgacttaaagagatacaaactctggcttgaacaaaaatataaaagtccatatacaggtcaaattatacccctaaacaaattatttacacctgaatacgaaatagaacatataatcccccaatcaagatacttcgacgactcattctccaacaaaatcatatgcgaatcagccgtaaataaactcaaagataactacatcggcctaggattcataaaacaattcggtggcaccatcattgaatgcggattcggaaaacgagtaaaagtgtttgaagtaggagagtacgaagaatttgtcaagaaacactatgccaacaatagaggaaaaagaaataaactcttattggaagaaataccagagaaaatgatagaaagacaaatgaacgataccagacatatctcaaaatacataagcggaatactatcccacattgtgcgggtcgaagatggaacagacgaaggcgtcaattctaaaaacgtcatacccggtaacggaaagattactacccaactaagacaagattggggtttaaatgacgtgtggaacgaactcatactacctagattcgaacgtatgaatcaactaaccaattcaacagactttacctcgtggaatgaaaaccaccaaaaatatctaccaacagttccagtagagttctctaagggatttagcaagaaaagaatagatcaccgtcatcatgcgcttgacgcattagtcatagcgtgtgccacaaaagaccacgtaaatttgctaaataatcaatcagcgaaaagtgcaactaaacgatatgatttaaagaagaaactaatgaaattcgaaaagacagtatataaagatcctcaaactgagaaaagaatagaaagagaagtaccaaaacacttcttaaaaccgtgggaaacatttacagtagacgcgaaaaatagactcgaaacaataatagtcagcttcaaacaaaacttaagggtaataaacaaagccactaactactatgaaaaatacgtagaaaaggacggcgtaatgatgaaagaaagagtggaacaaacgggtaccaattgggcaataaggaaacctatgcataaggaaaccgtatcaggaaagatagaccttccctgggtcaaagtgccaaagggaaaaatcctgacagcaacgagaaagtccctagacactagctttgatctaaaagctatcgccagcatcacagacaccggaatccagaaaatcctgaaaaattatctagaatttaaggaatcacctgagctagcattctcgcccgagggaatagaagacatgaataaaaacatagaaaaatacaacggtggaagaccacaccaaccgataagcaaagtacgcgtattcgaattaggaagtaaattccaagtcggtcagacaggtaataagaaagacaagtatgtagaagcagcaaaaggcacaaaccttttctttgcaatatatgaagataagaaaggtaaacgaagttatgaaacaattccattaaatgaagtaattgaaagacaaaaacaaggcctcagcgtcgtagatctaaagaacgttaatgacttctttttatgtccaaatgaccttgtctatattccaagcggagatgagttcgagaataggggttcaatagagatcgaaaacataacaaaagagaaaagtgaacgcttttacaaagtcgtatccttcagtggaagccaaatattctttgtccggcacgatattgcggtatcaatagtcaataaaggagaatttagcacgctaaacaaaatggaaagagcaatagacgggtcaatggttaaagaaatatgtataaaacttaaaattgatagattaggagatgttctaaaagcctga

SEQ ID NO: 5690 - RNA, 4317 nt, synthetic construct
  misc_feature 1..4317: note = Cas9 variant
  source 1..4317: mol_type = other RNA
atggtaaaaaaaggctatactatcggcctggacataggaacaacgtcagtaggatgggcggtcaccgacgacgacttcgaactagtaaacaaaaagatgagtataaaagacaagagcggttctacaattaaacgagtaaggaaaaatttatggggagtaaggttattcgacgaagcaaaaacagcagaaaatacacgacgaacacgtggagtacgaaggcgaataaggagaagaaaagaacgactaaactatctacaaggaatattcagtagcgaaatggctaaaatggacgaaaacttctttatgcgactagaagaaagtttttttaaattatccgacaaatcagaacagaataaatttccatatgctttatttaaaaacgaaatagaggaaaaagcgtattaccgacaattccctacaatatatcacctaagaaaacacttaatggaacatgaggaaagtgacctaagaaaaatatatctgggcctccaccatatactaaaatacagagggcactttgtacaagaaggtcaaaaaatggatgtagcaaacatagacatacaaggaaacttaaaggaattattcaatgcacttaacgaaaacttcagtaacaaagaggacgacttcgaacaggaaagaatgaaagatggagtaaaaagagcaaaagtactatttgacactgaaaagctcgccgcggtagaggaaatattaaaagaaaaaatttcaaaaagttggaaagttaacaaaatatctaaaggcattttagccgaaaaaaaagatctacctatatttaaagctatagtaggcaataagatagacctagcaggtatcttcgactgcccagactacgcagaaaaagtcaatgaatctataaaagaactaaaggacaaagtttatttcaacaaagaagacttcgaagaaactttcgaaaaactatcacaactacttaaagaagaggaacttgaaatattaatactagccagaaaatgttatgaggcagtactacttgctgatataatgcaaggggaacaaagcttaagcgatgcgatggtagcgaaatataacgaccataaaaaagacttggtaatcttcaagaaattcgtgatcgactactttagtgaagacgtctatttcgacttattcaaaaacacccaattagccggaaattatcatagttacgttaaaggagaacgcaaaggcaacaagttcaatcacgcatcactagatgacttttataaattcgtaaaaaaagagcttgacaaaaaagcagaggaactatcagagcatcccgtatacaaacaaatactacaaaaaatcgaactggaaacgtttttaccaaaacaaagaatgttcaaaaatggagcaatcccttaccaagtacacctacatgaattacgagcaataataaaaaaacaagaaaaaagatttccattcctagctgaaaaaatcataataaaagacaatcaaaaggacatcagtgaatataaaatagaaacactaatgaaattcagaattccatattacgtaggacctttaatagaggcaagagaaggtgagcttggaaaaaaaaggactaattattctagattcgcatggatgcagaaatcccccgaatcacaaaatataggaataactccatggaatttccactccgtagtagacaaagatgcctcagcttcagagttcattgaacgaatgacaggattttgttcatatttcccggaagaaccagtactaccaaagaactctctaatatatcaacagttcacagtttttcaagaattaagtattgtaggctattatgacgagcaaaacagaaaacactaccttgatggcgaaacacgtaggagaatattcgaagatctatttaaaaaaaatcgtacagtaagtgcaggactcctcagaaagtggctggtatgtaaccaacgaacgagccaggaggaaaaggaaatcagattatttggcttggaccttaaaaaaaacggtttaggatctgggaattttaacactaaatataccacgtacttagatctaaaagacgctggaataactgaaaaacaactgaaacaacacaaagatttctttgaaaaaatagtaaaataccagacaatattcgaagataaaaaaatattaaaaagacgaataattttattaaacgaagaacaaccattactaagcgaagaacaaataaaaaacctggcgaagaaacactacacaggatggggaaacctaagccttaaactaattgatggcatacaagacaaaggcaaaacaatattagactatttagaaacacaagattataaccaaaacctaatgcagttaatgaatgatgaaaacaaatcatttgaaatgcaaattgaacaagcaagggcagggaaagttcaattcggtaaaatagactattcctttgtggaacagttagcgggaagcccagcaatcaagagaggaatttggcaatcactccagatcgtcgaagaattagtagcttttcttggcaaagaaaacatcaagaaaattgtaatcgaaatggcccgcgaaaaccaatcatccaaaagaacaaagtcgcgacaaaaacaaattgaagcattatatcagaaagtaaccggagacctaaaaaacgaacaggaaaaaatagatgtaatgcagaattttgacaacgaaagagtattcctttactatttacaaaacggcaaatgtatgcattcaggtgaaaaactcgaactttcccagttatccgaatacgaaatagatcacataataccacaaacatacatcaaagatgacagcttcgataacaaagtactagttactaggaacgctaaccaacaaaaaggtggagacgtaccctcatatgatgtaattgacaaaatgaaatcttactgggaaaaactcaaggaaaacaatctcatatcagaaaaaaaatttgcaaacctaaccaaaggtaaatttgacgaccaacaactatccgggtttataaaccgacagttagtagaaacaaggcagatcacaaaaaacgtcgcgattatattagataaaatatataacgacgaagccaaaaacgaaaaagaagtagcaataataacattaaaatccgccttaacaagtcaataccgacaaggtattatatatgtcccaaacgacgactttgatgaacttaaactcgtgagcaaaacaaatagtagattaaaagaagtaaaactacacgacgggttctacaaggtacgtgaaatcaatgattaccatcatgcgcatgacgcctatttgaataatgtggtagctacatatctatatgaggccatgcccgatttaaggcccctcttcgtatatggagaacattcaagagaaatccataaaagattcctcggaaaatacgcaacaacacgaaaaggccaatttaaacaattacttgttgatatgcaagacgaatactggatgagaaaagacaaagaaggaaacttcatagatggggaaattctctggagacgagatgaagtgttacaaatagttaaaaaagtactagactaccgaaacatacaaataacgaaaaaactcgaaatgatggtaaccggaggagaagaaaaaagtttctatcaggacagtcgttgccgaaaagataaaaccgctattccatacaaaaccaactgggatcctagcaaatatggcggatttaaaagcccacgaacagcttacgcaataccggtaattaagaaaaacaagcccaaattagaacccgtactgttagtgaatagatcaaaagtcgaaacagatggacaattcgattgtgagaaatttaaagaactgaaccccactttaaaaatattaggacagccaatttggaaatatcaatcattcgaaatgttcgacggtaccaagagatatatagcttccgcatcagaaatacataaaggaaaccaaataaaatttagccaagagcacatgaaattcatatcatgttgccaaaaatatgatgaagtaaaaaataaacttgcgtttgatttcgtcaatgaatctaaacacttatttcaggaaatcttaacggcaattaaagacaacattcacagatatagacttatagccgaaggaatagaagttcatcgaaaattctcgaacatgttagagaacatagaaaaactatcaactcaagagcttgtagacaatctattagacgccatcaacatcacctcagtaggaaccactaacaatgcattcggaagagtaagatataaagggagctacttaaatgaaatatggtcagcgactctaatacaccaaagcgtaacaggactttatgagacgagagaaaaactaatttga

SEQ ID NO: 5691 - RNA, 4323 nt, synthetic construct
  misc_feature 1..4323: note = Cas9 variant
  source 1..4323: mol_type = other RNA
atgaaaactatactaggacttgacttaggaacaaattctattggttgggccctggtagaacaagacttcgaaaataaacaaggacttattttaggtatgggttcccgaataataccaatggatgcaggaattattggaaaatttgcagagggatcttccatatcacaaacagcagaaagaacaggataccggagtattcgcagactacgtgaacgccatttactgaggagagaaagactacacagagtgctcaatatcctaaaattccttcctgaacactatgcagcagaaatcgatttcgagaaacgatttggacaattcctggcagaaacagaaccaaaactagcatggaagaaatcagcagaaggaaaattcgaatttttatttcaacggagtttcgacgaaatggtagccgatttcaaagcaaacggacaagatatcaaaatcccatatgactggacaatatactaccttagaaagaaagcgctaactcagaaaatatcaccacaagaactagcatggattatactcaactttaatcagaaaagaggatactatcaattacgaggggaagaagaagaagaaaacccaaataagaaagtcgaattttactcattaaaaatagtcgatgtagtagcagatgaacaaccgaataagaaaggtgatacatggtattctctacacctagaaaatggatgggtatacagaagatcaagcaaaatacccctatatgattggaaagacaaagtccgagactttatagtcactaccgacataaacgaagacggaagcgaaaaattggataaagacggagaagtgaaacgatcattcagagccccaaaagaagacgactggacacttatcaaaaagaaaaccgaacaagagattgagcaatttaaccaaacagtgggaagctatatatacgaggctttgttagataaccctacccagaaaatacgcggcaagctagtaagaaccatcgaacgcaaattctataaatcagaacttaagaaaatactagaaaaacaaatagaacttcaaccagaattatttacagaggacctttacaatgcctgtgcacgtgaattataccgatcaaacgtagcccaccaacaacaactctcatctagagattttgtctatctatttttaaacgacataatcttctaccaacgacccctaagatcacaaaaatcactaatatctaactgctctttagaatttagaactattaaagacaaagacggaaatggtcaaataatatatttgaaagctattcctaaatcaaatccatactatcaagagttcagagtatggcaatggttgtataacttaaaaatattcactaaagaagacgataaagatgtaactaaccaatttataaataaagtagaagacttagaagcattattcgagttcctaatgaatcaaaaagaagttaaccataccgacatactaacatacttaattgaaccaatcgtaaaatcaaaatacccaaacgcaaaaggcaaagcattcaaagatgaattaaagaaagaattaaagaaataccggtggaactacgtttatgacgcagacaaagacgaaagtaaatcataccctatgaatgaaacacgttatgaactccgcaaaagattggacaaagtggaaaacgtacccgcggattttatgacaagaaaaattgagcaacacttatggcacatcatatattccgtaactgataaaatagagttcgagaaagcactaaaatcatttgcaaacaaatatgacctacaccaagagagctttgtagaaaattttaaaagattcaaaccattcgattctgattacggaacctactcagaaaaagctataaagaaactattacccctgatgagggtaggtaaatactggtcatgggaaggcatagataacaatactaagaaacgcataggaaaaatcataacgggagaatatgatgaaactattaaaaacagggtaagggaaaaagctatagacctaaccgaggaaaaccacttccaaggattacaattgtggcttgcgcaatatatcgtttacgacaggcattcagaagcagacatagccggtaaatggaactcagtcgcagatctagagcaatatctatcagagttcaaacagcacagcctacgtaaccctatagttgaacaagtaataacagaaacattaagggtagtaagggatatatggaaacaatacggaaaaggagcaaaagattattttgacgaaatacacatagaacttggaagagaaatgaaaaataccgccgaagaaagaaaaagactatcgagtatcatctctgaaaatgaaactacaaatttaagaatacgcgcaattctggaagaattgatgtacgatgaaaacatggaaaatgtccgcccatactcccctatgcaacaagaagcactcaaaatctacgaagatggagtcctgtcatcctcggtggaaattccagaagatatagagaaaattagtaagaaaagtgaacctacgaaatcagagatacaaagatacaaattatggctggagcaaaaatatcgaagtccctatactggacgcccaatcccattaagtaaactgttcactccagcttaccagatcgaacatataataccacaagcacgattctttgacgatggatttagcaacaaagtaatttgtgaaagcgaagtaaatgctctaaaagataaaatgctaggcttagaatttatacaaaattattacggacaaaaagtaacaacttcctttggagaagtaactatacttacagaagacgcatataaagcatttgtaaaagagcattatgacaaaaacagaagtaaaagaaataaactacttttagaagaaatacctgaaaagatgatagaccgtcaaatgaacgacacaagatatatctcaaaatacatatcaaaagttttatcaaacctggtaagaggagaaaaagatgatgaaggagtaaatagcaaaaacattatcccaggtaacggaaaaatatcagggacactaaaacaagattggggtttaaacgatgtatggaatgatctaattctacctagattcgaacgaatgaaccaactcaccaactcaactgactttacagcatggaacgaaaaacatcaaaaatttctaccgaccatcccattagaactaagcaaaggatttcagaagaaaagaatagaccataggcatcacgccttagacgcactcataattgcatgcgcaacgcgagatcacgtaaacctattaaataataaacacgctaaaagtaggaatgaacgctatgatctacagcacaaacttagacacactacaccatggcaggacaaagaaggcaaagttcgaacaaaattcaccgagttcaagaaaccatgggaaacgtttacacaagacacaaagaaagaattagaaaagatagttgtatcctttaaacaaaacctaagagtcataaacaaagcaacaaactattacgagaaaatagtagatggcaagaaagtaatgtttaaacaagagggtgttaattgggcaataagaaaaccaatgcacaaagaaaccgtttctggcaaaattgacctaccaagggttaaagttagcaaaggtaaaatattaacggcaacaaggaaatcgctcgacacaagtttcaatgcaaaaactattctcagtataactgacacaggtatacagaaaatacttcttaattatttgaaagccaagggaaatccagaattagcattttcccccgaaggaatagaagaaatgaaccaaaacatatccttatacaacgacggaaaaccacaccaaccaatactcaaagtgagagttttcgagcaaggatcaaaattcccactaggtgaaacaggaaataaaacaacgaaatacgtcgaggcagcaaaaggaacaaacttattctttggggtatacgaaaacaaccaaggaaaaagaagttataatacgataccattgaatctggtaattgaaagacaaaaacaaggtctaaattcagtacctgagactaatgaaaaaggccaccgccttctatttagcttatcgccgaacgatctagtatatgtcccaatagagggcgaagtcttcgacaaaacaaacccagatgtgaacagaatatataaaatagtatcatttagcggatcccaaatgttttgcgtcagacaagacgttgcaacctcaattgtttacaaactagagtttagtagcttaaacaaaatggaaagaacaatcgatggtataatgataaaagagatatgcatcaaattaaaagtcgatcgactgggtaatatatcaaaagcatga

SEQ ID NO: 5692 - RNA, 4323 nt, synthetic construct
  misc_feature 1..4323: note = Cas9 variant
  source 1..4323: mol_type = other RNA
atgaaaactattttgggattagatttaggaaccaattcaataggatgggccctagtagaacaagattttgaaaacaaacaaggtcttatattaggcatgggttcacgaattatccccatggacgcaggaataataggtaaatttgcagaaggatcatcaatatcacaaaccgctgaaagaacaggttatcgtagtatacgaaggctgagagaacggcatctactacggagagaaagattacacagggttctaaatatactaaaattccttcccgaacattacgcagcagaaatagacttcgagaaaaggtttggtcaatttttagccgaaacagaaccaaaactagcctggaagaaaaatgcagaaggaaaatttgaatttttatttcaacgatcatttgatgaaatggtagcagacttcaaagcaaacggacaagacatcaaaataccttatgattggacaatctactaccttaggaagaaagcattgacacagaaaataagtcctcaagaactagcctggataatattaaattttaaccagaaaaggggatactaccaactaagaggggaagaagaagaagaaaatcccaacaagaaagtggagttctacagtttaaaaatcgtcgatgtagtagcagatgaacaaccaaataagaaaggtgatacctggtactcattgcacttggaaaatggctgggtttacagaagatcatccaaaataccactatatgactggaaagataaagtacgagattttatagtaactactgacataaacgaagatggcagcgaaaaattagataaagatggagaagtcaaaagatcattccgagcacccaaagaagacgactggacactaatcaaaaagaaaactgaacaagaaatagaacaattcaaccaaacagtcggcagctacatctacgaggctttattagacaaccctacccagaaaattcgaggcaaattagtacgaacaatcgaaagaaaattctataaatctgaattaaagaaaatactagaaaaacaaatagaattacaaccagaactgttcacggaagatctctataacgcatgcgcaagagaactatacaggagaaacgtggcccatcaacaacaattgtcatcaagagacttcgtttacttatttttaaatgatataatattttaccaaagacccctgcgaagccagaaatcactaatctcaaattgttccctagagttccgaactattaaagataaagatggtaatggtcaaataatctacctcaaagcgatcccaaaaagtaacccttactaccaagagttcagggtgtggcagtggttatataacctaaaaatctttactaaagaagacgacaaagacgtaacaaaccaattcataaataaagtagaagatttagaagcccttttcgaatttttgatgaatcaaaaagaagtaaaccacacagacatcttgacatacctaatagaaccaatagtaaaaagtaagtacccaaacgcgaaaggcaaagcatttaaagacgaactgaagaaagaactcaagaaatatagatggaattatgtatatgatgcagataaagatgaatccaaatcatatcctatgaacgaaacgagatacgaattaagaaaaagactagacaaagtagaaaatgtgcccgcagacttcatgacacgcaaaatagaacaacacctctggcatatcatctatagtgtcaccgacaaaatcgagttcgaaaaagcccttaaatcattcgcaaataagtacgacctacaccaggaatcattcgtagaaaattttaaaaggttcaaaccattcgacagcgactacggaacgtactctgaaaaagcaataaagaaattattacctttaatgcgcgtaggcaaatactggtcttgggatataatagacgacaaaacgaaaaccagaattggaaaaataataacaggagaatatgacgaaacaatcaaaaacagggtcagagaaaaagccatagacttaacagaagaaaatcacttccagggcctacaactatggcttgcacaatatatagtatacgatagacacagcgaagcagatatcgctggaaaatggaactcagtcgccgacctagaacaatacctaagtgaatttaaacaacactctctaagaaatcctatagtagaacaggtaataacagaaacacttagagtagtacgagacatttggaaacaatatggcaaaggggcaaaagactacttcgacgaaatacacatagaactaggtagagaaatgaaaaatacagccgaagaacgtaaaagattaagttcaataatatcagaaaatgaaaccactaatctacgaatacgagcaatattagaagaactaatgtacgatgaaaacatggaaaacgttcgcccatattctcctatgcaacaggaagcattaaaaatttacgaagacggcgtactaagttcatcggttgaaataccagaagacatcgagaaaataagcaagaaatcagagccaaccaaatcagaaatacaaagatataaattgtggctagagcaaaaatatcgaagtccctacaccggaaggccaattcctctgtccaaactattcactcccgcataccaaatagaacatattataccacaagcccgtttcttcgacgatggcttctcaaataaagtcatatgcgaaagcgaagtaaacgctttaaaagataaaatgttaggcttagagttcattcaaaattattatggacaaaaagtcacaacatcatttggagaagtaacaatattaacagaggacgcttacaaagcatttgtaaaagaacattatgataaaaatcgttccaaaagaaacaaactcctactagaagaaatccccgagaaaatgatagaccgacaaatgaacgatactcgttacatatccaaatatatctcaaaagtacttagcaatctggttaggggcgaaaaagatgatgagggcgtaaacagcaaaaacattattccgggcaatggaaaaataaccggaatattaaaacaagactggggactgaatgatgtatggaatgatctcatactaccacgattcgaacgtatgaaccaacttacaaactcaacagactttactgcctggaatgaaaaacaccaaaagttcctaccctccgtacccctggaactgtcaaaaggcttccagaagaaacggatcgaccacagacatcacgcacttgacgcacttataatcgcatgtgcaaccagggatcacgtaaatttacttaacaacaaacacgcaaaatctagaaatgaaaggtacgatctacaacacaaattacgacacaccacaccatggcaagacaaagagggaaaagtaaggacaaaattcacagaatttaagaaaccatgggaaacatttacacaagacactaagaaagaattagagaaaatagttgtcaattttaaacaaaacctaagagtaatcaacaaggcaacaaactactacgaaaagattgtggatggcaagaaagtcatgtttaaacaagaaggtgttaattgggcaattagaaaaccaatgcacaaagaaacagtatctggcaaaattgaccttccacgtgtgaaagtaagcaaaggtaagatactcacagcaacacggaaatcattggacacttcattcaacgcaaaaacaatcctaagcataacagataccggtatacagaaaatactactaaactatcttaaagccaaaggcaatccggaattagcattttcacctgaaggaatagaagaaatgaaccagaacatttctttatacaacgacggaaagccgcatcaacctattctgaaagtaagagtgttcgaacaaggatcaaaatttcctttaggagaaacaggtaataaaacaaccaaatatgtagaggcagcaaagggaacaaacctattctttggtgtctacgaagacaatcagggaaaaaggtcctatgacacaattcccctcaacatagtaattgaaagacaaaagcaaggtttgaactcagtaccagaaacaaatgaaaaagggcataggctattatttagtctatctcccaacgacttagtttatgtccccatagaaggcgaggtatttgacgaaaccaacccagatgtaaatagaatatacaaagtagtatcattcagcggctcacaaatgttttgcgtaagacaagacgtcgctacctctatcgtatataaattagaattttcatcattaaacaaaatggagcgaaccatagacggcattatgataaaagaaatctgcataaagctcaaagtcgatcgattaggcaacatatcaaaagcatga

SEQ ID NO: 5693 - RNA, 4332 nt, synthetic construct
  misc_feature 1..4332: note = Cas9 variant
  source 1..4332: mol_type = other RNA
atgatcaaacttctttatttagagaaactaaaacaatacactatgaaaaaaatactaggactggatctaggaacatcaagcatagggtgggctctagtgaacgaggctgaaaacagtgatgaggtatcgagtattataaaactcggtgtaagggtgaatccgctgacagttgacgaaatgcaaaacttcgaaaaaggtaaatcaataacaaccaatgcagacagaacgttaaagagatcaatgcgaagaaatttacaaagatacaaattaagacgagacgcactaattgaattactaaagaaagtagggtttatcacagataaaaccatcctttccgagcagggaaatagaacaacatttgaaacatacaggttgagagcaaaggcggctgaagaagaaataagcctaaaagaactagcacgagttttacttatgataaacaagaagaggggctataaatcctctagaaaagcgaaaggtgaagaagaaggagccttaatagatggtatggaaatcgctaaaaagttatatgacgaagacttaacacccggacagctttgcctacaattactagaaagtggtaagaaattttttcccgacttttaccgtagcgatctacaagaggagttcaacaaaatttgggatttccaaaaacaatttaacttattcagcttttgtgacgtagcaaaagaagaagtaaaaggaaaaaataagagccaaacttgggccatactagcaaaatacttcgtggaaaccaagaaagtaaatgtatggaacgaacacgaagcacaaaccgaaaatcgagaagaagtatataaactagtaggattaaaaagaacagtaaaaggcgaagaactcaaaaaagaaaattacaggtggagggttcaagctcttactgaacaacttgatttagaaaaaatagctgtagtattgcaagaaattaatggacaaataagcgcatcaagtggttatctaggggccattagcgacagaagtaaagtcctatatttcaacagacagaccgttggacaataccaaatggccgaattaaataaaaatcccaatatgtcactgaggaacatggtgttttatagacaagactatcttgatgaattcaacgtgatatgggaaaaacaagcagaatttcacaaagaactcacccccgaacttaaaaaagaaatccgtgacattataattttttaccaacgaaggctaaaatcacaaaaaggtcttatatcattctgcgaattcgagaatagagaggtagtagtagaaaaagaaggaaaaaagcaaacaaaaattataggatgtaaagtaatccctagaagccatcccctatttcaagaattcaaaatctggcaaacactaaataatatagaagttttcgtaggagaaaagaaagggaaaagaaaaaaatcaaatgtatcatcagatctattcggtgatacagaagatgccttaataaccgaaggaagaagattcttgtatcaggaggaaaaaaaaatcctcgccaaagaactaagcatcaaaaaggggctgaccaaagcagaaatacttagattattatttgaaaacccccaagaattagatataaacttcaaacaaatagatggaaaccaaactggctttgctttattctccgcctacagtaacatgatagaaaaatatggatatgaacctctagattttaaaaaacccgcagaagatctgatcagccaactaaaaacagtcttcactgaccttggctggaacacagacttgctattcatagatctcgacaaagaaaacaaagagtgggaaaaacaaccatacttccgtctttggcatctactctactcatttgaaggcgacaacacacctacaggaaatggaaagcttattgaaaaaataatgcaattatgtggcatagaaaaagaatatgcaatagaactcgccaacgtgtctctacaagacgattatgggtccctctcagcaaaagccatcaagaaaattctgctttatctcaaagaagggaatcaatacgatatggcatgtgaatatgctggttaccgtcatagcaaaagctctctaacaaaagaagaaatagaaaataaagttttgaaggataagttagaaatactacccaaaaacagtctaagaaaccccgtagtagaaaaaatcttaaaccaaatggttaacgtcataaacactgtaatggaagtctatggcaggccggatgaaataagagtagaattagcaagggaactaaaaaaaagcgcaaaagaaagagaagaattgacaaaagccgtggccaaaaacaccagagaacacgaagaaatccgaaaagtgctccaatcagaattcggcatgattaatgtttctcgaaatgacattataagatacaaactttacgaagagctgaaggacaacggatacaaaacactgtactccaatcaatatatcccaagagagaagttattctcaaaagagatcgacatagaacatataataccacaaagtagactcttcgatgactccttaagcaacaaaacacttgaatacaaaagcatcaacatagaaaaaggtaataaaacagcatacgacttcgttaaagaaaaatacggagaagaaggacttcaacagtacttgaataggtgtgaaaacttatgcaaagacaagaaagccaaactcagaaaattgaagatggaactgaatgaaattcccgacggattcatagatcgggacctcagaaacacacagtacatcgcgaaaaaagcattatcaatgttaacagaaatttgtaggagagtagtagcaactacagggtcgataacagacaaacttcgagaagactggcaactcgtggacgtcatgaaagagctaaacctacctaaatacgaagcacttggactcgtggaagtatacgaagacaaagacggaagaaagataaaaagaataaaggactggaccaaaagaaatgatcaccgacatcacgcaatggacgctctaacggtggcatttacaaaagatgttttcatccaatacttcaataacaaaaacgccgcatgggaatcagattcaaaagagcatacaaacatagtgggaataaaaacacgatatttcgaatctggaaaagccgtaccacctatacccctgggtcagtttagagtcgaagcaaaatgtcatctcgaaaatttgttagtctccataaaagctaagaataaggtagtaacaaccaatgtcaattgtatcaaaaaaaaagggggaacatataaaaacacacaacaaacccctagaggacaactacatctggaaacaatttatggatctcataaccaatacgtaacaaagatagaaaaggtcaatgcatcattcgatgcagtaaaaatcgccacagtatctaagcaggactatcgcaatgcgttactaaaacgcctagaggtatttggaaacgatcctaaaaaagcattcactggaaaaaacagtttagaaaaaaatcctatatatctagatagggctcaaacaatccaagtaccagacaaggtacaaacagtagaactagagaccgcgtacacaatcagaaaaccagtagatccaacattaaatgtcgacaaagtagtagacaagaagataagacttatactcgaacaaaggcttaaagaatacggaggggatgcgaaaaaggctttcgtcaacttggatgagaacccaatttggcttaacgaagaaaaaggcatatcaataaagagagtcacaattcggggaatatctaaagctcaagctctacatgacaaaaaagacaaagacggaaatttcatactagacgaaacaggaaagaggatcccagtagattttgtaaacaccggaaacaatcaccatgtcgcaatataccgaaagccagtattggataaaaaaggtcaggtaatctttgacgacgaaggtaacccgatgtacgagttagacgaagacgtagttccattcttcgaagcagtaacacgcgcaaacttgggaatcccaataatcgataaagattataagaagtcagaaggatggcaatttctattttcaatgaagcagaatgaatattttgtattcccaaacgaaaaaacaggatttaatccaaaagaggtagacctactagaccctgataactacgcaatgattagcccaaacctatttagggtacaaaaaattgggctaaacgattacacctttagacatcatctagaaacaactatccaaaatgatttaaaattcatcacctggatacgttgtggcaagagtggaataaaagacattgtaaaagtaagaatcaaccacataggacaaatagtaagcgtcggagaatattga

SEQ ID NO: 5694 - RNA, 4332 nt, synthetic construct
  misc_feature 1..4332: note = Cas9 variant
  source 1..4332: mol_type = other RNA
atgaagaaaatccttggtctagacttaggcacagcatccataggaagcgcttacgtattagaagcggaaaaatcggcagatcaaactaaaatagtttatctgggcacacgaataatactttctagtgccgatgccgaaaacttctcaaaaggactttcttgcagcccaacgacagacagaacctttaaaagatcaatgagacgtcgactacaaagatataaacagaggcgtagtagcctaatccaacaatttaagaaaataggaataataaccaacacagaacaaataattagagaaccaatatctgaaacacatgaacttctaagaataagatcaaaagctgtaagtgaacatgtttccctcgaagagttcgcacgaatactactgacgataaacaaacgtcgaggatataaatcaaacagaaaaacatccaaaagcactgaagaagacggtaaattagtagacgccatggcagttacaaaagaactaataaaactaaagaaaacccccggacaatacatgttcgaaagattcaaacggggaaaatatgcggaaatagacttctaccccttcgaccttataaatgaattaaaacaaatatgggaagtccagggccaaaaataccccgatgtcctcacagaaggattgctcagttctctactaaaacagaaaacaggtaaagcgaaagaattaatatactctaaaagcgacctaaatcctgctgaagtcccaatagattaccaaaaaggtaagaaacttagaaaaacaatattgaataaatactttgcatacgaaagcagaagcctagctgtaaccaacattataccagtagaacaagcaataacagcaatagtcgctatatgtaaacaaataaacaattcatccggctacttaggggcaatcggcgatagatcgagggtcctatacgctaacaaccaaaccattggacaatatctgtacgaaagaataaaagccaacccacatgacagaatcagaggagaagtcttctacagacaagactacttagatgaatttgacagaatttgggaatgtcaacaaaactactacccagcgatactaactaatgaccgtaaacaatacatacgcaatagaatcatattttaccaaagaccattaaaatccaagaaatcagaattagcattctgtgaatttgaatcaagagaagttgaacataacgggaagaaatataccgaaggactgcatgttgcaccaaaatcaagtcccgtatttcaacacttccgattatggcaaaggttaggtcaaattgaagtatctccattacgaaaatgggataaacagtcaaatgaactttttgaacaacaaaataatgcagacagagaaggcatcttaaacactgaagccaaacaaaaattattttcatacctcaatctcctcgatcatctaacagataatgaaatcctgaatatactaggttattcacctgataaatggaaaataaacttcagagaaataataggaaatagaactaataatctaatgatgaaagcctttttcagtatgaaagaaatgactgatggcgaacaaattgattgggagaaaaacctaacaaaaataacaaatggacaatccctaataagtccagaacaaatagttgaccttatcagacagttcttcgaaagagaaggtataacaacaagcctgctctactttgatccagcaacagacaactttcgcgaacaatcacattatagtctttggcacttactctactcctacgaagacgataacagcccgactggcaccacctcgttatgtaagacactcgcaaaaagatatggtattccacatgaactctgtccactacttgcatccctgacttttgaacgtcaatatggaagtctctcaacaaaagcaatgcgcaaattattgccattcatgcaagagaaaagatacgatgaggcttgcgaattagccggatatcgccattcagcctggataacaaaggaagaaaatgcgaaacgaacactcaaaaacaaattacctttactcagaaaaggatcattaagaaacccagtagtagagaaaatactcaatcaaatgacccatgtcataaacactcacatagcagaatatggaaatccagacgaaatccgaatagaaatggcccgagatatgcaggccaatagtaaacaaagaaaagcaatgactgcagctattactgaagctacaaaacgaaacacacagttcatagaagaaatacaaaaagaatttggcttcaatccatctaaaaacgatttaataaaatacaaactttggaaagaattagcaccactaggtaataaaacattatattcaaatatatacatacccaaagaagaattatttactgcaaaattcgaaatagaacatataattccacgagcactcttttacgatgactcattctcaaacaaaacgttagaactaaactcagtcaacaaacttaaagggaacaagaccgcactagattaccttgatacattaggccaggaaaaagcgaatgactatattcttcgtgtcgaagaactaaagaaaataggagccataactcaagccaaatataagaaattattgatacgagaaaaagacctcggagacgatttcactaatagggacctcacgaacacaagatacataatacgccacgcagccgatcgagatctaacaaatacacgatacatcattagacatgccgcagacatgttattacaggtaactccctccatagttcacactaacggatcaatcacagcaatactcagacgggactggggacttctagacatactgaaagaactcaacctaccaacttacgaatccatagacagaaagatcagtgatcccgaagaaaaattaactcaatcagtagaccggaaagacggacaagccatcaaaatgatcaaagactggtcaaaacgagatgaccacaggcaccatgctatggacgcactcataacagcactgacaacaagaaaacatgtgcaatatttaaacggcaactcaggtgccgaagaaacagataaagcccagaaactggaacaattaaaagcgctaagaaaacaactaataggatccgacggacactttattccaccaatgcacgacatccgtgtgcaagcaaaagaagccctatcccgtgtaattatatcaactaaagtcaaaggaaaagtaacaacccccaatacaaacataatttgctcccgagataaaactacgggcagaaaaatatatgttcggcaaacaactttgacaccgagaggagcacttcatctagacacaaaatatggcatcaatagatattatcaagaaagagaagtcagcataggctctaagctcacccaagaagaaatacgcttagtatcttcaccccacatccaatcaatccttttagagcgactccgtgctttcgataataatcctaaaagtgcttttacagggcgaaattcagtagacaagaaaccgttagaagacaaaaataaaaagctagtatacacagataagaaagttaaacagaccattttagccaatcgtttcgtcaaaagagacagggtaaatagcaaactggacctagataacgtaatagataccggtataaaaaggattctcgaaagaaggcttaaacaatatggaggcaaatatgaaaccgcatttagtgacttagagaataacccaatatggttaaacgaggaaaaaggaatcgcaataaaatccgttagaatacgtggtaaaaataacactataacgataagacaaactaacacttgtcgaataaagtatgtagcaaacgacaacaaccaccacctagcagtatacgcactaccagacggatctataaaagatgatatcgtgagcttcttcgacgcagtagaacggagccgaaaaagactaccaataattgacaaacacaaaaaccaatcgctaggttggaaatacctattctccataaaacaaaatgaatattttcttttaccacaacaagtagagaaaatagatattgacacaggagaaataagtatgcaaacaacattttctcccaaagatctaagccatgagtatatcatgaaccccgataactacgcagaactagcgtctcacatctttcgcgtacaatcaattagcaaaacaccccaaggtaacagagatgtcagaatatatctatttaagcaacaatatatatcgggaagccaaaaagactccttacacttgaaaggaattactcatcgccaaatatcatcagcaaaagatttagcggagctagttaaaataagagtaaaccacctggggagaattgtaagtgttggagaaaaatga

SEQ ID NO: 5695 - RNA, 4341 nt, synthetic construct
  misc_feature 1..4341: note = Cas9 variant
  source 1..4341: mol_type = other RNA
atggttaagaatatacttggcctagacctaggaacaaactcagtaggctgggctttaattaaacaagatttcgaaaacaaacaaggggacatcctaggtatgggaagccgtatcatacctatgagccaagatgtactaggagatttcggaaaaggaaacagcatttcacaaacggccgaaagaaccaaatatagaagcgtcagaaggctacgagaaagattcctacttagaagggaaaggctacatagggtattaaacgtcctagacttcttacctgaacactacgcatcccaaatagattttaataaaagattcggcaaattcaaagaagagactgaaccaaagcttgcctacagtaacgacggattcattttcaaaaagagttttgaagaaatgatatctgactttaagacacaccaacccgaattattagaaaataacaaaaaagtgccatacgactggacaatatactacctaagaaacaaagccctttcacacaagatagaaaaagaagaacttgcctggatactcctcaattttaatcaaaaaagaggatattatcaactaagaggagaagaagaagaagaaaaccctaacaaattaattgaattctattcactaaaaatagtcgacgtactagctgatgaacctcaaaaaggtaaaagcgacatttggtatagtttaatattagaaaatggctggatatatagacgatcatcaaaaatccccctattagattggaaaggtaaaacacgagacttcatagtaaccactgacctcaatgatgacggatcagtaaaaacagacaaagaaggaaacgaaaagcggtcatttcgagcgccaggtgaaaacgattggaccctcgtaaaaaagaaaaccgaacaagaaatagacaacagtgacaaaacagtaggcgcctacatttatgaagcgttacttcaaaatccaaaacaaaaaataaaaggtaaactcgtaaggacaattgaacgtaaattctataaagccgaacttaaacaaattttagaaaagcaaatggaattccaccccgaactgaggcaagatgatctatacagtgattgtgtgcgagaactttataaaaataacgaagcgcaccagcttaccctctcaaaaaaggattttgtacatctattcatggaagacatcatattctatcaaagaccattaagatcacaaaaatcaagtatctcaaactgtacactagaattccgaaaatataaagacgaaaatgggacagaacacatacagtacctaaaagccctgccaaaatccaacccatattaccaagaatttagaatatggcaatggatgtataaccttaacatatataagaaggaagatgatacaaacgtaacaaaagaattcttgaattcaaaagcagactttgaatccctttttgaattcctaaataacaaaaaagaagtcgaccaaaaagcactccttaaacactttaaaataaacgacaaaacccatcgttggaaatacgtagaagataaaaaatacccttgtaacgaaacaaaaacgatgatctccgaacgtttaaaaaaagtagaaaatataagtgacgacttcctaacaagagaaatggagcaaaaaatttggcatattatttactcggtaaatgataaagttaaatacgaaaaagcactgaaatcttttgcagaaaagaacaacctagacgaaagttctttctttgaagcatttaaaaaatttccaccatttaaatcagaatacggtgccttctcagaaaaagcgataaaaaaactacttccattaatgagattgggtaaatactgggatgacgatgaaattttaaaatattctgacatatactttaagaatattgaatatctgctcggcgtactaaaacaaaaagacaagaacataagcgacgataacagacaaaattggaacaaaagcattaataataaattacgagaagaattagaaatatttcaaaacgcagagatagaatcatttcaaggactaagactacacatagcacaatatatactttacggacgccattcagaagcagctatgctaggtaaatggaactccgcagatgatcttgaagaattcctaaaagaatttaagcaacactcattacggaatcccatagttgaacaagtcattacagaaacactcagagtagtgaaagatatatgggtaaaatatggaaacggagctaaagacttcttcaacgaaatacatatcgaactaggaagagaaatgaaactaccagcagaagatcgcaagaaaataaccaaccaaataagtgaaaacgaaaacacaaacttaaggatcaaagccctgctcgcggaaatgatggtagactcttctgtcgaaaacgtacgaccgttcagccctatgcaacaagaaatactcaaaatatacgaagacggagtacttaatagtgatatagaaatcgaggacgatatcctaaagataagtaaaacagctcaaccatcaccatccgacttaaaaagatataagctatggttagaacaaaaatacaaatctccctatacaggtcaaattataccactcaataagctattcaccccagaatatgaaatcgaacatattattccccaatcccgttactttgatgattcgttttcaaacaaagtaatatgtgaggcagcagtaaacaaacttaaagacaattttatcggtctagggttcataaaacagttcggcggaacaatagtagaatgtggaaacggtaaaagcgttacagtcttaaaagaagaccagtacgaagactttgttaaaaaacattacgcaaacaatcgatcaaagcggaataaactactattagaagatatccctgaaaaaatgatagaacgtcaaatgaacgacacacgctatatctccaaatatatcagtggcgtattatccaacatagttagaacagaagacggcaccgacgatggagtaaatagtaaaaacatagtacccggaaacggaaagataacaaatactttgaaacaagactggggactcaacgatatctggaacgatctaatcctaccgcgatttgaacgcatgaaccaattaacaaactcaacagactttacggcctggaacgaaaatcaccagaaattcctaccaacagtcccagtagaattttcaaaaggttttagcaagaaacgaatagaccatcggcaccatgctctagatgcattagtgatagcctgtgcaactaaagaccatgttaaccttttaaataaccaatcggcaaaaagtgataccaaacgacacgacctaaaacgtaaactcatgaaatttgaaaaggtcgcatacaatcatccccaaacaggtgaacgaatcgaaagagaagttcccaaacaatttttaaaaccatgggaaaccttcacagtcgaggcaaaaaacgggctggaaacaataatagtcagcttcaaacaaaacttaagagtcataaataaggcaacaaaccactacgagaaatacgttgagaaagacggagccaaagtaaagggaagagttgagcaagcaggtaccaactgggcaattagaaaaccaatgcataaagaaacggtctctggaaaaatagatttgccacggatcaaggtacccaaaggtaagatactaactgcaacaagaaaaaatctagatacaagctttgacctaaaaacgattggtagtataacagatacaggcatccaaaagattttaaagaattatctacaatacaaggacaataacccagaattagctttcagtcccgaagggatagaagatatgaacaaaaatattgaaaaatttaatgacggaaaagttcaccaaccaatcatcaaagtacgaatatttgaacttggcagtaaattccctttaggacaatcaggaaataaaaaggataaatatgtagaggcagcaaaaggaactaatcttttttttgccgtttacgaagataaaaacgggaaacgttcatacgaaacaataccactaaacgaagtgatagaacgacagaaacaaggcctcacagtagtagacctcaaaggagtcaatgatttttacctaagccccaacgatctagtttatgtaccctcagaagacgaactagagaatgtgtccatgatagattataacaaactctccaatgaaaaagtttacaaagttgttagttttaccgggaatcaaatattttttgtcagacaggacgtcgcaacttcaatagtcaataaagccgaattctcaagcctaaataaaatggaaagagccataggcggcaccatgataaaagaggtattcgttaaaatcaagatagatagactaggtaatatatccaaagtatga

SEQ ID NO: 5696 - RNA, 4347 nt, synthetic construct
  misc_feature 1..4347: note = Cas9 variant
  source 1..4347: mol_type = other RNA
atgaaacacatattgggactcgacctgggaaccaattctataggatgggcagtagtaaaagaagcacagaacgataacgaacaaagcgaaatagtagacgtcggagttcgggtaaacccattaactacagacgagaaaacaaattttgaaaaaggaaaaccgatatcgacgaacgcagatagaactttaaaacgttcagcaagacgaaatttacaaagatataaattaaggcgaaaagaactaatagaactattaaaagaacaccaattaataagtgaaaataccatcctaacagaaaatggaaaaggaacaacatttcaaacactagaacttagagcgaaaagtgccaaagagaaaataagtttgggagaattggcaagagtattcttgacaatcaataagaaacgaggatataagagtagtagaaaagcgaaaaatggagacgaaggacagctaatcgacggaatggaaatagctaaaaggctatatgaagaaaatctaacaacgggccagttatcactacaactccttaaagaaggcaagaaatcgctaccagactattacagatcagatctacaattcgaattagacaaagtctggaatttccaaaaacaatcgcattccgacatactcaccgacgaattttatgcccagctcaaaggcaaaggacaaagagcaacatcagctttattcttagcaaaatatcagatatacaccgccgaaaacaaaggaagtcgagaagataagaaattacaagcataccaatggcgagttgatgcattatccaaagaattaacaagggaagaactagcatttgtaataacggaaatcaacaacaacctaaacaactccagcggttatctgggggccattagtgatcgatctaaagaattatacttcaacaatgaaactgttggggaatatttatggaaacaaatagctgcaaaccctcacaactcactcaaaaatcaagtcttttacagacaagattacttggacgagttcgaacaaatatggaaaacacaatctgccttttacccggaaatcttgacagacgaattgaagaaagaattaagggatgtagttatattctatcaaagaaaattaaaatcccagaaaagtctagtatcattttgtgagttcgaaaacaaagaaatagaaatcaaaaatgaagatgggacaactaccaagaaagtaattggcttaaaagttgcaccaaaatcaagtccactattccaagaatttaaaatctggcaaaatctaaataacgtgttaattcgcaagaaaggatcaaaaaccaagaaagtagccaaaaaccaacaagcagtactattcgaagaagagaaaacaattagtgaactggacttagaagccaaacaagccctcttcaatgaattaaatttaaaaggaaatcttaaagcagactattgcttggaaatactaggatacagcccaaaagaatgggaaatgaactattcaatccttgaaggcaacagaacaaacaaagctctatacgaagcctatttaaaaataacagaccttgaaggctatgatgcgaaaaaccaccttaaagtaaaactgaataaagatgaagtagaactcgatgacctaaaagtaccagcaagcgaaataaaagacatggtacaagcaatattcaaagaagcaggcatcaatacagacatcttacatttcaacgccgaactcgatggtaaagattttgaaaatcaagcaagctatcagttatggcacctcctttactcctatgaaggcgacgatagtaaatcaggcaatgaactactatacaaactcctcgaaacaaaatttggctttaagaaagaatatgcgcaaatcctcgccaatgtgtcattaagtgacgattatgggaacttaagcaccaaagccatgagagaaataatcacacatctaaaacaaggctttccattcacaggtcgaaaagaccgcccagacgaaccttcagcttgtgaatttgcaggatacaaacactccaaacacagtctgacaaaagaagagaacgagaaacgcgtactaaaagacagtttggaggtcctaaagaaaaactcactaagacaaccagtagtagagaaaattttgaatcagatgataaatctagttaacgcactactaaagaaatacagaacagaaaatccaaacttcaaattcgacgaaattcgaatagaactagcaagagagctcaaaaagaaagcagaagagagagcgaacatgacagctaatatcaacaaagcaaaaacagaacacgagaaaataatcaaaatactcaaaaacgaatttgggctaccgaatccaaccaggaatgacataattagatatagattatacgaagagttaaaagataacggctacaaagatctatataaaggtgactacatcccaagagaaaaacttttcagtaaagaaattgatatagaacatataatcccgaaagccagagtattcgatgattcattctcaaataaaacgattacttatcgaaaaacaaatctcgaaaaaggcgaaagaacagcgtacgattacatagaatctctaggcgaaaaacaattagaagagttcctgtcaagaatagaaaatttatatgaaatagggaaaccatcaagactacacaatagaagaaacccattaaagaaagtagaagagaaagggatatccgacagcaaatataaaaagttgctaaagaaagaatcagaaataggggacggatttgtcgaaagagatttaagggaaacccaatacatagcaaagaaagctaaagaaatattactacagataaccagaagtgtcttatcaacatcaggcggaattacagaccgattacgtgaagactgggatctcatcaatgttatgaaagaacttaacttaccgaaataccgggcattaggtctgacaaaaatggaagacagaaaatacggtcaacaagttgaagtaattacagactggacaaagcgaaatgacttgagacatcacgctatggacgcactaaccgtggcattcacaaaacataaccacatacaatacctaaactacttaaatgcccgtaaaaatgaaaaacacaaagaacataataatataatggcaatacaacaactcgaaacgattaaagttacagacgaaaacggaaacgagaaaagaatatttaaggctccaatgccaaattttagacaagtagcaaaagcatttctcgaaaacgtattaattagccataaagctaaaaataaagttgtaaccaaaaacaaaaataaaatatccggcaacaacaaagtccaagaagtgcttaccccaagagggcaactacacaaagaaacgatatacggcaagtatcaatattatgtccaaaaagaagagaaaattggtggaaaattcgacctggaaacaattgaaaaagtcgcgaacccactctatcagtcactacttaaaaagagactcgaagaaaacggaggggaccccaagaaagcctttaccggcaaaaatagcctagcgaaaaatccaatatacctagacgaagctcaaacagaacaactacccgaaaaagtaaaacttgtatggttagaaaattccttcagtatacgaaaagacataacgccagaaaatttcaaagatgaaaaactgatcgacaagatactagacgagggtgtaaagcgaatactcaaagaacgattgcagtcattcggtaatgacgccaagaaggctttctcagacttagagaaaaatcccatctggcttaataaagaaaaaggaatagcaataaaaagggtcacgatctcaggagtagcaaatgctgaaccactacacaccaagaaagaccatctcggcaaagaaatactagacaaagaaggaaaacctattccggtagacttcatatccaccggatcgaatcaccacgtagcagtatacagagacgaaaaaggaaacctacaagaaaaggtcgtatcagtattcgaagccgtggttagggcgaaccaaggattaccaatcatcgacaaaacgtacaaccaatacttagggtgggagttcctcttttccatgaaacaaaatgaaatgttcgtgttcccaaacgaaagcacgggattcaatccaaatgacatagacctgctagatccgaaaaataagaaaattatttcccctaatctattccgagtacaaaaactagcgacaggggattattggttcaggcatcatttagaaacaacagtagaaacaaagagcgcaacaaaagacatgacctacaaacgtttatcattaaaccatatcaaaaacatcattaaagttagaataaaccatcttggtgacatagtaagtgtaggggaatattga

SEQ ID NO: 5697 - RNA, 4353 nt, synthetic construct
  misc_feature 1..4353: note = Cas9 variant
  source 1..4353: mol_type = other RNA
atgaaacatatattaggactcgatttaggatctaactccataggatgggcgtttgtacaacaagattttgaaaacaaacaaggaaaaataatagcaacaggtagtagaatcatcccgatggatcaaggcattcttggagattttgaaagaggaaacactgtatctcaaactgcagaaagaactacatacaggaatactagaagacttagagaaaggcacctactaagaagggaacgacttcacagagtattgcacatactaggttttctccctccacattatgacagtcaaatagatttcacgaaacgatacggcaaatttattgacaatgccgaaccaaaaatcgcttacaataatggtaacttcatatttatgaacagttttaacgagatgatagaagactttaagaaataccaacctcaactattttacaagaaatccaatggagaagaatcaaaaataccatacgactggaccatatattatctcagaaagaaagcactaagccagaaaataacacaacaagaactggcctggctaattttacattttaaccaaaaacgaggttattatcaacttagaggagaagaagaaactgaaaatccaaataaagaagtggcatttcattcattagaagtagtagatgtagaagcggaagcaccgaataagaaaggagaaatttggtacacgataagactagaaaatggatggatctacagaagaacctcaaaaattcctctcgatgattggaaaggcaaaacaagggacttcattgttaccacagatctaaatgacgacggtacaattaaactagataaagaagggaaagagaaaagatcgtttcgcgctccagatgaaaacgactggaacctactcaaaaagaaaacagaacacgatattgatttcagtggcaaaacagtaggagcgtacatatatgatcacctactgcaaaatccaaatcagaaaataaaaggaaaattagtaagaacaatagaaagaaaatactataaagacgaactcaaagcaatattagcaaaacaaatagcactacaaccagaactctttacagaaacccttctagcagactgcatcagagaactttacaggaaaaacgaaacacaacaacaaaatttattaagcaaagactttttacacttatttgtagaagacatcatattttatcagcgaccactaagatcaaagaaatctactatagctaattgcacattagagaaaagaagttacatagataaagaaacaaatgagagaaaagacacaccaataaaggtctgtgctaaaagcaacccatactatcaagaatttagagtcttacaatggctacagaacctacgcatatacgaaatagaaactgacagagaagtcacggcagaatttatcgaaacagcacaggataacgaggcacttttcaacttcttaatgagccaaaaagaaatagacaatgagtctttactaaaatacttcttattcgcgaaaaacccccaaatcaaagataaagtagcaaaatcagaattaaagaaatggttaacaacatatagatggaactacgtttacgatgcagcagataacagcagcaagaaatatccaatgaacgaaaccggatatgaattacaacaatacctacaaaaagtggagggattaccagccaactttctaaccttcgacataacatatagactctggcacttactatattcagtaaaagacaaagttgaatttgaaaaagccctgaagaaatttgcacaagaataccaacttgacgaagcatcattcgtagatagctttaaaaacttcaaaccatatccaaacgaatacggatctttcagcgaaaaagcaatcaagaaattactaccacttatgagattcggaaaccactgggactttaaccgtatcgacgtatcaacccagaaaagaatagatgacttaattaacggggtcgcaaatgacgagatccgtacgataatccgcgagaaagcagaaaaataccaactaaacagcgaaacatgttttcaaggactccccctatggcttgcccaatatgtagtctataacagacacgccgaagcagcagacatcgaaaaatggaccagcgtaaacgacctagaagcctacttagaagacttcaaacaacattccttacgaaatccaattgtcgagcaagtcataacggaaactctgcgagtagtaagagatatatggcaaagatacggaggtggtcaagcaaacttcttcgacgaaattcacatagaattaggtcgcgaactaaagaaaactgcagaagaacgaaagcaactctcaaaccgaaaccaggaaaacgaaaacaccaacctacgaatcaaaaagttactagcggagctaaaagaagacgcgtcaatacaaaatgtaagaccttatagcccggtacaacaagaactattaaaaatttatgaagaaggtgtattctctgcgacggatgaagtagaagaagacatacagaaaattagaaagaaagccgaaccaacaaccccagaaatacagcgttacaaactatggctagaacaaaaatacaaaagtccatatacaggagaagtgatctcccttacaaaattatttacagaagaatacgaaatagagcatataattccccaatcgcgttattatgacgatagtctttcaaataaagtaatttgtgaatctgcagtaaataaactcaaaacaaaccaattagggcttgaatttattcaaaatcatcatggcgaaaaagtacgtatcacagccaataaagaagtaactatattcacagaagaacaatataaagagttcgtcaagaaacattatgccaataacagcgcaaaacaacaaaaattgctgctaaatgaaattccagagaaaatggtagcaaggcaattaaatgacacacgatatatctcaaaatatataagcgaaatactatcgaaaatagttagatcagatgaaaaagatgagggtgtgaatagcaagaatatcattccgtgcaccggaaaaataacgacagcccttaagcaggattggggtctcaatgatgtatggaacgaactaattttacccagattcgaaagaatgaatcaattaacacaaactcaattatttacaagctacaacgacaggttccagaagaacttaccaactgtgccaattgaatacagccaaggattccagaagaaacgaatagatcaccgtcatcacgcaatggatgctctggtaatcgcctgcgcaacaagagaacatattaactatatgaataatcaacacgccctagataaatcaaaagataagaaagaaaaacaacaatcacgaatagatcttcgcacaatcttatgtgagaagaaaaataataattggcaattcaagaaaccttggtcaacattcactcaggaagcacaggaagcattagaacatattgtagtaagtttcaaacaaaacctccgcgtcataaacaaagcaacaaactactatgaaaaatgggaagagaaaaatggtgtattagtcaaaaagaaagtaaaacaagaaggcacaaattgggcaataaggaaaccgttacacaaagaaactgtgagcgggaaaatagtattggaccgaaaaataggcaaggacaaaattcttacagcaacccgaaaatctgtagatataacttttaccgagaaaattatctcaagtataacagatacaggtatccagaaaattctcttaaattaccttaagtataaaggcagcccggaagtggccttttccgccgaaggactagaagaactaaacaaaaatatcgcacaatataatgatggaaagaaacaccagcccatctacaaagttagaatttttgaagaaggatcaaaatttcctcttggagaaacaggagcgaaagcaacaaaatatgtagaagccgcaaaaggaacaaacctattctttggcgtatatcaaggcaaaggaaaaagaacatatgccaccatccctctgaacgaagtaatagaacgtcaaaaacaaggattaccatcagtgccagaacgtaacgaaaaaggagagcccttactattttcattaagtcctaatgacctagtttatgtcccaatggagggagaaatagctgaaacaatagatttcaacaatttaagtaaagaacaaaaagaacgcatttataaaactgtcagcttcacaggaaaccaatgtttcttcgtacaagaagcagtagctacaccaattgtaaataagatagaatacagcccactaaataaaatggaaagagatatactgggcacaatgataaaagaagtgtgtattaagctaaaagttgatcgactaggaaatattactaaagcgtga

SEQ ID NO: 5698 - RNA, 4353 nt, synthetic construct
  misc_feature 1..4353: note = Cas9 variant
  source 1..4353: mol_type = other RNA
atgaaacgcatactaggactagacctgggttctaactcaataggctgggcattcgtagaacaagattttgaaaataaacagggaaaaataatagctacaggttctaggataatacctatggaccaaggaatattaggtgacttcgaaaaaggaaacacagtgtcacaaaccgcagaaaggacgacatacagaagcatgaggagattgagagaacgacatttattacgacgagaaagattacacagagtcttacacattctaggatttttaccaccacactatgacgctcaaatagacttcacaaaacggtacggaaaattcatagacaatgcagaacctaaaatagcatacaataacggcaacttcatatttatgaatagctttaacgaaatgatcgaagatttcaaaaaataccaaccacaattgttttataaaaaatcaaacggtgaagaaagtaaaataccttatgactggaccatatattacctaagaaaaaaagtcttgtctcagaaaataactcaacaagagctagcgtggttaatattacacttcaaccaaaaaagaggatattaccaactaaggggcgaagaagaaacagagaaccctaataaagaagtggcatttcacagtttaaaagtagtagatgtcgaggctgaagccccaaacaaaaaaggagaaatctggtacactataagattagaaaacggatggatataccgaagaacatcaaagataccactcgacgattggaagggcaaaacaagggatttcatcgtaaccacagacctaaacgatgacgggaccataaaagtagataaagaagggaaggaaaaacgcagcttcagagcacccgacgaaaacgactggaatctattaaaaaaaaaaacagaacatgatatagatttctcaggaaaaaccgtaggagcatatatatatgatcacctattacaaaacccaaaccaaaaaataaagggaaagctagtccgaacaatagaacgaaaatattacaaagatgagctaaaagccatattagcaaaacaaatcgcactacaaccagaattatttactgaaaccctcttagccgactgcattagagagttatacagaaaaaacgaaacacaacaacagaatttacttagtaaagattttttgcatttatttgtggaagacattatattctaccaacgtcctttacgatccaaaaaaagcactatagccaattgcacactagagaaaaggtcttatatagacaaagaaacaaatgaacgaaaagatactttcattaaagtttgtgcaaaaagtaacccatattaccaagaatttagagtactacaatggctacaaaatttaagaatctacgagatcgagacagatcgcgaggtaacagcggagtttatcgaaactgcagaagactacgaagcgttattcaacttcctaatgagtcaaaaagaaattgacaacgaaggactactaaagtatttcctattcgcaaaaaacccccaaatcaaagacaaagtcgcaaaatcagaactaaaaaaatggttaacaacctacaggtggaattacgtgtacgatgccgcggacaacagtagcaaaaaatatcccatgaatgaaaccggatacgatctccaacgttacctacagaaagtagaggggctaccagctaacttcttaaccttcgacataacataccgcctatggcacctgctgtattcggtaaaagacaaggttgagtttgaaaaagcactaaaaaaatttgcacaagaataccaattggacgaagcaagctttgtggactccttcaaaaacttcaaaccatatcccaatgaatacggcagcttctcggaaaaagcaataaaaaagcttttaccattgatgcgttttgggaatcattgggacttcaacagaattgatgttagtacccaaaaaagaatagatgatctaataaacggagtagccaacgatgaaataagaaccattattagagaaaaagcagagaaataccaacttaactcagaatcctgcttccaaggactacctctatggctcgcccaatacgtagtctacaaccgtcatgctgaagcgaccgacatagaaaaatggacttctgtatctgacttagaaacgtatctagaagactttaaacagcacagcttgagaaacccaattgtagagcaagtagtaacagaaactcttcgagtcgtacgggatatatggcagcaatatggtggtggacaagccaatttctttgacgaaattcacattgagctcgggagagaactaaaaaaaaccgcagaggagcgtaaacaattatccaacagaaaccaagaaaacgaaaacacgaaccttcggatcaaaaaacttttagcagaactcaaagaggacgcatcgatccaaaatgttcgaccttattcaccagtgcaacaagaattattaaaaatatacgaagaaggagtattctcatccacagaccaagtcgaagaagatatacaaaaaattagaaaaaaagcagaacctaccacacccgaaatacaaagatacaaactgtggctggaacagaaatataagtcaccatatacaggagaagtaatatctctaactaaactctttaccgaagaatatgagatagaacatataatcccacagagtcgatattacgacgacagtttgagcaataaagttatatgcgaatccgcagtaaacaaattaaaaaccaaccaactaggcctagaattcatacaaaaccaccacggtgaaaaagtacgtataacaggaaataaagaagtaactatctttacggaagaacagtataaagaatttgttaaaaaacattatgccaacaacagtgcaaaacaacagaaacttctcttaaacgaaatacccgaaaaaatggtagcgcgacaactgaatgatacacgatacataagtaaatacatatccgaaatcctcagtaaaatagtaagaagcgatgagaaagacgaaggggtgaatagcaaaaatgtaatcccatgcacaggaaaaataacaacggcactaaaacaagattgggggctaaacgacgtttggaacgaactaatcttaccaagattcgaaagaatgaatcaactaacacaaacacaactatttacatcttataatgaccggtttcaaaaaaatctaccaacagtgccaatagaatattctcaaggctttcaaaaaaaaagaatagaccacaggcaccatgcaatggatgctttggtgatagcatgcgcgaccagggaacatataaactatatgaataatcaacatgcactagataaaaataaagataagaaagaaaaacaacaaagcagaatagatttacgaacaatattatgtgaaaaaaagaacaataattggcaatttaaaaaaccatggtcaaccttcacccaggaaacaaaagaagctttggagcatatagtcgttagcttcaaacaaaatttacgagtgataaataaagccaccaactactacgaaaagtgggaagaaaaaaatggagtccttgtaaaaaagaaagtcaaacaagaaggcacaaactgggcaataagaaaacccctacacaaagaaacggtcagtggtaaaatagtcttagatagaaaaataggtaaagacaaaatacttaccgcaacacgtaaagaggtagacatcacattcacagaaaaaataatatcctcaattacagacaccggtatccaaaaaatattactgaactatttaaattacaaaggttcccccgaagtcgctttcagcgctgaaggactcgaagaattaaacaaaaacattgcgcaatataatgacggaaaaaaacatcaacctatatacaaggtcagaatcttcgaagaaggatcaaaatttccacttggggaaaccggagctaaagctactaaattcgtagaagcagcaaaaggcacaaatcttttctttggggtatatcaaggtaaagaaaagcgatcatatgcaactatccctctaaatgaagtaatagaaagacagaaacaaggattaccttcagtacctgagcgaaacgaaaaaggggaaccactccttttcagtctatcaccaaacgacctcgtctacgtacccatggaaggagagatcgcagagacaatagacttcaacaatctaagtaaagaacaaaaagaaagaatatacaaaacggtctcgttcacaggaaatcaatgttttttcgttcaagaggcggtcgcaactccaatagttaacaagatggaatatagtccattaaacaagatggaaagagatatactgggaacgatgataaaagaagtctgtataaaattaaaagtagatcgtctaggcaacataacaaaagcctga

SEQ ID NO: 5699 - RNA, 4353 nt, synthetic construct
  misc_feature 1..4353: note = Cas9 variant
  source 1..4353: mol_type = other RNA
atgaaacatatattaggcttagacttaggatcaaacagtatcggatgggcatttgtacaacaagacttcgaaaacaagcaaggaaaaataatagctgctggctccaggataattccaatggaccagaaaatgctatcaaatttcgaagaaggcacaacagtaagccaaactgccgaaagaaccacctaccgatcgatgagaagactaagagaacgccacctactacggagagaacgtttgcatagagtacttcacattctcggatttttacccccacattacgacgctcaaatagacttcacaaaacgatacggaaagtttattgataacgccgaaccaaaaattgcgtacaacaacggaaactttatattcatgaattcatttaatgaaatgatagaagatttcaaagaacaccagccccaactattctataaaaaaagcaacggagaagaatcgaagataccatacgattggacaatatactacttacgtaaaaaagccctaagtcaaaaaattacacagcaagaacttgcttggctaatactacacttcaaccaaaaaaggggatactatcaattaagaggcgaagaagaaaccgaaaatccaaataaagaggtagcatttcattcattaaaagtagtagacgtagaagccgaagcccccaacaaaaagggagagatatggtatacaataaggcttgaaaatggttggatatatagaagaacaagcaaaataccgctcgacgattggaaaggaaaaacacgcgattttatcgttacaacagatttaaacgacgacggaacaataaaactggataaagaaggcaaagaaaaacgcagttttagagcacctgatgagaatgattggaatctattgaagaaaaaaacagaacatgacatagattttagtgggaagcctgttggaacctacatttacgaccacctgctacaaaacccaaaccaaaaaataaaaggcaaattagtacgtacaatcgaacgcaaatattataaagacgaattaaaagcaattctagcaaaacaaatagccctacagcctgaactttttacagaaacattgctagcagattgtataagggaactatatcgtaaaaatgaaacccaacaacagaacttactaagcaaagattttctacatctatttgtagaagacataatattctaccaaagacccctccgcagcaaaaaaagcacaatcgctaactgtaccctggaaaaaagaagctatatagacaaggaaacaaacgaacgaaaagacaccccaattaaagtatgttcaaaatcaaacccgtattatcaagaatttagagttttacaatggctccaaaatctccgaatatatgaaatagaaactgacagagaagtgactgccgaatttatagaaaccgcacaagactatgaagctctatttaacttcctaatgtcacagaaagaaatagataatgaatctctgcttaaatacttcctatttgccaagaacccccaaatcaaagacaagactgcaaaaatagagctcaaaaaatggatcacaacatatagatggaattacgtctacgacgtcgctgacaactcatccaagaaatacccaatgaacgaaacaggatacgacttacaacgttatatgcaaaaagttgaaggcttacccacaaacttcttaacgtttgatacaacatatcgactgtggcacttactctattcagttaaagataaagtcgaattcgaaaaagcacttaagaaatttgcaaaaaaaaaacaactggataaaacatcatttgtcgactcctttaagaattttaaaccctatccaaatgaatacggctccttcagtgaaaaagcaatcaaaaaattactacctttaatgcgatttggaaatcattgggatttcaatagaattgacgtatcaacgcaaaaaagaatagacgatttaataaacggagtagcgaacgaagatatccgaacaataattcgcgaaaaagccgaaaaatatcaactgaactcggaaacatgctttcaagatttaccactatggcttgcccaatatgtcgtatataatagacacgccgaagctactgacatcgaaaaatggacatcagtaagcgatctagaagcctatttagaagatttcaaacaacatagcctaagaaaccctatcgtcgaacaagtagtaaccgaaacgcttcgcgtagttagggacatatggcagcaatatggtgggggacaagcaaatttttttgatgaaatacacattgagttaggcagagaattgaaaaaaactgcggaagaaagaaaacagctatccgacaaaaatcaagaaaacgagaacacgaatctaagaataaaaaaactccttgccgaactaaaagaagacgcaagtattcaaaacgtcagaccatactcactagtacaacaagaattgcttaaaatatatgaagagggtgtatttagttcaacagatgaaattgaagaagatatacaaaaaatacgtaaaaaagtagaacctacaacaccagaaattcaaagatataaactatggcttgaacaaaaatataaatcaccatataccggagaagtgatatcattaacaaaactcttcacagaagaatacgaaatagaacatataataccacaaagcaggtattacgatgatagtttatctaataaagttatctgcgaaagtgcagtaaataaactgaaaactaatcaattaggacttgaattcatacaaaaccatcacggcgaaaaagtacgcataacagccaataaagaagtcacaatattcactgaagaacaatataaagaatttgtaaaaaagcactatgctaacaactcagcaaaacaacaaaaattactattgaatgaaataccagaaaagatggtcgcgcgacaactaaatgatacacgatacatatcaaaatatatctccgagatactaagcaaaatcgtaaggtctgacgaaaaagatgagggggtaaacagcaaaaatattattccctgcacgggcaagatcacaactgcactaaaacaagactggggacttaacgatgtatggaacgaattaatcctacccagattcgaaagaatgaatcaattgacacaaacacaacttttcacatcttataatgatcgattacaaaaaaatttgcccacagtcccgatagaatactcgcaaggcttccaaaaaaaacgaatcgaccaccggcatcacgcgatggatgccctggtcatagcatgcgcaactagagaacacataaactacatgaataaccaacatgcattagacaagtcgaaagataaaaaagaaaaacaacagagcagaatcgacctaagaaccatcttatgtgaaaaaaaaaacaacaactggcaattcaaaaaaccatggaggacattcacacaagaagcaaaagaagcgttggaacacatagtagtaagttttaaacaaaacttaagagttataaacaaagcaacaaactactacgaaaagtgggaagaaaaaaatggtgttctggtaaaaaaaaaggtaaaacaagaagggacaaattgggcaatacgaaagccgctacacgaagaaacattctcaggaaaaatctcactgaatcgggagaaagtcggaaaaggtaacatcttaactgccaccagaaaagcagttgattcaagctttgacgttaaaaaaataagcaaaataaccgatacggggatacaaaaaatattactcaattatttaaaatacaaaggttccccagaagtagccttttctgctgagggactggaagaactcaacaaaaatattgcgcaatacaacaacggaaaaaaacaccaacccatatataaagtacgaatttacgaaaagggctcaggaagattcgtcctaggagaaaaagggacaaagtcaaaaaaatacgtccaaggggcacctaacctatattttggcgtatatcaaggaaaagaaaaaaggacctacgcgaccattccgctaaatgaagtaatcgaaaggcaaaaacaaggactacccagcgttccagaacggaacgaaaaaggggaacccttattattctcgctatctcccaacgacctagtatatgtaccaatggaaggagaagctacggaaacaatcaatttcaataacctaaataaagaacagaaagaaagaatatataaaaccgtatcctttacaggcaatcaatgtttttttgtacaagaagcagtcgcaagccctatagtaaataaaatggaatattctccattaaataagatggagaggtccatagtgggaataatgataaaagaagtctgtataaaactaaaagtagacagacttggtaatattacaaaagcctga

SEQ ID NO: 5700 - RNA, 4362 nt, synthetic construct
  misc_feature 1..4362: note = Cas9 variant
  source 1..4362: mol_type = other RNA
atgaaaacagtactaggtctggatttagggacgaatagtattggatgggcacttatacaacacgattttgatagtaagaaaggagaaatactcggtatgggaagtcgtataatacctatgtcacaagacatactaggcgagttcggcaaaggaaattccgtatcacaaacagctgacaggacaaaattcagatcagcacgcagacttagagaaaggcacttattacgcagagagcgcctacacagagttcttaatatacttggattccttccacgccattacgcagccgacatagactttgaaaaacgactaggacaattcttcgaaggaaaagaaccaaaattggcctatgataataatcaattcatattcacaaaaagtttcggtaaaatgttagcagactttcgccaacatcaaccagattttctaaaagacgaaaaatcaaatgatctgttaataccatacgactggtccatctactacctccgaaaagaagcccttactaagaaaattgaaaaagaagaactagcatggataattctaaactttaatcagaaaaggggttattatcaattacgaggagaagaagaagaagaaaaccttaataagctagtggaatttcactccctaaaaattattgatgtagtagcagacgaaaaactaaataataaaggagaaacctggtactcactcctcctagaaaatggatggacatatagacgatctagcaaagtaccattattcgactggaaagaaaaagtaagagattttattgtaacaacagacataaatgacgacggttctgtcaaaacagacaaagaaggaaatgaaaaacggtcgttcagagcaccctcagatgatgattggacacttctcaaaaagaaaacggaacaagacattgacaaatcacgaaaacctataggtgcgtatatatacgatgctatattgaaaaatcccaaacagaaaattaacggaaaactcgttcgaacagttgaaagaaaattttacaaagaagaactaaaattaatcttgcaaaaacaaaaagaatttcacccagaactccaatctacagacttatacaacgaatgtattcgggaactatacaaaaacaacgacgcacaccaactccaattaaataagaaagacttcgtccacctattcttagaagatataatattttaccaacggccacttcggtctcagaaatcatctgttggcaactgtcccttagagttccgcaaatttaaagactctgaaggaattgaaaaagtagaataccttaaaacaattccaaaaagcaacccatactttcaagagttccgtatatggcaatggatgtacaatctctctatatacaagaaagacgatgacgaaaacgtaacaagagatttcctaaaaacaatagaagactgggaagatttatttgaatttcttaaccatagaaaagatatagaacaagaaacactcttaaaatttctactaggtaaaaacggcgttaaaggtaaagccttgaaagtagaagcaggaaaattcagatggaactacgtatcagataaaatatacccttgtaacgaaactaaagcacttataatttcgaaactagaaaaagtaaaaggcgtcgaagaaaaatttttaactgaagaaatagaatataaattatggcatctaatatactcagtgacagacaaagtcgaatatgaaaaagctcttaaagcatttgctggaaaacaaaaattggatttagtatcatttgtagacagctttaaacgattcccacccttcaaaaacgaatacggtgcatacagcgaaaaggccataaagaaaatattaccactgctcagaacaggaaaatcatggaactggatggccattgatagtaaagttcgagacagaataaataaaattataacaggagaatttgatgaagaaatcaaaaacaaagtaagagaaaaagcggaaaaacactccctgaagaaagaaaatgacttccaaggattacccctatggttagcacaatacgtcgtatatggtcggcactctgaagcatcattctctgggaaatggaactcagtagatgatcttaagaaatatctagaagagttcaaacaacactcacttcgcaatcccattgtagaacaagttctaacagaaacacttcgagtagtagcagatatctggcaattctacggaaaaggtgaaaaagactttttctcagaaatccatatagaactaggcagggaaatgaaaaacactgcagaagatcgaaaagaaatgagtgctattatacaagcgaacgaaacgacaaacctaagaattaaagccttactaaatgaactgctacaagacaagaaagtcgaaaatgtaaggccatactccccctcacaacaagaaatactgaaaatatacgaagacggagtgctatcatcagatatcgagatacctgacgacattcagaaaatatcgaaagctgctcaaccgacaaaatcagaattacaaagatacaaactatggctcgaacaaaaatatcgatcaccatacacaggagcaatgataccactcgggaaattatttacaagtgagtatgaaatagaacacataattccacaatccctatatttcgacgactcattttctaataaagttatctgcgaatccgccgtaaataaattaaaagattcgaggctaggaatggagttcataaaagaatgccatggaatggttgtggaaacaggatttggaaaatcagtaacagtttttgaagaagaaacgtacagagactttgttgtccaaaactacagcaaaaatcactcgaagaaatcaaaactcctcctagaagaaatacctgagaaaatgatcgaacgtcaaatgaatgatacaaggtacataagcaaattcatcagttctgtcctatctaacatagtacgagaagaagtaaacgatgatggcgtaaactccaaaaacatagtccctggaaacgggaaaataacgacgcaattaaaacaagactggggactgaacgatatatggaacgaactgatcttgcctcgcttcgaacgcttaaatgtactaacagactcaaaacattttacagcctggtcagaaaatcaccaaagattgcttccgacggttcctataggattaagcaaaggattcagcaagaaaagaattgaccacaggcaccatgcattagatgccttagtaatagcttgtgcatcacgtaaccatatcaatttcctaaacaatgcacacgctatagacaaaaagaaaaacagtgaggaaaaacaaaaatttagacacgatctaaaagccattctatgcgataagaaatacagtgataaatcagaaaagaactatcgatggatatttaagaaaccatgggacaacttcacgatagatagcaaaaacgctctagacaaaataatagtcagcttcaaacaaaatttgagaataataaacaaagcaacaaatagatacgaaaaatgggtagacagagatggtataaaagtaaaagaatggcataaacaagaaggcataaactgggccactcgtaaaccactacataaagacacagtaagtggaaaagtagatttaaaacgagtaacggtaccagaaggaaaaatactcacagcaacaagaaaatccttagatacatccttcgacttaaaggtcatcgaatcaataactgacacaggtatccagaaaatactaaagaactatttaacatcaaaatccaacaacccagaactggctttcagcagtgaaggcgtagaggatatgaataaaaatataagaaaatacaacgacggaaaactgcaccaacccatttataaagtacgaatctttgaactgggctcaaaatttccactagggcaattcggaaacaagaaattcaaatatgttgaaacagctaaaggaacaaatctattctttgcagtatacgaggacgaaaataaaaaccgaaattatgaaactataccactaaacgtagtcatagaacgccaaaaacaaggtctatcctccgtacccattaagagcgaaaaaggacataaactcttattttacttgtctccaaatgacattgtgtacgtacctggctccaatgaagaatttagtatagacagattatacagatttaccgacagcagcgacaaaacagctaattttattccattatcagtttcttctctaatattttcatctaataaaaacgaacaaaagaaaataggaattagctatccgatacaagacgagttcggattaggttccccgcaaagcaaaaatcaaaaatcaatagatggaatcatgataaaagaaaagtgcgtaaaagtaaatattgacagattaggaagagtatcattctga

SEQ ID NO: 5701 - RNA, 4368 nt, synthetic construct
  misc_feature 1..4368: note = Cas9 variant
  source 1..4368: mol_type = other RNA
atggcaaaaattctcggtttagacctaggcactaatagtatcggttgggctgtagtagaagaccaaaataacaaaaccaccttaatagacaaaggagttagaatcttctccgaaggagtgaaaatagaaaaaggcatagaaaagtctaaagcagctgaaagaactgatttcagaagtgcacgcaaaatcaaattcagacgtaggctaaggaaacaagagaccctaaaagtcctaatagaaaacaacatgtgtcccctcacaattgaagaatggaccaaatggaaaaaagacaaaaaagagtatccgaaaaaccctgactttattaactggctaaaaacagatgagcttaaaaacataaatccctattttttcagagacaaggctagtagaacagaattacctctaatgcaaacaggtagggcactataccatttggcccagagacgcggatttctatcaaatagactagaccaagggagcgatggatttacggagcaaatcagattagatctaataaaaaagatagaatgtgaaaccgataaaacagaattactaacatcagtacaatctataatagatacctattcagaagaagaagacaaagacgcaaagaaactgctaaaaggcgttgagaaattatgcaaaataaacaatgaactaccaataaccgaatttaaggaaaagcttatcaactatctaaataaagccgacaatttaggtgctgtaaaaaaaggaatagcggatgtgagtaaaaaaatcacagaaaccggttgcgaaactttaggtcaatacttttacaagttgtaccaaaaccaatcaaaaattaggaaagtttatacagcaagaaccgaacactattatcacgaattcctaaaaatatgtgagacacaaaatatctgtgaccaactgaaacataaactagataaagccattttttaccaacgaccactcaaaagccaaaaaggacttataggcaaatgcgtctttgaaaaaaacaaaacacgatgtgccgtatcacaccctgcatacgaagaatacagagcattacaattcataaatagtataaaagtcagcgaaacaaaagacggaaaaaaagactttctttcttttgacgaaagaaaaaaaatatggcccaagttcattagaaaatcaaaaccaaatttcgacttcaaagaaatagcggaaacactagacaaaaaaggattaagtcgttattataattacacaggacacacctcagtatcgggctgcccaacaattgcacaattaacaaatatattcggggaaaattggcaagaaacacttttcgaaaaatacactaataagcaaaacacaaagggtttaaaaaccatcgacgaggtcgtaacggatatatggcatgtcttattcacatttgataaagacgaaaaaataatagaattcggaaaacaaaaattgggactaaacgaggtattagcaaaaaaattcggagctataaacctaaaaaaagactatgcaagtttatcactaaaagcaataaataaaatattaccatacctacgagaaggactgatatactcttacgctgtatttctcgcaaatatagagaatgtggttggagaagaaatatggaaaaatgacgaaaacaaaaatcttataaagaaggaactacatttactaatcgataacttcaacgaaataaaaggactggaagcagtagtaaatgactttatagccgacttcaaaaaagaatacaacaacgcacacaaggattacgtattagacgagcaagacaaaaaaatactcctagaaaaaatagagtcaaattatggaaaaaataaatttgaaagcttagaacccgacaagaaaacggaaataataaacagtaccgaaaaaatggtagccgaacaactcagaaaacaaagaggagaattcataaaaccaaaacgtctagatgaaaaaataagtgaattcctcataaataatttcaacgtaaccaaaaaaagcatagcaagattatatcatccgagtgatgtagaaatcttcaaaacggcctcacgaaatagtgaaggacttctgctcctaggcagcccaatagtttcttcaattaaaaaccctatggctatgagagcgatgcaccaactacgaaaactagtaaatactctaataaaagaaaacataattgatgaagaaacaaaaataaatatcgaattagccagagaattaaacgacgcaaacaagagagccgcaataaaaaaatggcaagacgaaaggcaaaaagcacgagaagaatacaaaaaatctataaaagagttattcaaggcagagtgcggtaaagacatagaaccttccgacagtgaaattctcaaatacgaactatgggaagaacaacaacatatctgcatttatacaggaaaaacaataaatatatgtgactttataggagcaaacccaaattttgatatagaacatacaataccaaaatcactctgctttgataacagtaacgaaaacttaactctatgcgatatccaatataaccgtgacgtaaaaaggaacaaaatccctaccgaattatccgattataatagcataaaaccaagattggacaagtggctagtatttatcgatgactacgaaaaattatataatacacgaaaaaaggcaaagggaatcgaaacaaaagaacaaaaagacaaaagaataaaagagaaacactactacaaactgcacttagattattggaagggaaaatacaaacgatttattatggttgacgttccctctggatttaagaatagtcaaatagtagacactggcataatcacgaagtatgctatatcatatatgaaatcgatatttcccaaagtatactctgtaaaaggaaacatagtagcagagttcagaaaaatatggggtttacagaatgactatgaaaaaaaggaaagagttaatcacgtacatcattgcattgatgcaatcactatagcatgcatgtctaaacaaaaatatgacacactggcgaaaatataccacgaagatgaagctggattccataaaataaaaaaagaaacacaactagtaagtaagccttggacatcattcacaatggatgtcctaaacatcgaaaaagaaatctttgtgtcacaccacactcccgacaatatgaaaaaacaatcaaaaaaggtagttcgtgaacgaggtataatagcaccaaaagtgatttacgaaacagacgctaacaataacaccctacgagataaatatggcaaaaaaatagtcaaagaatatatacttctaaaagacgtaaatggaaacttaatccctatcaaagggaaaagattaaccccaagcgatattattaacaaagttgatggaattgattacttcagtttgataatcaacgacaaaatacaatattatgaattcgccaaatcaaaaaaaacaggtaagataatatacaagaaagaaccaatctatttacaaggtgatacggtgagaggatccctacacttagatacattctacggcgctatcgctaaggatatcaacggcaacataatcacgaacaccaacggaaaaatcgctccaaattacgtcataagaaaagagcttagtaaattaaaagaaactgacatagagaacatagtagatcccgtagtaagaggcaaaatcatagaggcaaagaaaaataaactgatcacattcaacaaatcaggtgcagtaatcaaaacaaccatttggatgaaagaaaatcagattcccataaacaaagtcagagtgtattcatccttaaagaacccattacccgactttaagaagcatagggacttaagtcaccttacgtataaacaacagtataatgtatcaaatgaagaaaactactgtctggcgatttacgaaggaaaaaataagaaaggtaatgtttgcagaacgtgtgaattagtaaatatgatcgatgccggcaactattaccgtctctccaataaaaactggaaacaacaatatccaatagtacctgaaaaagactcagtaacaaactacagcctcaaaacaatcataacaaaaggattaatggtcttgctatatgagaaaagtccagaagaaatatgggaactaacctataatcaacaaatggagcgactatacgaaataacccaactcgacactgaaaagtcagcggaaataaaactactttttcaccaagaagcacgagaaaaaaaagtcataaccgaatatatgggcctaaaaacaggcatgaaaggaggcaaaaacatcggtaaacacaaggaatttccgtggatcaaagtgggaccaaactcttttgatgcactcatcgaaggtattgattttaagctaacacctacaggaaaaataataaaactatga

SEQ ID NO: 5702 - RNA, 4374 nt, synthetic construct
  misc_feature 1..4374: note = Cas9 variant
  source 1..4374: mol_type = other RNA
atgaaaacaatcctggggctcgacttaggcacaaactctatcggatgggcaaaagttagcgtagacgattatggtaattacctacatgatataaaacttggatcaagaattatacctatgagtcaagacgtgttaggaaattttgactcaggcgtcacagtttcacaaacagcccaacgcactgagtttcgttcaaaacgaagattagttcaaaggaacttacaaagaagagagcgcttgcatagagtactccacgtactagacttccttccagcacattatgatgcagcaatcggatgggaccgaacagaagcagttacctacggcaagttcctaaaccatgccgaacctaaattagcatgggaagagttaggaaatgggaaaagaagattcttattcatggatagtttccacgaaatggtagcagactttgcaagatgccaaccagcattagtggctgacggaaagaaaatcccattagattggacgatttactacttaagaaaaaaagcactaacccaagcaataacgaaggaggagcttgcttggatactactcaacttcaaccaaaaaagaggctattaccaattaagaggagaagaagaagaagaaaatccaaccaaacaagaagagtactatgaattaaaagttgtaagtgtagaagccactgatagtcgaaaaggaaacgatacatggtataatgttcacctggaaaatggatggatctataggcgtagttcgaaaatttcattagatgattgggtaggaaaggttaaacaattcatagttaccaccgagtacgagaaagatggagcgactttaaaaacagacaaagaaggatatgtaaaaagaagtttcagagcaccaaatgaaaatgattggggattaagaaaaaaaagaaccgaaaccttattagaaatgtcaggaaaaaccgtgggagcatttatatacgatcatcttttacaagaacccgccgataaaataagaggtaactttatcaggacaattgaaagacattattacaaagcggaacttgaggcaatcttagcagaacaatgcaaatatcacattgaactacgtgataaagaaatgctagaagcgtgtgcacgagaactatatttgaataatctaccacatcaaagatctctaatgaaaaaagatatgacatatttactattatatgatctcatcttttaccaaagaccactaaagtcaaagaaagcactaatagcaaactgtccatatgaatattacgaatacgtagacaaagagaccggagaaataaaacggcaaaatatcaaatgtatagcaaaatcaaatccatatttccaagagtttagactatggcaatttgttcttaacttacgcctatttgaccgagtcgaagacaaagaagtaacagcaaactatctaccaacagcagacgatcacgcacggttatttacctacctaaacgatagaaaagagataaaccaggaaacattattaaaagactattttaagctaaaaaaagtgaagattggaaacgaaaaagaatacccgatacgatggaattacatcgaagacaaagaaaagaaatacccctgcaatgaaacaagatatgaactactaatggcattagatagggcaggaattgagcacaaatggttagacgataataatctagaatacagactttggcatttactatacagtgtggaagttaaatcagaaagtgaaacagcactcagaaaattaaaaaatgatgatgcctttgtgaattcattcttaaaagtaaaacctttcaagaaagaatacggtgcatattcagaaaaggcaattaaaaggctattagcagtaatgaggaaaggattcctatggaatgaacaagatatatgcgacgaaactagaaaaagaatagaaataatcattaaaggagatgtcgatgaaaaagtaaaagagagaatgggtcatgcagcttactcatttgaccgagtctcagacttccaaggattgccagaatggttagcctgctacgtagtatatggacgtcattcagaggctatggacatacagcattgggactctcccgaaagactaatggcttatataaataactttaaacaatatagcctacgaaaccccatagtagagcaatgtatactagaaacccttcgaacagtgcacgatatatggaaagaaacaggtcagatagacgaaatacatgtcgaattaggaagggaaatgaaatcgacatcagaagaaagagcacgacgaacccaaaatgtcttaagaaacgagaatacgaacctgcgaattaaaagtttacttatagaacttaagaacgatacagacatctgcaatgtacacccatattcaccaatgcaacaagaaatcctaaggatatatgaagaaggagctcttcaggaattaaatagagaagatgaggacttcgaagaaatttcgaagatatcacaaatgtcccaaccatcaggtaaagaactaaacagatataaactgtggttagaacaaaaatataggtcaccatatacaggaaaagcgatatcattagccaaattatttaccccagcatatcaaatcgaacacgtaatcccacagagtagatattttgatgactcattcacaaataaagtaatatgcgaagctgaggtaaacacacttaaatccaatctcttaggctacgaattcattaaaaaacatggaggcgaaataatacactgcacaactctaggtgatgtacgaattttttccgaatcagaatataaggcctttgtaatggatcattatgctaataataaaagcaaaaaagataaattattaatggaagacataccccaagaatttctaagccgacaaatgaatgacagcaggtatatatctaaagtcgtgaagacattattaagcaatatcgtacgaatggctgacgaaagtgaagcaacctcgaagtccgtaatagtatgtactggaggtgtaacagacagattaaaaaaagactggggtcttaacgatgtatggaacagcattgtatattccaggttcgaaaggttgaatcgactcacggggaccgaagcattcggacactgggaaaataaagatggcaagagagtattccagacatcgatgccactagaactacaacgaggattccgtaaaaaacgaatagaccacagacaccatgctatggacgctttagttattgcatgtgcgtctcgcaatatcgtaaactatttgaataatgaatccgcgaataacccaaagaaaagggaagacctcagacgccaattatgtgataaaaacagagtgatccgaaaaccctgggaaactttcacccaagacgcatataacgcgttagaaaacgtagtagtctcctttaaaaattacgtgcgggttatcaacaaagcaacaaatagatacgaacactacgacgagaacggtaaaaaacgctttgttcagcagaaaggaagtgagctatgggccattcgaaaacccatgcataaagaaacctattatggacatgtaaatttacgaagaaaagaacttgtcacccttcaaaaagcattagacgatatcccatcgatttgcgataaaaaactacgagattatatttccgcacttgtcgaaaaacattttaacaagagacagttattggctcatttcaaaagcaccgactactattggcagaagcaatacgttaacaaagtctacgtatggacattcagcgatgatataaaacccctagtcgctacccgaaaacttttagatacgagttttgacgcaaagagaattggaacaataacagacacaggtattcaaaaaatactcagaaactatttggaagcaaagggaggaaacgcaacactggcatttacaccagaaggaatagctgaaatgaatcaaaatataagcaaatacaatgacgggaaaccccaccaaccaatattaaaagttcgcataaccgaaccaatgggagcaaagtacagagtaggacaaacaggcaataaaatggctaaatatgtagaagcccaaagcggaacaaacctctatttcgcaatttacgaagattctgaaggaaaaagatcctacacaacagtacccttagacgaagtagcagaaagattaaagcaaagattatcacctgtaccagaaaaagatgaaaacgatgtaccactgaaattttacctttcaccaaatgacctcgtatacgtaccgactgaagaggaattacaactccgggagtgcaaattgaacaaggatcgaatttacaaaatggtgtcatcaacaggaaatgaatgccacttcatcccatattacgtagcaaacgtaatatacaacaaaggaggcttcaatatgcaaatgcacaggccacagtcatga

SEQ ID NO: 5703 - RNA, 4374 nt, synthetic construct
  misc_feature 1..4374: note = Cas9 variant
  source 1..4374: mol_type = other RNA
atggccaaaatactaggtctagatctgggaacaaactccataggatgggctatcgtagaaaagaataacagcgatttcacactaattgacaaaggagtacgaatatttagcgaaggtgtgaaaactgaaaaaggaatagagcgaagcagagccgccgaaagaacaggatatagaagcgcaaggaaaataaaatatagaagaaaactaagaaaatacgaaacactaaaagtattatccaaaaatcggatgtgtcccctacaaatagaagacgtagaagcatggaaaaaaagcggatttaaagattatccactaattccagaattccttcaatggcttaggaccaatgatcacgagaatgtaaacccgtatttttttcgagataaagcaagcagagcaaaagtaagtctctgggaattaggaagggcattctatcatatcgctcaacgaagaggttttctaagcaacaggcttgaccaatcatcagaaggagtacttgaagaacacaatccacagatacaatctctcatagaagacttagaagagactagtaccatcctaaatgaagtccgcgactattacattaaccttggattgttagacggagtaaaaggagatttcaaaaaagagttagatgaaggtgaaaaaaaacttaaaagcttatacaacacactaatagcaataataaaaaaaaacgaaaacgacgttcaaaaatgcaaagacgaaatcatcaagagactcaacaaaaaagaagatctaggcaaagtaaagggtaaaataaaagacatatcgcaagcaatgctagacggaaactttaaaacattgggacaatatttctactccctatataacaagggaaaaataaggaaccaatatacatccagagaggagcattatttacaagaattcattacaatctgtaaggtacaaggaataaatggaattaatgacgaggagatattaccagaaaaaaaatttaccggactagctaaggatctatacaaagctatattcttccaacgaccactcaagtcacaaaaagggttaatcggaaaatgcagcttcgaaaaaaataaaagccgatgtgcaatatctcatccagacttcgaggaatatcggatgtggaattaccttaatacaataaaattcggcacacagagtgataaaaaattaagatttcttacacaagaggaaaaactgaaattaatcccaaagttttacaggaaaaacgactttaattttgaagtactagctaaagaattaatcgacaaaggagctactttcggattctataagtcatcacgaaaaaacgagtttctctattggtttaattacaaaccgacggatacagtctcagcgtgtcaatttagtgcatcactaaaaaatgcaataggagaagattggcaaaccaaagttttcacatataagacactaaatagcgaaaaaaaagaagtaatacgaacagtggactaccgggatctctggcacctactaagcgcaagcacatcagacatatatctctatgagtacgcaaaagaaaaactaggactagaagacaagtcagcaaaaactttctcaaaaattaaactgaaaaaagactttgcatccctatctcttagcgcaataaacaaaatacttccatacataaaagaagggctactgtatagtcacgcagtatttatggcaaacattgaaaaagtggtagatgaacacatatggaaagatgtcaaagaaagaaccataattcaaaatgaaataagcaaaataataaaaagtgacgtatttgaaagagaagtcataaacataatcaatggacttataaaaaatagcaaaactgagggggaaaattacgctgaagaatcaaaaaatatattcaaaacagaatttgacaacgcaatagctaaaatattcgaaaaaaacaatgatatagaattcaatcaaccatttctggatgacacgtacttaaagtacgtagaagaattaaaaaaattcgacaaagcaaggagtttcttgcctgtaccgcgcctagatgaaaaagttatccagttcctcctagggaacaacaaagacgggatggtctactgcagtgataaaaataaaacaaaaaaactatatcacccttcggatatagaaatattcaaaaaaaaaataataaaagatgaattcggtaatgaaaaaatggtattaggaagcccactaacgactagtataaaaaacccaatggctatgagagcattacaccagctaagaaaagtcctaaacaccctaatcctagaagagcaaattgacgagaatacacgaatacacatcgagatggcaagagagctaaacgacgccaacaaaagaaaaggcattcaagactaccagaatgagaacaaaaagtttagagaagatgcgataaaagaaataaaaaaattatacttcgaggaatgcaaaaaagaagtcgaacccacagaagaagatgtactaagataccagctatggatcgaacaagataagaaggaaatatatgaacaaggaaaatccataagaatatcagatataataggatctaacccagcatatgacatcgaacacaccgtaccacgatcaatcagtcagaacaactcattaatgaataaaacactatgcacgccacgttttaatagagaaataaaaaaacaaaagatgccaatagaattatcaaattatgaagaaatattaccacgtatcgagcactggaagaaggaagctgaagacctaacacgtcagattgaatcgataagcaaatcgattaaaagcgccagcaccaaggaagcaaaggacaaaaatataagaagaagacactatcttacactgaaacgagactatttaaaaggtaagtacgatagatttatatgggaagaaccaaaagtaggattcaaaaactcgcaaatacctgatactggaataataactaaatatgcacaggcatatctaaaatcatattttaaaagggtagaaagtgttaaaggaggaatggttgctgaattccgcaaacaatggggcatccaggaaagttatattgacgagaacgggtttaaacactataaagagaaagatcgaagcaaacacacacaccacacaatcgatgccattactattgcctgcatgacaaaggacaaatatgacgttcttgcacaagcgtggacatcagaagacgaacaagataaacaaaaagcgaaaacgctcatgtccgaggcaaaaccctggaaaacatttaaagaagacattgaaaaaatagaggaggagatactagtgtcccactttacactggacaacgtcaaaaaacagtcaaaaaaaatagttagagttagaggaaaaaaacaatacgtagcagaaatagaaagagatgtcaatggtaaggcaatggccaaaaaagatgctaatgggaaaatcatctacaaattaaatgagaaaggggaaaaaataccaaggttacaacaaggagatactataagaggcagcctacatcaagactcaatctacggcgcgattaaaaatccactaaaccaagaagaaataaaatacgtcattagaaaagatctcgaaagtctaaaggcaaatgatgtcgacaacatcgtggacgaaacagtaaaacaaaaagttaaggaagccattgaaaacaaaatattactactatcatcaaacgcacaacaaaaaaataaattggtcgacgatgtatggctaaacaaagaaaaacaggtacctataaaaaaggtacgaatatacgcgaatagtgtaaaaaatcctcttgagattaaagagcagagtttactctccaaaagcagaaaagaacacaaacaaaaagtctacggacaaaacgacgaaaattatgccatggcaatatatgagttagacggcaaacgagaattcgaactaataaacaatttcaatctagcaaaactaataaaacaaaaagaaggattttatcccctgaataaagagaaagaagtgaaaggcaaaaaagtactgtatcccatcgctaaaagcaactacagggatgttgttctaaaacgaggtcaacaagtagttttttacgacaaagaagtggaaaatccgaaagatatatccgaagtaatagatttcaaggggcgtatatatattatagaaggactatcaatacaaagaatcgttagaccctcggggaagatcgacgagtatggagtgatcatgttaaaatacttcaaagaggcacgaaaagccgatgagataaagaaagacaattataaacccgatggagtattcaagctaggcgaaaaccggcctacaagaaaaatgaatcactcccaatttactgcattcgttgaaggaatagacttcaaggttctgccgacaggaaaatttgataaaatatga

SEQ ID NO: 5704 - RNA, 4377 nt, synthetic construct
  misc_feature 1..4377: note = Cas9 variant
  source 1..4377: mol_type = other RNA
atgacaaaaaccatactagggctagacctcggaacaaacagcatcggatgggccttgataaatcaagacttcgacaataagaagggagaaatattaggaatgggcagcaggataatccctatgacacaggatataaaggacgagtttggaaaaggcaatagtatatcacaaacagctgaacgcactcgattacgaggagttcgccgattaattcaccgaacccttttgaggagagaaagactccatcgagtgttaaacataataggctttctaccagaacactacgcaaaccaaatagacttcgagaaaagattcggaaaattcaaaccagaatcagaacccaaaatttcattcgacggaaacgacgtttttctgtttgaaaaatcatatcaagaaatgcttgttgactttaaaattcatcaaccacagctagtttcaaatggcaagaaaatacctcatgactggactatttactacttaagaaagaaagctctcagtaagaaaatcgaaaaagaagaactcgcatggatcctattaaactttaaccagaaacgcggatactaccaactaagaggagaagaagaagaagaaactcccaacaaactcgtagagttccatagcctaaaaattgtagaagtgaatgcagacgaaccacaaaagggaaaaccagaaatatggtactcattagtactagaaaatgggtgggtatacagacgtgcatccaagacgccattgttcgactggaaagataaaattagggaatttattgtaaccacagaaatcaataatgacggaactgtaaaaacggacaaggaaggaacagaaaaacgatcgttcagagcccccaagccagaagattggaccctccagaaaaagaaaacagagttcgaattatcaaaaagtggtaatgaagtcggtgcattcatatatgaatcaatcctacaaaaaccaaaccagaaaataagaggaaagttaataagcaccatagaaagaaaattctataaagaagaactaaaaacaattctaaaaacacaactatttttccataaggaactcaaagatgaaaagctatataacgcatgcatcgaggagttatataaaaacaacgaagctcatcgatcgctactatcaaacaaaggctttgaacatttatttataaatgatatactattttaccaacgccctctcagatcgaagaaatcacaaatctcaaattgtccactagagaaaaggacttataagaaagaaggaatagaaattaccgaaggaataaaagtcatatccaaaagtaaccccatatatcaagaatttagactgtggcaatggataagtaacctatcactgtattgtatcgaaccaacagaaactaacgttacaagcacatttttaaactctatagaagactacgaaaatctattcgaatttttaaacaacagaaaagaaatagaacaaaaacacctattaaaatacttacttgaaaaccaaggattcaaaggaaaactattgacaaatgaactagaaaaatttagatggaactttgtcgctgacaaaaagtacccgtgcaatgaaacaggttcactattgcatacccggctaagtaaagtaaagaacatatcaccagacttcttaacaaaagaaatagaacatcaactatggcatataatatactcagttacagacaaaatcgaatacgaacaagcattaaaaacgtttgctcgtaaaaataatttagatgttgactcatttttcgaacacttcaagaaaatacctccattcgaatctacatatggagcatattctgaaaaagcaatcaagaaactgttaccgctaattagattaggaaaatactggaattgggaagcaatagactcaattagtaaagacagaataagcaaaatactatcaggtgaatatgacgaaaatatcaaaaatcgcgtcagagaaaaagcggtccacctgacaagtgaaaataacttccaaggattacaggagtggttagccaaatacatagtttacgaccgacatagcgagggtaatgacctagggaaatggacctcggtaagtgatctagaaacctacctaaaagagtttaaacagcacagtctacgtaacccgatcgttgaacaagtcataacagaaacactcagagttgtaaaagacatatggatcaaacacggaaaagggaccgaaaactttttcgatgaaatccacgtagagctaggaagggaaatgaaaaataatagcgaagatagaaaacgacttaccaatacgataacagaaaacgaaaacacaaacctacgcatcaaagcactactaatggagatgatgaatgacaacgacgttgaaaacgtacgaccctactcaccatctcagcaagaaatattgaaaatctatgaggatggagcattaaatagcaacattgaactagacgatgaaatcgtaaaaatatccaagaaagcagaacctaccaaatcagaactacagaggtacaaattatggctcgaacaaaaatatagatcaccttacacgggccaagtaattccactaaacaaactatttacatccgagtacgaaattgaacatgtagtaccacaatccagatttttcgacgactctttcagtaataaagtaatttgcgaatcagcagtaaataaaagaaaagacaaccaactcgggctacaattcatcaaaaatcattcgggtgaaaaagttgagttagggttcggaaaagttgtgcaagtttttacagaagaacaatatctagacttcgtaaaagaacactacagtaaaaacagatcaaaacataataaattactactcgaagagataccggagaaaatgatagaaagacaattaaacgacacaagatatatatcaaaatttgtatcatctatactatcaaatatcgtgagatccgaaaaagacgacgacgggctaaattcgaaaaacatattaccaggaaatggcaaaataacaacagaacttaaacgcgattggggattgaatgatgtatggaacgacctaatactccccagattcgaaagaatgaacacaatcacaaactctgaccttttcactacctacaacgataaatatcaaaaacatctcccaacagttccatttgaatattcaaaaggatttcaaaagaaacgaatagaccatagacaccatgcaatggacgctctagtaatcgcatgcgcaacccgtgatcacctaaacctcatgaataaccaatccgcaaaatcagaattaaaaaggtacgatctgcaaaataaactcagaaagaaagaaccatacttcaatcaaaaagaaaacaaacaaaaagaagcatttaaagattttataaaaccatggggtacatttacggaagatagtaaaaatgcactagagaaaataattatctcctttaaacaaaacctacgagtcataaataaagctaccaatagttacgaatcctacaaagatgaagacggaaacctacgaattggcaaagacggaaaaccagaaaaaggcctaataaagcaaaaaggactaaactgggcaatacgaaagcctctacacaaagatacagttagcggacaaataaatctctccaggataaagttacccaatggcaagattttaacagcaacacggaaaaatctcgacacatcattcgacttaaaaaccatagaaaactcaattaccgacaccggaatacagaaaatattaaagaactatctactttctaaagaatcacccgaactagcattctcaccagaaggtctggaagaaatgaataacgaaatagaaaaatacaacaacgggaagttccatcacccaataaacaaggcgagaatatatgaattaggatcaaaattcaatgttggacaaacaggaaacagacgagacaaattcgtcgaagcagcaaaaggtacgaatttattcttcgccatttaccaagacgaaaataaaaatagatcctacgaaaccataccattaaatgaagttattgaacatcaaaaatggagagcaagcctaccaaaagaagaacaagagaaaatcccattagttccagtcaacaaactaaaaggaacgttcatatttagtttatccccaaatgacctggtgtatgtcccttcaaacgatgagctagaaagatccgcatctatagatttctctaaattaaagaaagagcaaatcaacagactttataaaatggtctcatccagtggttcacagtgctttttcgtaaaaagtgaagtagcaaccagtgttgtgaataaaatggaatattcatctttgaataaaatggaaaaatcaattgacaacctcatggttaaagagatatgtataaaacttaaaatagataggctaggaaacatatcaaaagcttga

SEQ ID NO: 5705 - RNA, 4377 nt, synthetic construct
  misc_feature 1..4377: note = Cas9 variant
  source 1..4377: mol_type = other RNA
atgaaaaaaatactaggattagatctaggcacaaatagcataggatgggcgttaatagaacaagactttgaatcaaaagcgggaaaaattagcggagctggttctaggataataccaatgagccaagacatactggggacattcgaaaccggacaatcctacagccaaacagcagatagaactcattaccgaagcatacgacgactataccaaagaacaaaattaagaagagagagacttcatcgaagtttaaatgtacttggtttcctgccggaacactacaaaaatgaaatagactttgaacaaagaaaaggacaattctacccaaataaagaaccaaaaattgcatattatcctgaacaagtcgctagtaaagtgaaataccaatttctgtttaaaagcagcttcttagaaatggtggaagattttaaacgtcgcggatataacggagcaataccatatgactggacaatctattatttacgtaaaaaagcgttagagaaaaaaattgagaaggaagaacttgcatggttattactaaatttcaatcagaaaaggggttattaccagctccggggagaagaggaggacacaaactcaaataaaaaggaagaattctatgaactgaaagttagttcagtcgaacaaacacacgacacaagcccaagcggaacatggtataatgtacacctccagaacggatgggtatatcgaagaaaaagtaaagacagtctgaaagactgggaaggattaaacaaaaaatttatagtaacaacacatctcaacgctgacggaagcgaaaaacttgataaagacggcaatgtatcacgttcattccgagcaccaaaagaagacgactggggattagtcaaaaaaagaacagaatcagttctagaaaaatccggattacacgtcggtgagttcatatacgaaagtcttctagaaaaccccgaacaaaaaatacgaggatcactaatcaaaaccatcgagagaaaatactataagaaagagctcgaagcaatattagacaaacaaacatcatttcatcgagaattacgaaacgacgctctatataaagaagcaacgctcgaactatatccgaaaaattctgcacatagatcaaacattaaacaacgaggatttaaatatctcttcatagaagacatcatattttaccaacgaccactgaaatcgcagaaacacttaatcgcacattgtcaatatgaaaaaagaacgtataaaaataatggtggtgaaacaatagaagtttcactacaaggtgctccaaaaagtcatccttcatttcaggaatttagaatatggcagttcatctcaaatctacgcttttatgacaaagaagaaatagtagaaggacaagaagtgtcaataacagaaaaactcctcaaaagtgactccgacttcgctgagctgtaccactggctttcgcatcagcgcgaagtcgaccaaaataaaacactaaaatatttcacacaaaaaaaattaataccaaaacaaaaaaaagacaatccaacaattagatggaatttcccagaagacaaaaagtacgaaatgggagaatttaaggcacaactactgagccgattggaaaaagtacgaaactgtcaaccagataagttcttaacccagaaaaatgaactagacctatggcacataatctacagcgtaactgacaaaactgaattcgaaaaagcactggtcacatttgcagaaaaaagagaattagacagtgaatcatttgtggaaaactttaaaaagttccccccgttcaagaacgactacgcttcatactccctaaaagcaataaaaaaaatactaccgttaatgcgacgaggtaaatattggaaagcagagaatctcggtccacaaacgctccaaagaattgaaaagatagttaatggggaagcagacgataaaatttcaataagagcaagaaaacttgcactccatttaaacgatactaaaagtttccaaggtttacccacttcattagcctgctacgtagcatacaataggcacagcgaaaatgaggaaaatcaaaaatggcaaactccttccgatatagataagtaccttaaagacttcaaacagcattcactcagaaatcctattgttgaacaactcataactgaagcattaagggtcgtacgagatatatggaaacactatggacagggccaaaaagacttttttgatgaaatacacgtcgaactaggtagagaaatgaaaaatcccgcaataaaaaggaagaaactaagccaaaaaatacaagagaacgaaaacacaaattacagaataaaagaagtattaagaaatcttaaagaaaacaatattgatgcaaagccatacagccccagtcaccaagaaatactcaaaatatatgaagaaggcgtatatcaatcaatcgaaaatgttgaagacgaaatcgaaaaaataagaaaaaataatactccctcttcgaaagatatcaatagatacagattatggttagaacaaggttacataagtccctacacaggcgaagtaattcccctaagtcaactcttcagcaatcaatacgaaatagagcacataatcccaagaagtagattcttcgatgatagcttagctaacaaagtcatctgcgaatctagcgttaatgcgttgaaagacaacaaaacagctctagaattcataaccaatcacggaaatgaaaaagtagaattcgcaggcaaaactgttgaaatcttatccagcgataaatatacggaacattgtaaaaggtactttaagagaaatagaacaaaacttaaaaacctcctttcgtatgacgtacccgaaggattcatcaaccgccaactaaacgactcgcggtttatcagtaaatacgtaagaaatttattgtccaacatagtcagagaggaagaagaaagagaagcaataagtaaacacatactaacaataccaggaagcataacgtcccaactaaaacaggactgggggttgaacgagaaatggaatgaagtagttacgcacagatttgaaaggctcaataacctaacaggcactacagactttggcttttgggacaataaaataaacgctttcagaataacggtacctaaagaattatcaaaggggtttaacaaaaaacgtatcgaccatagacatcataccctggatgcactagtgatagcagcatgcacaaaagatcatgtaaattatattacatcccttaatacagaaagaaacaaccatagtctagtttcaaaattacgaaataccaaaaaagtacttatcaatggtaaggaaagaagaatagcaaaagcttacaaacttccttggtcatcctttcccctagacgctaaacaccaactcgaaacaacagtaatttcgttcaaacagaatttacgagtcataaataaatcatcaaataagacctggcaatggagaaatgtgaacggagaacaaaaaaaaaagcttatcccacagacaaaaggcgactcatgggccatacgcaaaagcatgcacaaagcaacagtatcagctaaagtcgaaagtgtaggaaaaggcaagataaagacgaccaataggacaccactcggcgagataaaaggtgaaaaacacgtagaaaaaatatatgacgctcgtatacgagaagtcattatcccaaatcatctgaacaaatatttagatgagaagggcaaaccaaactacgaagcagccttctcacaaagcggaataaagcaactaaacgagaatatagaggttttgaatgaaggaaaaccacacgcccctatatataaagtacctctgtttgaagtgggcagtaaattcccagtatcagaagacgcaaagtctccaaaaaaccaaaaatatgtcgaagcagataagggtacaaacctcttctttgcagtttactggaatgaagaaaaacaaaaacgaaatttcgaaacagttcctctacaccaggtcatagtacatcaaaaacaagtagcaagtctacccacggaacaaagaaccagtgtacctataaaaccagaattaggactattcctcttctcactatcaccaaatgacctagtttatgtcccaacagaagaagaaattgaaaaccctcacctagtagacctaaagaacctatctaaggatcaaacaaaccgcatatacaaaatggtatcatctaccggaaacgaatgccatttcataccacatcatatttcacgtttaataatgaaatacaacgcaaaacaaaaagtaggagaattcggaagcctcaataaagcagaaaaagctatcaccggagaaacaattaaagagaaatgtctaaaaatccaaataaattcactaggaaaattaaaaaccgagagaatagcctga

SEQ ID NO: 5706 - RNA, 4380 nt, synthetic construct
  misc_feature 1..4380: note = Cas9 variant
  source 1..4380: mol_type = other RNA
atgaaatttaacttaggtctggacatcggaacaaactcgataggatgggctctagtaaacgaagactatgaaaacaaaaaaggaaagataatagcagcaggtagccgaataattccaatgacccaagatatactggacaaattcggctccggtgcaataacagaaacacaaacagcacttagaacagattataggtcaaaaaggaaattaatacaaagattcttattacggagagagagattacatagagtcctgaacgtactggacttcctacccaagcactatgccgaaagcatcgacttcgaaaaatacttcggaaaatttttgccaaacaccgaacccaaactggcttacaaccaaaatcaattcatctttcaaaatagcttcctcgagatgttaaaagagtttcaagaaaaacaccccgaattgctcacaaataataaaaaaattccctatgactggactatttattacctccgaaaaaaagccctaaatcaaagaatcgaaaaagaagaattagcctggctacttctacaatttaatcaaaaaagagggtacaaccaattaagagatgaagaagaggaatcggtaccaaacaaacaagtggaattctattcactgaaaataatagatgtagtagcggatcaacccaaagaaggccgggataaaaggtggtactcaataaatctagaaaatggatggacctacaggagagaatcgaaaaccccacttttcaattgggaaggcaaaaccaaagattttatagtaaccaccgatttaaatcaggacggctcaataaagaaagataaagaaggaaaagaaaaacgtagtttccgagccccaagtgaaggagactggactctactaaaaaaaaaaacagaaaaggaaatatacgaaagcggaaaaacattaggaacatatatatatgatgccttacttaacacaccagatctaaaaataaaaggagactttatccgaacaatcgatcgttcaatatataaagaagaactccagcaaatcattaacaaacaaaaagaatatcacttagaactcaacagctctaaactatataaagcatgcttagaagaactatacccaaaaaatgaaatttacaaatctgccttaaaaaacaaagatatagcctacttattcataaacgacattttatactaccaaagacccctaaaagcgccaaaatacaatataggaaaatgtacctacgaatcacgcacgttcaaaaaagaagacaaaaaaatacgtgaatatatccccgcagtggccaaaagccacccactattccaagaatttcgactatggcagtggatcaaaaatttaaaaatttatgaaaaactctcgagtgataactgcacagactttttcctaacaaatgaacaagactttgaaaacctattcgagttcctttggaataaaaaagaaattgatcataaaggcatcctagaatacttagtaaagacaaagttcccagacctaaaaccaaaacaagtaaaaaccaaagttaaagagtatagatggaattatgtatatgaccacgaaaaagacgaaagcaaaacttacccatgcggcgaaacatattttcttttaaaaaataaacttgacaaaatttataacgctcaagacgactttttagataaagaaagattgtataacctgtggcatataatctattctgtcacagataaaaagcaatacgaaaaagccttagcaaaattcgcattaaaaaaccacctagacaccaagtcatttgtaaatacgttcaaaagaataccaccttttaaaaacgactacgccatctattcattaaaagcaatcaagaaactactacccctaatgagagtaggaaaatactggaactatgacgatattgatcccataacaaaacaaaaaattcagtgcataataacgggagaagaaaatgatacaataagcacactcgttcgagaaaaaacaaaccacttctccaatgaaaacgacttcaaaaacctcccactatggctcgctggatatatcgtctacaattcacacaacgaaagttcagaaatcgaaaaatggaagtccccacaggatatagatacatttttgaagaaattcaaacaacacgccctacgaaaccccatagtcgaacaagttgtgaccgaaacacttagagtagttagagatatctggtccaaaaaagggcaaggtaaaaaagatttctttaacgaaatccacatagaacttggaaaagaccttaaaaatccagtagataaacgaaggaaattatctagcacgaacaccaaaaacgaaagcacaaacacccgtataaaagcgttattgatcgaacttttcacacaaggtgtagaaaacgtaaaacctaactcaccgaaacaccaagaaatacttaagatatttgaagaaggcgcactcaattcaggtatagaaatagaagaggatataatcaaaatatctaatacagatcagcccacaaaaaaacaattagaattatacatcctatggttggaacataagtacaaatcaccctataccggacaaagcataccactttcgaagctattcacaccaaattacgaaattgaacacataatacctagatcaaaatattacgacgataaccttagcaacaaagtaatatgtgagacagagataaatagattaaaaaataaccagctcggttacgaatttataaacaaccacgaaatcagagaagtgactctcgaagaaggaaaaactataagacttctatcgccagaacaatactggaacttcgttactacatactacgcaaaaaataaggcaaaaagggagaatttactacttaaagaattacctgtacaaatggttgagaaacaactcaacgatacccgatacgtgtctaaatacgtaatgcaactcttatccaagatagttagaaaagaagacggaacagataatggcatcaattctacaaatatactatcgatctctggtaaaatgaccagagccttaaaaaacgactgggacctaaacgacgtatggaatgaccttttattgtaccgcttcgaacgattaaacaccataacaaaaacaaatcttttcaccacatattcagaacaaaaacaaaaaagaatgcctatagttccagaccaatacgcaaaaggtttccataaaaaaagacttgaccacaggcatcatgcgttagacgcaatagttattgcttgtataacaagaaatcatataaactatatgaataaccagaacatccaaggtgaaaaacttaagaaaaacgcgatagaaaaggaaaactaccgagagatattacaaaaatcccgactagatatccgagcacaattatgtgaaaagaaatataacgataacgacccgacaaaatacaactgggtgttcataaaaccctgggcagactttacggaaaacacaaaggacattttagaaagcatcattcccagttttaaacaaaaccttagaatcataaacaaaaccgtcaactactacgaaaaatacaacgaaaatggaaaaaaagtgaaagtacgtcaaattaaaggagataattgggctattagaaaacccctccacaaagaaaccataagtggtaaagttcacttatcctataaaacaccagcaaaaggaaaaatcctcacagcaacaagaaaagtactggattccagcatggatttcaaaagtatagaaaagataacagacacaggaatacaaaagatcctcaaaaactacctagaatataaaaaatcaccggaactagcattcagtccagaaggtatcgaagaactaaacgcaacaataacaaagtataataatggtttccaccataaacccatttataaagttcgaatatacgaagaaggggtaaaattccctctaggaaataaaggcaacaaaaaaagcaaatatgtagaagcagaaaaaggaacaaatctttttttcgctatatataaggatcaagaaaacaatagatatttcgagactataccatttaatgatgtgcttgaaaccttaaaaaaaggcatgtcagcagtcccagaaaaaaaccaagaagaaaacactttagttttcgctttatctccacaagatctagtattcgttcctactctcgatgaaattgaaaacccagacatcgtagactttaaaaacctcacgaaagatcaaacaaacagaatatacaaaatggtctcctcatccggcaaacaatgctttttcataaaggctgaagtggctacgtcaatcgttaacaaaatggaattttccacttccaacaaaatggaaaactctatagaaggaatccaaattaagtcaaactgttggaaactcaaactagaccgactgggaacaatcactcgagtaataaagtga

SEQ ID NO: 5707 - RNA, 4383 nt, synthetic construct
  misc_feature 1..4383: note = Cas9 variant
  source 1..4383: mol_type = other RNA
atgacaaagttcaacctggggctagatataggaaccaactctatcggctgggccttagtaaatgaggactgcgaaaacaaaaagggaaagattctggcagcaggttcaaggattatacccatgacacaagatatactcgataaatttggctcaggcgcagccacagaaactcaaacagccctaaggacagactaccgctcaaaaaggaagctaatacaaagattcctactaagacgagaacgacttcatagagtgctaaacgtattagatttcctacccaaacattacgcggaatcaatagacttcgaaaaatacctcggtaaattcctaccaaacactgaaccaaagctagtatacaaccaaaatcagtttatcttccaaaattcattctttgaaatgctaaaagaattccaagagaaacaccccgaattgtttttaaacaaccaaaaaatcccctatgactggacaatatattacctaaggaagaaagctttatcacaaaaaatagaaaaagaagaacttgcatggctcctactacaatttaatcaaaaacgaggatataatcaactaagggatgaagaagaagaaaacaccccagataaattagtagaattctacagtctaaagataataaaagttacggccgacgaggccaaagaaggcataaacaagcgatggtattcgatcaacctagaaaacggatggatataccgaagagaatcaaagaccccactgtttaactgggaaggcaaaacaaaaaacttcatagtcactacagatctaaatcaagacggatcaataaaaaaagacaaagagggaaaagaaaaaagaagttttcgagcgccttcagaaggcgactggacattacttaaaaaaaaaacggagaaagaaatttatgagtcaggaaagacattgggaacctacatctatgatgcacttttaaataacccagatctaaaaataaaaggcgcccttataaaaactatagatcgctcaatatataaagaggaactacaacaaattatcaataaacaaaaggaataccactccgagttaaacaacagcaaattatataaagcatgcttggaagagttatatccaaaaaacgaaatctataaaaatgaattaaaaaataaagatattgcctatctattcataaacgatattttatattaccaacgacccttgaaagctccaaaatacaatatcggtaaatgttcctatgaatctaggacattcaaaaaggaagacaaaaaaataacggaattcattcctgcagtcgcaaaaagccaccctctctttcaagaatttagattatggcaatggataaaaaaccttaaaatctacgaaaaactcacaaatgacaattacacagatttctttctaacgaacgaacgcgatatagaaaaacttttcgatttcttatggaacaaaaaagagatagaccacaaaggcatcttggaatacttaattaaaacaaaatttccggacctaaaaccgaaacaggtaaaaagcaaagtgaaagagtatcgctggaactatatatacgaccatgaaaaggatgaatccaagaattacccgtgtggtgaaacctatttcctgctcaaaaacaaattagacaaaataacctcaatacaagatgacttcctcaacaaaaaaagactcgaaaacctatggcacataatatactcagtgacagacaaaaagcaatatgaaaaagctctagcaaagttcgccttaaaaaatcaattagatacaaaaagtttcgtaaacactttcaagagaattccagcttttaaaaacgactacgcaatatactctctaaaagccataaaaaaactactacctctgatgcgcgtaggaaaatattggaactacgacgacatagaccctattacaaaacaaaaaatacaatgcataataacaggagaagaaaatgatacaatttcaactttagtccgagaaaaaacgaaccacttttccaatgaaaatgatttcaaaaacttatctctatggctcgcgggctacatcgtctacaattcacacaacgaatctagtgaaatagaaaaatggaaatcaccacaagacatcgacacatttctaaaaaaattcaaacaacacgcactccgcaacccaattgtcgaacaagttgtaactgaaacactaagagtagtccgagacatctggctaaaaaaaggtcaaggcaaaaaagacttctttaacgaaatccatatcgaactgggaaaagatcttaaaaatcccgtagacaaaagacgaaaaatctcatcaacaaacagcaaaaacgaaacaacaaatattcgtataaaagctttattaaaagaattactaaaagaaggaattgaaaacattaaaccaaactcaccaaaacaacaagaaatactaaaaatcttcgaagagggcatcctaaactcaggtatagatatagaggaagaaataatcaaaatttctcaaattgcacaacctacaaaaaaacagctacaatactaccgaaactggcttgaacaaaagtacatatcaccatatactggacaattcattcccctatcgaaactcttcacatctaaatacgaaattgaacacattataccaagatcgaaatactatgatgactcgctgtcaaacaaagtcatatgcgaaacagaaataaatagattaaaaaataaccaattaggatatgaatttataaataatcacgagattagagaaataacacttgaggaagggaaaacaatacgactactaagccccaagcaatacctcgacttcgtaactacgtactatggaaaaaataaagccaaaagagagaatctacttttaaaagaaatacccattcaaatgatcgaaaatcaactaaatgacactagatacgtaagtaaatacgtgatgcaactactaagcaaaatcgtcagaaaagaagacggcactgacaacggcacaaattctataaacatcctatccgttagcggaaaaataacaagagtccttaaaactgactggggtctcaatgacgtatggaacgacttattatgctacagatttgaaagactaaataaaataaccaatacaaacttgttcactacgtactcagaacaaaaacaaaaaataataccaatcgtacccgaccagtacgcaaaaggctttcataaaaaaaaattagatcatagacaccacgcactagatgcaatattaattgcttgtataaccagaaatcacataaactacatgaataaccaaaacatacaaggagaaaaactaaagaattttaaaatagacaaacataactatcacgaaatattccaaaaaagccgactggacatgcgagcacaactttgcgaaaaaaaatacaatgatcacgatagcacgaaatatacatgggtcttcaccaagccttgggctgacttcaccgaaaacatcaaggatacactagaatttatcataccatccttcaaacaaaatttaagaattattaacaaaacagtcaattactacgaaaaatataatgaaaacgggaaaaaagttaaagtgagacaaacaaaaggcgacaactgggcaattcgaaaacccctccacaaagaaaccatatctggtaaagtacatctactttacaagacaccagctaaaggaaaaatattaacagcaactaggaaagtattagactcaagcatggactttaaatctattgaaaaaatcacagacacaggcatacaaaaaatcctgaaaaattatctcaagtacaaggagtctcctgaacttgcgttttcgccggaaggaatcgaagaacttaacattactattgccaaatataacgacggattctaccacaaaccaatatacaaagtcagaatttacgaagaaggagttaaattcccactaggcaatagaggtaacaaaaaaaataaatacgtagaagccgagaaaggaacaaatctgtttttcgcaatttacaaagatcaagagaacaacagatattttgaaacaataccattcaacgacgtattagagaccttaaaaaaaggtatgagtgcagtgcccgaaaaaaatcaagaaaaaaatacgttggtgtttgctctctcaccacaagacttagttttcgtaccgacactagatgaaatcgaaaatccagacatagtcgattttcgcaatttgacaaaagatcaaacaaatcgcatatataaaatggtatctagctctggtaaacaatgcttttttataaaagcagaagtcgcaacaagcatagttaataaaatggaattcacaacatctaacaaaatggaaaactcaatcgaaggaatccaaataaagtcaaactgctggaaactaaagcttgacagactgggtaccatcactagggtaataaaatga

SEQ ID NO: 5708 - RNA, 4389 nt, synthetic construct
  misc_feature 1..4389: note = Cas9 variant
  source 1..4389: mol_type = other RNA
atgactaaaaacatattaggattggaccttggtacaaatagtataggatgggcactaataaaacaaaactttgaaaacaaacaaggcgaaatactaggaatgggaagtcgaatcatcccaatgtcgcaagacatcttaggagactttggaaaaggaaacagtgtatcacaaacagcagaaagaacaaaatatcgatcggtaagacgattaagagaacgattcctactcagaagggaaagactacatagagtacttaacctactcaacttcttaccacagcactatgcttcacaaatagacttcgagaaacgattcgggaaatttaaagttgagacagaaccaaaactagcctggaaaaacatagacggtcaattctcttttctcttccaaaccagtttcaacgaaatgctggaagattttagagtgaacggacaagatgttaaaatcccatacgattggacaatctattacctaagaaagaaagcactatctaagaaaatcgaaaaagaagaactagcgtggatcctactaaatttcaaccaaaaacgaggctactaccaattaagaggagaagaagaagaagaaaaccctaacaaattagtcgaattttatagcttgaaagtcgtagatgtcgtagcggacgaacctcaaaaaggaaaatttgatatctggtatagcttaatcctagaaaacggctgggtttacagacgatcctctaaaataccccttttcgactggaaagataaaacaagggattttatcgtaacaacagatttaaatgatgacggcagtatcaagaaagataaagatggaaatgaaaaacgatcattcagagcaccaagtgaaaacgactggacactggtgaaaaagaaaacagaacaagagatagaacaatcaagaaaaacagtaggaacttatatatatgaagcactattagacaatccaaaacagaaaatcaaaggaaagctagtcagaacaatcgaacgtaaattctataaagaagaacttaggcaaatactagagaaacaaaaagaatttcatcaagaacttcaatcggacgatttatataatgattgtgttagagaattatatagaaataatgaagctcaccaactaaccctctccaagaaagatttcgtacatcttttaatggatgacctcatattttaccaaagacccctgaggagtcagaaaagttcagtaagcaattgtacacttgagttccgaaaatacaaagacgaaaatggagcggaacatacacaatatctaaaagctatcccaaaatcaaatccatactaccaggaatttagactgtggcaatggatatacaatttaaacatatatcgaagagaagatgaacaaaatccaatcacaggggaatttttaagtactactaaagagttcgaaaatctctttgagttcctcaacacacgtaaagaagttgatcaaaaagcgctgctaaaacatttcaaactcaacgacaaaacacacagatggaacttcgtggaagacaagaaatatccttgtaatgaaacaaaaactatgatatcgagtcgactggaaaaagttgaaaacatctcagatgacttcttaacgagggaaatagaacagaaaatctggcatattatatacagcgttaacgataaaatagaatacgaaaaagcattaaaatcgttcgcaaagaaacaccacttggatgaatcgtcatttttcgaggctttcagaaaatttcctccattcaaatccgaatacggatcatttagcgaaaaagccgtcaagaaactattaccgctcatgcgcttaggaaaatactggaattacgctgacatagataaaagtagcaaagaacgtatccagaaaataatttcaggcgaatatgacgaaaatataaaagacagggtaagagaaaaatcagtgcacctaacaaccgaaaacgattttcaaggcctacaattatggctagcacaatatatagtctatggtagacactctgaagctagcatgataggaaaatggaactccgcagatgatcttgaagagttccttaaaaattttaaacaacacagtctacgtaatcccattgtagaacaagtcattacagaaactctacgagtagtaaaagatatctggttgaaatatgggaatggagccaaagacttcttcaacgaaattcatatcgaattgggacgagaaatgaaattacccgctaaagaaagagaggacctaacgaggaaaataacggaaaatgaaaatacaaatctaagaataaaggctttactagcggaaatgatgaacgattcaagcgttgaaaatgtaagacctttttccccaatgcaacaagaaatcctaaaaatatacgaagacggagtcttaaacagcggaattgagatcgaagatgagtatttgaaaataagtaaaaccgcccaaccatccccatccgacctcaaaagatacaaactatggctagaacaaaaatataaatcaccgtatacaggacaaattatccccttaaataaattatttacacctgaatacgaaatagaacatatcatacctcaaagtaggtacttcgacgacagcttcagcaataaaataatttgcgaaagtgcagtgaacaaactaaaagacaattatataggtctaggctttattaaacaatttggaggaacaattatcgaacttggattcggtaaaagtgtaaaagtattcgagacggaagaatatgaagacttcgtaaagaaacattacgcaaacaaccggagcaaaagaaataaactcttattagaagatataccagagaaaatgatagaaagacaaataaatgacacaagacatatatccaaatacattagcggagtactcagtaacatcgtaagaatagatgatgaccaagcgaagaaaataatagaagatgctgaaatactcgctcgaaaagaaatcgacaaagacaaagccaatgaaattagacgcaaagccaaaagtctagcgacagatgatggaataaatagcaaaaacattgttccaggcaacggaaaaattacgacccaactaaaacaagattggggattaaacgacgtctggaatgatctaatattaccaagattcgaacggatgaaccaacttacaaacagcaaagatttcaccgtatggaatgaaaaccaccaaaaatatctaccaacagtaccaatagagttctcaaaaggttttagcaagaaacgaatagaccatagacaccacgcactcgacgcattggtgatagcctgtgcgactaaagaccatgtaaatttattaaataaccaaagcgcaaaatcagacactaaaagatatgatcttaaaaagaaactaatgaaatttgaaaaagtagtatatcatcacactcaaacaggaaataaaattgaaagagaaataccaaaacaatttctgaaaccctgggaaaactttaccttcgacgcgaaatataatttagaaagtatcatcgtttcctttaaacaaaacctacgtgtaataaacaaagcgacaaattactatgaaaaatacgtagaaaaggacggaaccaaaaataaaggacgcgtagaacagacaggaacaaattgggctataagaaaacccatgcacaaagatacagtaagtggtaaagtaaatctaccatgggtcaaagtaccaaaaggaaaaatactaactgcgacaaggaaaatactagacaccagcttcgacctcaagagtatcgggtctattacagatacagggattcagaaaatattaagaaattaccttgagttcaaaggatcccccgaacttgctttctccccagaaggcatagaagatcttaacaaaaacatagaaaagtacaatgacggaaaaccgcatcaacccataaacaaagtaagagtcttcgaattaggaagtaaattccaagtgggacaaacaggaaataagaaagacaaatacgtagaagcagctaaaggaacaaacttattctttgctgtatacgaagataaaaacggcaaaagatcatatgaaaccataccacttaatgaggtcatagaacgtcaaaaacaaggactaagcgtagttgacttaaaaggaacaaacgatttttacctctgcccaaatgatctagtctacataccaagtgatgatgagctagaaaatatcaacaatattgatttcaagaacatagcgaaagagaaaaacgaaagaatatataaagttgttagctttagcgggtcccaaattttctttgtaagacaagacattgcaacatccatagtaaacaaagctgagctatcaactttaaacaaaatggaaagggcgatggacggtagcatgatcaaagaaagctgtgtcaaattaaatgtagacaggttaggcaacatatccaaggcttga

SEQ ID NO: 5709 - RNA, 4401 nt, synthetic construct
  misc_feature 1..4401: note = Cas9 variant
  source 1..4401: mol_type = other RNA
atgactaaaaatatactaggattagatttaggaacaaattcgattggatgggcgctaattaaacaagatttcgaaaacaaacaaggtgaaatcctaggaatgggatcgaggattatcccaatgtctcaagatgtattgggagaatttggaaaaggcaatagtgtaagccaaacagcagcacgaacagattatcgaggagtaagacgactacgcaaaagatttttgcttcgcagggaacggctccatagagtactgaacgtactaaactttttaccggtacactacgcttcacaaatcgatttcgagaaaagattcgggaaatttaaagaagacacggaacctaaactagcatataataaagaaggctttattttcaaaaacagttttgaagaaatggtagcagacttccgaaaacatcaaccacaattacttgaaaacgataagaaaataccctatgattggacaatctactatttgcggaagaaagcattatccaagaaaatagaaaaagaagaattagcatggattctactcaatttcaaccaaaaacgaggctattaccaactacgaggagaagaagaagaagaaaacccaaacaaacttgttgaattttacagcctaaaaataaccgacgtcctagcagatgaaccacaaaaaggaaaatcagacatatggtacagtctcattttagaaaatggatggatttacagaagaagtagcaaaacaccactcttcgactggaaagagaaaacaagagacttcatagtaaccactgacttaaatgatgacggatcgataaaaaccgataaagacggaaacgagaaaagatcattcagagcgccaagtgaaaacgactggacgctcgtcaaaaagaaaactgaacaggaaattgacaaaagccagaaaacagtcggaacatacatttacgaaaccttacttcaaaacccaaaacagaaaataaaagggaagctagtatgtacgatcgaaagaaaattttataaagaagaactaaaacaaatactagaaaaacaaaaagaatttcatcaagaactacaaaatgacgacttatattcagactgcgttcatgaactatatcgaacaaatgaagcccatcagctaacattatctaagaaagaaatagtaaacttatttatggaagacttaatattctaccagagaccactacgtagccagaaaaccagtataagtaactgtacactcgagttcaggaaatacaaagatgaaaatggcgtagaacatactcaatttctaaaagcaataccaaaatccaacccctactatcaagaatttagaatatggcaatggatattcaatctaaacatctacaaaagagacgacgactcaaacgtaaccaaagagtttctaaatacgacagaagacttcgaaaatcttttcgagtttttaaataaccgaaaagaagtcgaacaaaaggctttactaaagcacttcaaactcaacgaaaaactacatagatggaacttcgtagaagacaagaaatacccatgcaatgaaacaaaaacaatgataagcacgcgattagacaaagtagaaaacattagcaaagacttctttactagagaaattgaacagaaaatatggcacatcatatattcagtgaacgacaaaatagaatatgagaaagcactaaaaagtttcgccataaaacataacctagacgaaaattcatttttcgaagcctttaagaaatttccaccatttaaaagtgaatacggatcctttagcgaaaaagcaatcaagaaacttcttcccttgatgagactcggtaaatactggaacgaagatgaaatactaaaatacagtgacgactacttcaaaaacatagaaagtctactaggggtgctaaaacaaagagatgaaaacatatctgatgctgacagagaaaactacaataaaaccataaacaataaattaagagctgaattagaaaattttcagaatgcagaaatagaatcctttcaaggtctgagattacacatagcccaatacatattatacggaaaacattcagaaggagacaacaagaaatttaattcagcagacgatctcgaaaaatttctaaaagagttcaaacaacactcacttagaaatccaatagttgaacaagtaattacagaaactctaagagtggtaaaagatatatggacaaaatacggaaatggcgccaaagacttctttgatgaaatacatatagaattaggaagggacatgaagaaaacccgcgacgagcgtgcggatgccacaaaaatcataacagaaaacgaaaacacaaatcttcgaattaaagctctactcgcggagatgatgaacgacgtagaaatggaaaatgtacgaccgtattcaccaatgcaacaagaaatattaaaaatatatgaagatggtattttaaaaagtgacattgaaatcgaagatgatatactaaaaatctcaaaaaccgcccaaccgagttcttcagacttaaaaaggtacaaattatggttagaacaaaaatacaaaagcccttacacaggacaaatcataccgctaaataaactatttacccctgaatatgaaatagagcatataataccacaatcaaggtattttgacgattctttcagcaacaaaatcatatgtgagtccgcagtcaacaaactgaaagacaactacattggactaggttttataaagcaattcggaggaacaatagtggaatgcggttttggcaaaaatgtaaaagtatttgaagcagaagaatatgaagattttgtcaagaaacactacgcaaataatcgaggaaagaggaataaactactacttgaggaaataccagagaaaatgatagaaagacaaatgaacgatacaagacatatatcaaaatatatatcaggcgtactaagcaacatagtaagagtcgaagacggatcagatgaaggcgttaacagcaaaaatatagtacccggcaacgggaaaattacaacacaacttaaacaagactggggactgaatgatgtatggaatgaactaatactccctagatttgaaagaatgaatcaattaaccaactcaactgactttacagcatggaatgaaaatcatcaaaaattcctaccaacagttcctatcgagttcagcaaaggattctcgaagaaaaggatagatcacagacaccacgctttagacgcattgataatagcctgcgcgaccaaagatcatgttaatcttttaaacaaccaaagtgcaaaaagcgacaccaaacgatacgacctaaagaagaaattaatgaaattcgaaaaagttgtatataatcaccctcaaactggtgatagaatcgagagagaagtaccaaaacaattcttgaaaccatgggataattttactttcgaagccaaaaacaacttagacaaaattattgtcagttttaaacaaaatttacgagtaattaacaaagccaccaactactatgagaaattcgtcgaaaaagacggagttaaaacaaaagaaagagtcgaacaaaaaggcaccaactgggccattcgaaaatcgctacatgaagaaactgtaagtgggaaaatcgatttaccctgggtcgaaacgaacaatggcgagttcataactgcaacaagaaaatccttagacgcctccttcaatctagagaagatcaagaaaatcacagatacaggaatacagaaaatactccgtaactatctaaaagcaaaagacgacaatgccgaactggcattctcgccagaaggtatcgaggatctgaacaaaaacatagaaaaatacaacgacggtaaatcacaccaacctatagtaagggtacgagtttatgagaaaggaaagggcagattcgccttgggccaaacaggaaacaacatagataaatacgtacaaggaagtccaaacctattcttcgccatatacaaagacgaaaatggcaagaaatcatacgaatcaatcagattagacatcgtaatagaaagaatgaaacaaggattacaagcagtacccgaaaccaatccaaatgggatatccttatatcaaaacctctcacctttagacttagtatacatacctactgaagatgaaatcgaaagcccccacctaatagatttcacaatactaaataaaacccgactagaaagaatctataatgtcaacgatttcagtggttatacaatctattttagtcaaaactcattcgccaaaaacatataccctaaagaaatggatatgacatggaatgagaagaaacagaaacctagcggcagcttcgactcaaaaacagcaagctataacaaaaagtccataaaagacatatttattaaactaaagatagaccgtttaggtaacatatcaaaagtaagtaacacgctctga

SEQ ID NO: 5710 - RNA, 4401 nt, synthetic construct
  misc_feature 1..4401: note = Cas9 variant
  source 1..4401: mol_type = other RNA
atgaaaaacatattaggattagacctaggcacaaactctataggatgggccctagtaaaagaagatttcgaaaataaacaaggggaaatcctaggactaggatcaagaataatccctatgagtcaagacatacttggagaatttgggcgtggaaatagcatttcacaaactgcagatagaactggttacagaggagtccgacgactccgcgagaggcacttattaaggcgagaaagactacatagagtactcaacatattaggatttctacctaaccactacgctaaagaaattgactttactaaacgattaggcaaatttataaaccacgcagaaccaaaactatcgttcgacaaagaatttatattcaaagacagctttaacgaaatgctcaaagattttcaacaaaaccaaccgggtttcatcataaataagcacggcgaagaagcacttgtaccatacgactggaccatttattatttaagaaagaaagctctaactcagaaaatagacaaagaagagttagcatggatacttctaaattttaaccagaaaagaggttattatcaattgagaggagaagaggaagaagaaaacacaaacaaattggttgaattttactcactaaaaattatcgacgtaattgcagataatgaagtaaataagaaaggtgaagtatggtacagcctacatttagaaaacggatggatatatagacggtcgagcaaaatatccctagtagactggaaagataaagtcagggattttatagtaacaacagacgtaaacgacgacggttccgaaaaactagacaaagacggtgtagtaaaacgatcatttagagctcctagtgcagatgattggacacttttgaagaagaaaacagaacaagatatagataactccaataaaacagtgggcgcctacatctacgaaaaccttctactaaacccaaaacagaaaatcaaaggaaaattggtacgaacaatcgaacgaaaattttacaaagatgagctgaaacaaatcctagaaaaacaaaaagaatttcaccaagagctacaaaacgaacaacttctccaagactgtgtacgagaactatacaaatataatgaacaacatcaacaaatgctcgaaagtaaagacttcgttcatttatttctgaacgacattatattttaccaaagacctctaagaagccaaaaatcgttaatttcaaactgcacactcgaaaagagggtaagcagagatggtgtcgtgtttccaataaaagtcatatcgaaatcaaatccatactatcaagaatttaggttattacaatggctgcaaaatcttgcaatatatagaaaagacgatgatgttaacgtgacgcaagagttcctaaactcaatagaaagttgggaaaatcttctacaattcctaaacgcgaaaaaggaaataaagcaagaacaattaataaagtttctactagaacaaaaaggacttaaaggaaatagtctcaaaacagcaatcctaacttacagatggaactacgttacagacaaggtttatcctatgaacgaaacacgttcgcttatccaagacaaattaaagaaagtggaaaacgttgcaacagacttcctatccttcgataatgaaatggcactatggcacattatatacagtgtcaatgataaaattgaatatgaaaaagcgttagctaaattcgcttcaaaacacaacctagacgaaatatcattcgtggagagttttaagaaattcccaccattcaaatcagactacggatccttcagtgagaaagcgatcaagaaactattaccactaatgagattcggaagtgtttggaacaaaaataacatagtacctagcgtattggacaggatagataaaatactcacaggcgaatatgatgagaaaataaaaatacgcgttagggaaaaagcagaacaattccaattaaaccaaatagaagattttcaaaatttgccactatggttggctcaatatgtcgtatatgatagacatagcgaagcagaaatcgcaggaaaatggaactctgtcaaagacttagaaaattatttaaaagagttcaaacaacactctctaaggaatccaatagtggaacaaataatcactgaaaccctacgcgtggtaaaagatatatggcaacaatacggcaatggagttcaaaatttcttcgacgaaattcacatagaactaggacgcgaaatgaaaaacaccgcagacgaacgtaaacggataacaaattctgtaacggaaaatgaaaatacaaatttacgaattaaagcacttctggtggaactaaaagaagatacaaacatcgagaacgttagaccgcactcaccaatgcaacaggagatcttaaaaatctatgaagagggagtattaaatgcagtagaaaatatagacgaagatatccttaagatcagtaaaacagcgcaaccatcgaaatcagaattaattcgatacaaactatggttagagcagaaataccaatctccatatacaggagaaatgatcccattgagtcgcctcttcacttctgattatgaaattgagcatgtaatacctcaaagtcgttattttgatgattccctaagtaacaaagtaatatgtgaagcagctgtaaacaaaagaaaagataatcaactgggattagagttcatcaaaaatcatcattcagagaaaatagaactaggtaatggaagaactgcacaagtactagaagtagaagcatacgaaagttttgtgaagaaaaattatgacaaaaacaggggaaaaagaaacaaattattactggaagacgtacctgagaaaatgatcgaaaggcaactaaacgataccagatatatttcaaaatttgtaacacatttactctcaaacatagtaagaaaagatgaagttaactccaaagatgacggaataaatagtaaaaatattataccaggaaacggcaaaatcacaagccaactaaaacaagattggggtttgaatgatgtatggaacgaattaatacttccaagattcgaaagaatgaataacctaacaaattcaaccgatttcaccagtaccaacacaaatggaaaaataattcctactgtacccttggaatactcaaaaggctttagcaagaaacgtatagaccacagacaccacgctctagatgccctagtcatagcgctagccaccagagaccatgtaaacctcctcaacaatgaaagtgcattaccaaagaaagacagaaccaaagaagaacaaaaatctttcaggtttgatttacaagtcaacttaagaaacaaagaaaaatatttcaacgtgaaagaaggacgagaaaaagaaaaatttactacatttaagaaaccatggaacaccttaactcaagatacacgcgatgccttagagaatatggtggtctctttcaaacaaaacttaagagtgataaacaaagctacaaattactacgaaagttatacagatgagaacggcaatttgcgattagacaaatacggtaatccaaagaaagaattaatatcacaaaaaggcacaaattgggcaataagaaaatcattgcataaagaaacagtaagtggacaaatacacctagaccgcgtaaaagtaacaaaaggaaaaatagttaccgccacacgcaaatcattagactcgagtttcaacgaaaaatcaatagaatcaataacggacactggaatccagaaaattcttcgaaactatttaaaagcaaaagacaacaaaccagacgtggcctttagcccagaaggtatagaggaattaaacaaaagcataagcgtctataatgagggtaaaaaccaccaaccaatcattaaagtccgaatcttcgaacaaggttcaaaattcccggtgggagagacaggaaacaaaatcgcaaaatttgtcgaggcagctaaagggactaatctattctttgggatataccaagacaaaacaggaaaaaggtcatacgacacgataccattaaacttagtcatagaacgacttaaacagggtctaagccctgtaccagaaaccaatgaaaaaggacatcaattactattccacttaagtcccaacgatctggtttacgtgccgactatcgatgataacgaacaactagacagtaacagagtatacaaatttactgactcatctgatacaacatgcaatttcataccaagcaacattagcgcaataatattcaatataaacagtaaagaacaagaaaaacgggggataaattaccccatacaaaacgaattaggggtaggatcaccccaaagtaaaaaccagaaaagtttcgatggtttcatgataaaagaagtgtgcatcaaactaaaagttgatagattaggcaatatatcaaaaacctga

SEQ ID NO: 5711 - RNA, 4416 nt, synthetic construct
  misc_feature 1..4416: note = Cas9 variant
  source 1..4416: mol_type = other RNA
atgtgtaaatatttttatatcaaaaacttcataacattcgttttatctaaatcaataatacccatgaaacacatattaggcttagatttaggttcaaacagtatagggtgggcattcgtacaacaagattttgaaaataaacaaggcaaaatcatagcaacaggatcaagaataattccaatggatcaaggtattttaggcgatttcgaacgtggaaacacagtatcacaaaccgcggaaagaacaacatataggtctacaaggcgtttaagagaaagacacttattaagaagagaaagattacatcgggtattacacatattaggatttttgcctccccactacgatgctcaaatagatttcacaaaacggtatggcaaattcatcgataacgcagaaccaaaaatagcgtacaacaacggaaacttcatatttatgaactcgttcaatgaaatgatagaagattttaagaaacatcaaccccaattattttacaagaaaagtaacggtgaagaatcgaaaattccatacgactggacaatctattatctcagaaagaaagcactatcacagaaaataacacaacaagaattagcgtggctaatattgcacttcaaccaaaaacgtggatattatcagttgaggggcgaagaagaaacagaaaatcccaacaaagaagtcgcatttcactcattgaaagtagttgacgtagaagcagaagcaccaaacaagaaaggtgaaatctggtacacaataagacttgaaaacggatggatataccgaagaacatccaaaatcccactagacgactggaaaggcaaaacacgtgactttattgtaacaacagatctgaacgacgatggaaccataaaagtcgacaaagaaggtaaagagaaaaggtcattccgtgctccagacgaaaacgactggaacctattaaagaagaaaacagaacatgacattgacttttcaggaaaaaccgtgggagcgtatatctatgaccacctattacaaaaccccaaccagaaaattaaaggaaaactcgtgcgcaccatagaaagaaaatactataaagacgaactcaaagcaatattagcaaaacaaatcgcactccaaccggaacttttcactgaaacattactggcagactgtattcgcgaattatacaggaaaaatgaaacacaacaacagaacttgctctccaaagactttttacacctgttcgttgaagatataattttctatcaaagaccattacgaagcaagaaaagtacaattgcaaattgcacccttgagaaacgatcatacattgacaaagaaacaaacgaacgtaaagacgcacccataaaagtgtgcgcaaaatcaaatccctactatcaagagttcagagtactacaatggcttcaaaacttaaggatatatgaaatagaaacagaccgagaggtaacagcagagttcatcgaaacgccacaagactgtgaagcattattcaacttcttgatgtcacaaaaagaaatcgacaataaaggactactaaaatactttctgtttgccaaaaacccacaaatcaaagacaaagccgccaaatcagaactaaagaaatggctaacgacatatagatggaactacgtatacgacgcggctgataactctagcaagaaatatccgatgaacgaaacgggttatgaattacaaagatatctacaaaaagtcgaaggtctacccgcgaactttcttacattcgacataacttatcaactctggcatttactatactctgtaaaagacaaagttgagttcgaaaaagcgctaaagaaattcgccaaaaagaaacaactagacaaaacttctttcgttgattcattcaaaaatttcaaaccttacccaaatgaatatggatcgttttcagaaaaagcaatcaagaaactattacctctaatgagattcggaaatcattgggacttcaatagaatcgacgtctcaacacaaaaacgaatagatgatttaataaatggagtagcaaatgaggatatacggaccattatcagggaaaaagcggaaaaataccaactcaactcagagacttgctttcaagacttgcctctttggctcgctcaatacgttgtctataacaggcacgcagaagcaacagacatagaaaaatggaccagcgtatcagacctcgaagcatatctagaggatttcaaacaacatagtcttcgtaatccaattgtagaacaggttgtgactgaaactctacgtgtagttagagacatctggcaacaatatggaggagggcaagctaatttctttgacgaaattcacattgaactaggacgagaactaaagaaaacagccgaggaacgaaaacaactctccgacaaaaatcaggaaaatgagagtactaacctaagaatcaagaaactactagccgaactaaaagaagatgccagcatacaaaatgttcgaccgtattccttagtccaacaagaactcctaaaaatatatgaggaaggagtcttcagtgcaacagacgaagtagaagaagacatccagaaaatacgaaagaaagcagaaccttctaaagcagacctgcaaagatacaaactatggctagaacaaaaatacaaaagtccatacaccggagaagtcatatcgctaaccaaattatttacagaagaatatgaaatagagcatataataccacaaagcagatactacgatgactccctatcaaataaagtaatatgcgaatcagcagtcaacaaacttaaaaccaaccaactaggattagaatttattcaaaaccaccacggggaaaaggtcagaataacagcaaataaggaagtaactatatttaccgaagaacaatacaaagagttcgtcaagaaacactacgctaataattcagctaaacaacagaaacttttactcaacgaaataccggagaaaatggtcgcacgacaattaaatgataccagatatataagtaaatacatctcggaaatactttccaaaatagtacgcagtgatgagaaagacgaaggtgttaacagcaaaaacattataccctgcaccggaaaaataacaacagcattaaaacaagactggggcctcaatgacgtctggaacaaactgatactaccacgattcgaacgaatgaatcagcttactcaaacacaattatttacaagttacaatgaccgactacagaaaaatctaccaaccgtacctatagagtatagccaagggttccaaaagaaacgaatagatcacaggcatcacgcaatggacgcactggttatagcatgcgccacaagagaacatataaactatatgaacaatcaacacgcattagataaatcaaaagataagaaagaaaaacaacaatctagaatagacttgagaacaatactgtgcgagaagaaaaataataactggcaattcaagaaaccatggtcaacattcacacaagaggccaaagaagcactcgaacatatagtcgtcagcttcaaacaaaatttacgcgtaattaacaaagcaaccaattactacgagaaatgggaagagaaaaacggggtattagtcaagaagaaagttaaacaagaaggtacaaactgggcaataagaaaacctcttcataaagagacagtaagcggaaaaatagtactagacaggaaaataggaaaagataaaatcctaacagcaacccgaaaggcagttgacattactttcacggagaaaatcataagctcaataactgacacaggtattcagaaaatacttctcaactacctaaaatacaaaggtagcccagaagtcgcattttccacggaaggattagaagaactaaataaaaacatagcacaatataataacggtaagaaacatcaacccatatacaaagtgcgcatattcgaagagggaagtaaattccctctaggagaaactggcgctaaagcaactaaatatgtagaagcagctaaaggaacaaacttattcttcggtgtttatcaaggtaagggaaaaaggacatatgctacaatacctttaaacgaagtaatcgagaggcaaaaacaaggcctaccgtccgtaccagaaagaaacgaaaaaggtgaaccactattattcagcttaagtccaaatgacttagtttacgttccaatggaaggtgaaatagctgaaacaatagactttaacaacctttcaaaagagcaaaaagaacgcatttacaaaacagtttcgtttaccggtaaccaatgctttttcgttcaggaagcagtcgcaactccaatagtgaacaaaatggaatactccccattgaataaaatggaacgagatatcctaggtaccatgataaaggaagtatgcataaaactcaaagtagaccgactaggaaacatcacaaaagcgtga

SEQ ID NO: 5712 - RNA, 4416 nt, synthetic construct
  misc_feature 1..4416: note = Cas9 variant
  source 1..4416: mol_type = other RNA
atgggatataaagcgccacgaaatgataaaggcgaaatagattatggagttggcctagatctgggcaacgggagtgttggatgggtcgcaatggataaagactaccacttaattcgggctcgaggccatgaattaatcggtgctcggcttttcgaccccgcaaactcagccgaaaaccgtcgcgagagtagaacaacacgaagaagattaagccgacgaagatggcgattaagaatgctagatagtttattcgctagtgaactagcgaaaatagacccaaattttctagccagaagaaaatattcatgggttcatccaaaagatgaacaaaatcatgaaaattggtatggttcaatcatctttgggagtaaagaacaagacaagcaattttacaaagattatccgacaatatatcatctacgtaagaaactaactgaagacacagaacggcatgacataagagaaatctacgtagcgattcaccacatcgttaaatacagaggacattttctacgagaaggagaaatcaattcagaaaatttatttgatccagaaggcttcgtcgaactaataaaagatgttataaaactcaataactcatatgatgagtctacacctatttttgaagcatcaccggcagatgtatcagaagcgctgttaaacgaacacacatctcgcagtggaaggatagaagatacattagacaaattggattttagtgtgtcaagagtagataaacacgaactcaaaggaatgagagacgcagcaaaagcagttattggagcaatagtaggtaatactgcggattttagcaaaatattcaatttagataaccttgataaagactcaaaagataacttaaaattaaaatttgcagatagtaactttgatgaaaaatatggtggagtagtcggatcaggcttgttggatgaaactcaaatagaactcgttgatcgcatacacgctgtctatgatgcagttgctttaaaaggaatactaggggatgcgcatacaatatctgaagctaaagtggaaagttacgaaaaacataggaaaaactggaaattaattaaagaagaactccgaacaaaagagaataaggatgaagtagacctttggtacggcgatttgtctggtcggcaatacaaaaatcccccagacccagaaaaaggacccgacgagggaagcaaaaaggattcaccaataagagattctgaccaaaaacaaaatttaatcaaaaaggctaatgactatttcacggaactaatagacgattcacaactttcagaagaacagaaaaattgcctcaaaaacgatattaataatgggcaactatttcctgtacaacgaagtagtgataatggagtaataccataccaaatacatttaaacgagttaagacgaataatagaaaatcaaaaacaatattatcccttcctcgcagaaacgttcatacgtaaaactgctgaaggtaaaagctatgaagagaataagatcgtagccttgctcaaattcagagtaccatactatgttggacccctagtttcaaaagaagatatggaggaacatagttccggaaattcggcataccattggatggcacgcaacccaggcagaggcgaagcaattacaccatggaacttcgacgaagtagtagataaagatgaatcgggcgccagattcataagtcgattgactggaacagatacctatctcttaggcgaaccaacactcccacaacacagcctactatacgaagaatatatggttttaagtgaactaaataacgttcgattaaacgtcagacaaggaaaccattggtcagataaaaacaggcaaagattatcttataaacaaaaagagttcttaatcgaaaatttatttaaagaacacaaaacggtaacacgtaaacgagcggaagattgtctaagctcaatgggttgtggggaagtacaactatttggattatctgacgaaaagaaattcgcaagcagtctgagcagctatattacattgaagaaaattctcggaaaagcattcgtagatgactctgggaatagtgcgatactagaaaggataatagaagtccaaacagttttcgaagatagagaacccctaacccaccaattgagtctcatagactcacttacagtagaacaaagaaaacagctggctaaaatacattatactggatggggtaaattaagtagaaaacttcttacaagtaagaaaggatcttacaaaattcatagtcaaaatgaaatcatgcgaacacaacactcaataattgacataatgagaggtgattctctaaacctaatcgaaataattagggataagaaaatcggaataggagaatggatagacaacgaaaacctcgatagagaaacgggagaaagcgacgtttccagactagaaagtgtatttgaaggaatagtaatgtcaccacgtgttaaaaggggagtcgtacaagcagtcagagtaatagatgacttagcaaaagccatagggaatccaccacagaggatatttatagaaatggctgatgaagtccaagcaagccaacggaccgtttcccgcctatcacgcctcaaagcattatacggaagtccatccttacaaaaagagttcaacgatttaaaagacctaagaaagagcttaaatgaaacaaaagatgcagatctacaggaagatcgactatatctatactacattcagctaggaaaagatctatacactggtaaagaaatatcaatagatagcttaagctcagcatacgatatagatcacatagtaccacaagcgctaacccaagacgatagtatcgataacagagtattggtaagcagaaaagaaaatgcaagaaagaccgatagttatttatatacaccagacctgattaaaaacatgcgacctttatggggaaaactgctcgctgcgggattaatgagccaaaagaagtatgacgcattaactagagtagatgacttcaaggacagagaaaaacaaagattcgtacaacgatcactcgttgaaactcgtcaaataatgaaaaatgtttcaaccatacttcgcacttattatggcgaagatacaaatgtagtaacattaaaatcatcaataacacacgacatgagaaaatacctaggcttcccatacaagaacagggatataaatgattatcatcacgcacaagatgctttatgtatatctgcagcaggacaattcatgctaaacaggcactttgtctctggaggcgaagtcaccgatggcgcctccaacgcctacaatatgtacttagcagaatatttacaggagttcagagacgcaaaagcccggggagaaagaaaaagatcaacagcttttggatttgttgttggctccatgtcttcaaaagacgacgagaaaagaactgaccacaggacaggagaaatagtctggagcgaaaccaatgcagaatacctaagaaaagtaatgaactacaagaaaatgttaatcacacaaaaagtgggagatgtgaaaactcgagcactgtacgatgaaacacgatacgggcacaaagaatcttcagcaaaatcaataaaatttgataatcttcgaagagatacatctctatacggaggattttcaggtgctagcactgcctacatgatgttagtcgaatataaaaagaaaaataagctagtttctataacggcacaagaagcaagtttacttgctgtagcagaccagaaaaacgacaccgtatcagtaatggacggcattctagcatcacacggattatcaggagctaaaatcttactcccaaaaatcgtaacaggacaactactagattatagcgatgccttagtcacgcttcaatctgcctcagaattaaacacggcacgacaaatgtggttaccaagaaatgattataatgacatagatataattttgaaatcaaaagacatagaggatgcggcacacaagctaggatacgacagtgacaccgtccacgtattgcgacgaatccagaaactatttgaggctgtatttcgagttgctgagagtcaatttccactacaccaattatcaaaagatcaacaagaagaaatactacgagatccacaaaactatggatttggatcagcagtaaagttactaggaggcttactcaaagcactacatgcgaacgcagaaaatacaaacttagcaggacttgtgaaagtgcttcatggagataaagaatattcagacgacggtaaagcaaaagaatttaagaaattcgggttcagtcccagatggcggcgcataagtaatcccacaggatttacgctgtcggactccgacacattcatctatcaaagtccaagtggaatatttgaacagcgagtaactgtaaaagaattaaaagaaaaagcagacaaacaaaagtga

SEQ ID NO: 5713 - RNA, 4422 nt, synthetic construct
  misc_feature 1..4422: note = Cas9 variant
  source 1..4422: mol_type = other RNA
atgaaaaacatacttggactggatctgggcaccaactcaataggctgggctttaattgaaaaggatacagatcagaaaaatggtaacatattaggaacaggatctaggataatacctatgagccaagacatcaaagatgagttcggaaaaggcaacagtataagtcaaacagcagacagaactaagtttcggagcgttaggaggttaagggaacgacatctactaagaagagaaagactacatagagtactaaacgtgctaggctttctaccaaaacattatgccgaccaaattgacttcaagaaacgattaggcaaactcgtcaatgaaacggaacctaagctagtgtatgacaataaaaattttatattcaagaaaagtttcgaagccatgctttcagactttaaccaacatcaaccattattattagcagacggcaagaaagtaccatttgattggacaatatattacctacgaaagaaagcactaacagagaaaattgaaaaagaagaacttgcctggctaatactaaactttaatcaaaaacgaggatattaccaattaagaggagaagaagaagaagaaaatccaaacaaaatggtagcatttcactcactaaaaatcgtcgaagtaatagcagatgaatcccaaaaaggtaaagcagaaacctggtactctttaattcttgaaaatggatggatttacagaaggtccagcaaaacacccctctacgactggaaaggaaaacaaagagatttcatcgttaccacagatctaaatgacgatggatcaataaaaactgataaagaaggattggaaaaacggtcatttcgtgcaccggtagaagatgactggactctagtaaagaagaaaacagaacaagaaattaatcgaagccacaaaactgttggcacctacatctacgagaacctcttacaagacccaaaacagaaaatcaaaggtaaattagtaagaactatagaaagagaattttacaaagacgagctaaaaatgattcttaaaaaccaacaaaaattccacccagaactaaatgacgaacacctatatattaactgcgtgcgagaactataccgaaacaaccaagcacatcaaacaatccttagcaagaaagactttgtacacctatttatagacgacataatattttaccaacgacccttacgctcacaaaaatcatctatttccaactgtaccctagagttcagaaaatacaaaaatgaaaacggcaccgatcaaacagactacctcaaagcaatcccaaaaagccatcctctcttccaagaatttagactatggcaatggatatataatttaggaatatatcaaaaagaagacgacaccaatgtgacagatgaactaatcaaaaatatagacggctaccaggatttattcgactttctaaacaacaagaaagaaattcgacaagacatactcataaaattcttggtcgaacaaacaggactcaaaggaaaaccactatcttctgtagtcgctaaatatcgatggaatttcgtagaagacaaaatatacccgtgcaacgaaaccggaactcaaattaggacacggctcgccaaagtcgaaaacactccagaagatttcctcacagcagaaaccgaaataaaattatggcacattatatactcagtcaatgataaagccgactacgaaaaagcattaaaaacatttgctgaaaaacataaccttgatacacacagctttgtcgaaaatttcaagaaattcccaccattcaagtctgaatacgggtcattttctgaaaaagcaataaagaaactcctaccattgataagacttggcaaatattggtcctgggaaaacatagataagaaaactcaagaaagaatagagaaaattttaacaggagaatttgacgaagcgataaaaagtcgggtacgcgacaaagccatacacttaacagaagaagatcacttccaaggcttacaactatggctagcttcctacgtagtatacgggcgtcactcagaagcagataatctagataaatggcataccgtcgcagatctagaagattacttggctgagtttagacaacatagtcttcgaaaccctatagtagaacaagtcattacagagactcttagagtagtaaaagacatctggcttcagtacgggcaaggagctaaagactttttctctgaaattcatatagaattagcgcgtgaaatgaaaaacacgggagatgaacgcaaacgactcacgagtttagtaacggataatgaaaatacaaaccttcgaatcaaagtcttattgtcagaactattaaacgacggtaatgtggagaatgttagaccatactcacccatgcaacaagaagctcttaaaatatttgaagacggagttctaaattccgacattgaaatcgaagacgacatcttaaaaataagcaaaatggcgcaaccaacaaatactgaacttaagagatataaattatggctagaacaaaaatacagatcaccatacacgggtcaaataataccacttaaccgtctcttcacagccgactacgaaatagaacatattatcccccaaagcagattctttgatgacagcttttcaaataaaattatatgtgaaagtgcggtgaaccaactaaaagataaacaactcggtctagagtttattaaaaaccacagtggtacgatagtcaagttaggcatgggcaaaacagccaaaattctcgacgtagaatcatataacgagttcgtaaaaggcaattataccaaaaacatatctaaacgtaataaacttatgttagaagaaattccagacaaaatgattgaaagacaattaaacgacacacgatacataagcaagtttattatatcagcgctaagtaatattgtacgctccgaaagtaacgatgacggtttcaattcgaagaacgtcttaccaggaaatggaaagataacaagccgactaaagcaagattggggcatgaacgatatatggaacgaattaatactaccacgttttgaacgtatgaataaaattacagattcagctgtcttcaccgcatggaatgaaaacaatcaaaaatttctacccatagtgcccctggagttctcaaaaggattccaaaagaaaaggatagatcatagacatcacgcattagacgctttagttatagcagcatcaacacgagaacacattaatctacttaacaacgaacatgcgaaatccgataaaaggtttgacttaaatagaaaactccgtaagttcgaaaaggtagcttacaatgacccaaaaaccgggaaacgcatagaaaaagaagtacccaccatatttctaaaaccatgggaaacattcacagtagatgccaagaatagtctagaatcaattatagtctcattcaaacaaaacttgagagtaatcaaccgtgcaacaaattatagtgaatcttataatgacgaaaatggtgccttaagattaggaaaggatggtaatccgttaaaagagaaaattaaacaatcaaaaggagactcatgggcaatccgaaaaccaatgcacaaagactttgtatacggtaaagtacatttacaaaatgtaaaactgccaaaagacaaattcataaccgcgattagaaaatcactagacgtaactttcgacctaaaacgtatagaaacaatcacagacaccggcattcagaaaatcctgaaaaattatctacattcaaaagaaaataaggtcgaactagctttttcaccagaagggatagaagatatgaatcaacacatagaacgatataatgacggtaaaaagcaccaaccaatccataaagtcagagtatttgaaatagggtcgagattctcactaggagaatcaggcaacaagaaaacaaaatttgtagaagcagccaaaggcaccaacctattcttcgcggtatatcaagacgataacaaagggaaaagaaactacgaaaccatcccattaaacatagtcatagaacgccaaaaattaggcttacacagtgtcccaacagaagacgcaaaaggcggaaaactactgttccacttatcacccaacgacatggtttatgtgcctacttcagaagaactcgaagataaccttgcgtcagttaacataaaaagattaaacacggctcaacgtaaaagaatttataaagtggagaaagcaagcggagttgaatgctactttataagacaagacatagcttacctcattaaaaattatgatgccaaaaccaagataggagaactagaatcccaaaataaattacaaaccacaatgacagacgacagactgaaaataaccgatgtttgcgtaaaactaaacatagacagattaggatccatcgcagaaaccttcttaggaaatcaatacggagcgtcaaagaaaacctga

SEQ ID NO: 5714 - RNA, 4422 nt, synthetic construct
  misc_feature 1..4422: note = Cas9 variant
  source 1..4422: mol_type = other RNA
atggcaaaaatacttggactcgacttaggtactaacagcataggatgggcagtagttgaacgtgaaaatatcgatttctctttaattgacaaaggagtcagaatattcagcgaaggagtcaaatccgaaaaaggcatagaatcatcaagagcagcagaaaggacaggatacagaagcgcaagaaaaataaaatacagaagaaaactaagaaaatacgaaaccctcaaagttctatcattaaatcggatgtgtccccttagcatagaagaagttgaagaatggaagaaatctggcttcaaagactatccattaaacccagaatttctaaaatggctatctacagacgaagaatcaaacgtaaatccctacttctttagagatagagcatcaaaacataaagtaagcctatttgaactaggcagagcattctatcatattgcacaaaggcgagggttcctaagcaaccggttagatcaatcggctgaagggatattagaagaacactgccctaaaatagaagcaatagtagaagacttaataagtatagacgaaatttcaaccaacattactgattacttctttgaaaccgggatactagatagtaacgagaaaaacggctatgcaaaagatttagatgaaggagataaaaagctagttagtttatacaaatccttgcttgcaatactaaagaaaaatgaaagcgactttgaaaactgcaaatcagaaatcatagaaagactcaataagaaagatgtattagggaaagtaaaaggcaaaataaaagatatcagtcaagccatgttagatggtaattacaaaacattaggacaatacttctactcactatactcgaaagagaaaatccgcaaccaatacacatcaagagaagaacactatctaagtgaatttattacaatctgtaaagtccagggcatagaccagataaacgaagaagaaaagatcaatgaaaagaaattcgatggattagcaaaagatctatacaaagcgatattcttccaaagacccttaaaatcgcaaaaaggactcataggcaaatgctctttcgaaaaatcaaaatccaggtgcgccataagtcacccagacttcgaagaatacagaatgtggacatacttaaataccatcaaaataggaacccaaagtgacaagaaactaagatttctaacacaggacgaaaaactaaaattggttccaaaattttataggaaaaatgactttaatttcgatgtcctagcaaaagaactaatcgaaaaaggaagcagcttcggattttataaatcaagtaagaaaaatgacttcttctactggtttaactacaaaccaacagacactgtagctgcctgccaagtagcagccagtttgaaaaatgcaataggagaagattggaaaacaaaatccttcaaatatcaaacaattaattccaacaaagaacaagtctcaagaacagttgactacaaagatctatggcatctattaacagtcgcgaccagcgatgtttatctatacgagttcgcaatagacaaactaggacttgatgagaaaaacgcgaaagcatttagcaaaaccaaactaaagaaagacttcgcatcactttctcttagtgcaattaacaaaatactaccatatttgaaagaaggattactttacagccacgctgtattcgtcgcaaatatagaaaatatagtagatgaaaatatatggaaagatgaaaaacagagagactacataaagacccaaataagtgaaataatagaaaattatacattggaaaaatcacgattcgaaataataaacggactactgaaagagtacaaatctgaaaacgaagatggaaaaagggtgtactattcaaaagaggcagaacaaagttttgagaatgacctcaaaaagaaattagtattattttataaatcaaatgaaatagaaaataaagaacaacaagaaacaatattcaatgaattgctgcccatatttatccaacaactaaaagactatgaatttataaaaatacaaagattagaccaaaaagtactaatctttttaaaggggaaaaatgaaaccggacagatcttctgcaccgaagaaaaaggaacagcggaagaaaaagagaagaaaatcaaaaaccgactaaagaaactttaccatccatcagacatagaaaaattcaaaaagaaaataattaaagacgaatttggtaacgagaaaatagtactagggtcaccccttacacctagcatcaaaaacccaatggctatgagggctctacaccaattacgaaaagtcctaaatgctctaattctcgaaggacaaatcgatgagaaaaccatcattcatatcgaaatggcccgcgaattgaacgatgctaataaaagaaaaggaatacaagattaccaaaatgataacaagaaatttagggaagacgctattaaagaaatcaagaaactatattttgaagattgcaagaaagaagtagaaccaactgaagatgatatactacgttaccaattgtggatggaacaaaatcgttctgaaatatacgaagaaggtaaaaatataagcatatgcgatatcatcggatcaaacccagcttatgatatagaacacaccatacccagatcaaggtcacaggataattcacaaatgaacaaaacattatgctcacagcgatttaatcgtgaagtgaagaaacaaagtatgccaattgaactaaataaccatttagaaattctaccaagaatagcccactggaaagaagaagcggataacctcactcgagaaattgaaataatatcaagatcaataaaagctgccgcaacaaaagagatcaaagacaagaaaatacgacgaagacactatctgacattaaaacgagattacttgcaaggaaaatacgacagattcatatgggaagaaccaaaagtaggattcaaaaactcacaaattccagatactggaattataacaaaatacgcacaagcatacttaaaaagttacttcaagaaagtagagtcagtaaaagggggaatggtagcggaatttcgaaaaatatggggtatacaagaaagttttatagacgaaaatggaatgaaacattataaagtaaaagatagatcaaaacacacccatcacactatagatgcaataactatagcttgcatgacaaaagaaaaatacgatgtgctagcccatgcatggaccctagaagaccaacaaaataagaaagaagccagaagcataatagaagcaagcaaaccgtggaaaacattcaaagaggacctcctaaaaatcgaagaggaaattctagtctctcactatacaccagataatgtcaagaaacaagccaagaaaatagtacgcgtgcgtggtaagaaacagttcgttgctgaagttgaaagagatgtaaacggcaaagcagtacccaagaaagcggcctccggcaaaacgatatacaaattagatggagaaggtaagaaactaccgaggcttcaacaaggtgacactatccggggatcattgcatcaagatagcatatatggcgccattaaaaatccactaaacacggatgagatcaaatacgtcattagaaaagacttagaaagtattaaaggatccgacgtagaatctatagtggatgaagtggtaaaagagaaaataaaagaagcaattgccaacaaagtactcctactcagtagcaatgcacaacagaaaaataagttagtaggtactgtctggatgaatgaggaaaaacgaattgcgataaacaaagtcagaatatacgcaaactccgtgaaaaatccactacatataaaagaacacagtcttttgtccaaatcgaaacatgtccataaacaaaaagtctacggacaaaacgacgaaaattatgcaatggcaatatatgaactcgatggcaaaagggattttgaactcatcaacatattcaatcttgcaaaattaataaaacaaggacagggtttctatccactccacaagaagaaagaaatcaaaggaaaaatagtattcgtaccgatagagaaaagaaacaaaagagatgtagtcctcaaacgcggacaacaagtggtgttttatgataaagaagtagaaaaccccaaagatataagcgagatagtcgatttcaaaggacggatatatataatcgaaggattatcgatacaacgtattgtaaggccaagtgggaaagttgacgaatacggagtaataatgttaagatacttcaaagaagcaagaaaagctgacgatatcaaacaagataattttaagccagatggagttttcaaactaggcgaaaacaagcctacaaggaaaatgaaccataatcaattcaccgcttttgtagagggaatagacttcaaagtgttacccagtggaaaatttgagaaaatatga

SEQ ID NO: 5715 - RNA, 4425 nt, synthetic construct
  misc_feature 1..4425: note = Cas9 variant
  source 1..4425: mol_type = other RNA
atgaaaaaaatattgggattagatctaggtacgaatagcattgggtgggctttgatcgaaagcgactttgaaaagaaacaagggaaaatcaacggtttaggttctagaataataccaatgtctcaagacatcctaggaaaattcgattcgggagtcagtatatctcaaacagcagaaagaactagttatagaggtgtacgaagacttaatcaacgaaacttattaagaagagaaaggctccaccgagtacttaacatcttggattttctgccaaaacactactcaaatgcaatagatttcgagaaaaaattaggccaattcaaagaaaatgttgaagaaaaactaaactacgccaaaaaccaaataggaagacatgaatttatattcatggattcattcaaagaaatggtgaaagaattcaaacagacccaaccgcaacttttctacaaaagagaaaatggaatagaaacaaaaattccgtacgattggacactctattacctcagaaagaaagcacttagtcaaaaaataaaaaaggaggagctcgcatggataatattaaatttcaatcaaaaaaggggttactaccaattacgtggagaagacgtcttagacgaatcgaaaatagaagacttttacagtttaaaggttgtggaagtacaggaaaccgaagataaaaatgcccgcggaacttggtacaatgtaatactcgaaaacgattgggtatacaaacggcaatccaaggagtcactcgacaattggataggaaaaaacaaagaattcatagtaaccacgaataaagaaaaagacggatcattaaaacttgacaaggcaggcaatgttaaacgaaattttagagcagtagactccgaaaaagattggattgcaattaaaaaaaaaactgaacaagacgttgaaatctccaagcatacagtaggtcaatatatatacgaaactttactacaaaatgcgaaacagaaaataaaaggaaaattggtaaaaaccatagaacgaaaattttataaagaagaatttataaaaataattaaagaacagctaaaacaccatccagaactacagagcaaaacactttacgaaacctgcatccaagaattataccctcgaaacgaagctcatcaaaacaatataaaatcaaaaggctttgagtatttgtttacagacgatatcattttctaccaaagaccattaaaaagtaaaaaatccaccatctccggatgtcaatacgaaacacgcctgtttaaaaaaaccgttcttaataaagtaacaaataaggagaatgaaatatggcaaaaggagcctctcaaagcgataagtaaatcacatccattattccaagaattcagattatggcaattcttgaagaacctaaaaatataccaaaaggaagatgtaaagggaaacctcatagatcacgacataacgagcgatctactaaagactgaagcagattgggtcgagttattcgattttttgaacattaagaaagaaatcgagcaaaaacaaataatacaattttttataaacaacaaacaaatagaaaagggcaaaaaaaacaactacaggtggaattatgttgaagacaaaaaatacccttgcaatgaaactaaaagccaactcatatctagacttaaaaaggtaaaaaacctagacttaaacctctttttcacatcagaaaccgaactaaaactatggcatatcatatatagcgtaaaagacaaaatacaatatgaaaaagcaatcaaaaattttgcaatcaagaataatatagacatagactcattcgtggaaaactttaaacgattccctccttttaaaaatgaatacgcagcatactcagaaaaagccattaaaagattactaccactaatgagaatgggagagtactggaacgagtctgagataaaacaagaagttaaagatagagcatactccatcatcgaaagattaaaaggaattgatttcaataaggacaaaatagatgagaaaatcacagacgacgacatcaaaaaacaactcttaaaatcattcatagacttcaaagataaaaatcctttaaaaggactaaacacgtaccaggcttgctacttggtctataacagacatagtgaagtcaacagtatcgcatattggaaatcacccgacgacattaataaatatttagaaggatttaaacaacattcgctaagaaaccctattgttgaacaagttgtgactgaaactttacgaactgtaagagacatttggcaatattacggaaaaggaaaagcatcattctttaacgaaatccacgttgaattgggaagggaaatgaaaaatcccgcatataaacgaaaagcatcaaccaaccgtgtcacagagaatgaaaacacgaaccacagaataaaagaaattcttaaggaactccagaatgaaggcgtacaagaagtaaaaagctactctagaaatcaacaagaaattctcaaaatatacgaggaaggaatttatcaatcgatagacgtagttgacgatgcgatcgaaaagatacggaaaaactcctccccaacgaaagcagaaataattaaatataaattatggctagaacagggatacacttcaccttacacagggaaaacaattccaatgtcaaaactatttactactgactaccaaattgagcatataataccacaatcactatatttcgacaactcattaagcaacaaaataatctgcgaaagcgaagtaaatcaactcaaagataaccaaacagcatacgaatttattaagaaacacggaactgaaaaagtcagtcttgggaaaaacaaaacagtagaaatctttacgttagaacagtacgaaaaacactgcaaccaatatttcaaaaaaaacaaaaacaaactaaaaaaacttctctcagaagagataccagaaggttttattaacaggcaattgaacgactcaagatatatatcaaaatttataaaaggtctattaggaaatctagtaagagaagaagacgaacaagaggtaacaacaaaacacatagttccagtaaccggcgcgataacctctaaactaaaacaagattggggattaaacgataaatggaacgaactcgtagccagcagatttcaaagactcaacaccatgacaaactcaaacaatttcggatattgggacacgaagattaatgctttcagagtacaagtacccgatgaaatcagtaaaggattcagcaaaaaaaggatagatcatagacatcacgcattagacgcactagttatcgcatgctgcaccagaaatcatatcaactacttaaacgcactcaacgctgaaaaaaaaaactacggacttcgtgaccttctactaataaaaaacgacaaaaaccattatacaaaatttttcaaacatccatgggacggctttccagtagaagcaaaaagcgttctagaaaaaacaataatatcattcaaacaaaatacaagggtaataaacaaaacaaacaataaaacctggcaatgggccgagaaagaaggacaacttaaaaaagttctggtaaaacagacaaaaggcgataattgggccatcagaaaaccaatgcacaaagaaactgttagcggaaagcttaatataccaactcctaaaggtaaaattgcaacagcctcaagagtttcactgtcagaaatcaagacaaggaaacaactcgacaaaatcacagacatatcaatccaaaagatattggaaagacacttaaacaattacctagacgataaaggcaaagaaaaattcgatcttgccttcaacgctgatggagtcgaagaactaaacaaaaacatcaaagttttgaacaaaggcaaaaaccaccaaccaatttataaggttagactatatgaaatcggatcaagatttaaagtaggaaactcaggaaacaaaaaggacaaatacgttgaagccgcaaaggggacaaaccttttctttgcaatttacttaaatgaaaaagacaaaaaaagagtatatgaaacaatacccctaaacgaggtcatagagcatcaaaaacaagtaagtaacctaccgaaaaacgagagaacaccggtaccagtcaatcatactaaaggcaaattcctatttagcctaagtcctaacgacctggtttacgtaccaacggatgaagaaatagataacccaagtctcgttaacttcaacaatcttaacaaaaaacaagtcgaaaaaatctataaaaccgtaagttgtagtacctaccaatgttttttcgtacataacacgatatccaaacccattcaaaacaaggtagagttcagtgctttaaacaaaatggaaaaatccatagacggaataatgatcaaggacagatgttggaaacttaaaatggacagactaggcaatataatatccgtaatacgctga

SEQ ID NO: 5716 - RNA, 4443 nt, synthetic construct
  misc_feature 1..4443: note = Cas9 variant
  source 1..4443: mol_type = other RNA
atgaaaacaatactaggattagacttaggcactaattcaattggctgggcaaaagtatgcgttgacaacgatggaaactatttaagagacattaaactaggcagtagaatcatccccatgagccaagataccctgggcaattttgataaaggagtgacagattctccaacagcagcccggacaggatttcgcggtgtccgaagaatacgagaaagagcactacaaagacgggaaagattacacagagtcctccacgtcatgaaattcctcccaccacattatgaaaacgcaataggatggaacagagaagaagcaacgacgtacggcaaattcctcaaccacggtgaaccaaaattagcatgggagaaacaagaggacgggagcatgagattcctctttatggactcctttcatgaaatgatggctgattttgcagagagccaacctgggctagtagcaggcggaaagaaaattccgctggactggactctgtattaccttagaaagaaagccttaacacaagctataagaaaagaggaattggcctggatcttactaaacttcaatcaaaaacgtggttactaccaactccgtggagaggaagatgaggaaaatcccgcaaaaagagaagaataccatgaattaaaagtagtctcagtcgaggcagccgaggagggaaaaggaggaaacacttggtacaacgtaacgttagaaaatggttggatatatagacgccaatcaaaagtagaattacatgattgggtaggaaaaactagacaattcattgttacgacagaatatgaaaaagacggtgtaacaatcaaaaaggataaaaatggagaagttaaaagatcatttcgagcacctagcgaagatgactggggcctacggaagaaacgaactgagagcttattagaagattcaggaaaaacagtaggtgctttcatttatgaccacatactaagcgaaccaacggacaaaataagagggaatttcattagaacgatagagagaaaatactataagaaagaactcgaagcaatactactagaacaaacaaaacatcacaaagagttaaaagaccaaaataccctcatcgcatgcataaaagaattatatcaaagcaacaaaccacatcaagacagtttaatgaagaaagatatgacttacttactaataacagaccttatattctaccaacgaccactaaaaagcaagaaaagcctaatagcggattgtccctacgaatattacgaatatacaataaaagaaaccggcgaaatcaaacgacaaggaataaaatgcatagcaaaaagcaacccctattatcaagagttccgactatggcaatttataataaatctacgactattcgatcgaaccgatgacaaagaagtaacaagcgaatacttatcaagtatggaagactatacaaaactctttacatacctaaacgatcgaaaagacataaatcaagaaaccctgttaaaagacttctttaaacaaaagaaagttaaaatggggatggaaaaagagttcccaataagatggaattacatagaagataaagagaagaaatacccatgtaacgaaacacgacatgaactattggcagcactcgataaagcaggtatagaccatagctggctagacgacaaagaacgtttttatcgactttggcacctgttatacagcgtggaatcgaaagaggaagcagaaggagcgttaagaaaacttaaagacaacgacgacttcgtaaacgcattcttaaaagtaaaacccttcaagaaagactatggagcatacagtgaaaaagctgtaaagaaactattagctattatgcgaatgggcggactgtggaatgagacagatatatgcgaacaaacgagaaatagaatacaatcaataattaaaggagaaatcgatgagaaaataaaagaaagaatgggacggacattttgccaactttcagatttccaaggtttacctgaatggttggcctgctacgtcgtttatggaagacacagcgaagcaacagatattcaaagatggacaaaaccagaaaatttaatggcctacataaacggtttcaaacaacactctctaaggaaccctatagtggaacaatgtattttagaaacattacgaacagtacacgacatatggaaagaagcgggacatattgacgaaatacatgtagaactgggacgatcaatgaaaagcaccgctgaccaacgtgcaaggatgagcaaaagcatactacaaaacgagaatacgaatttacgcataaaaagtctgctaatggagctaaagaacgcaaaagaaatagaaaacgttcgaccctacagtcctatgcaacaagaaatattaaggatctacgaggaaggcgctttacaagaactgacaaaagaagatgcacagtatccggagatatcaaaaatatcacaaatggcccaaccttcggctaaagaactactaaaatataggctgtggctagagcagaaatactgctccccttacacagggaaacctatatcacttagcaagttattcacctcagcataccaaatagaacatatcataccacaatcaaggtatttcgatgatagctttacaaacaaagtaatatgtgaaacagaagtaaaccagttaaaaagtaatatgttaggatacgaatttattaagaaacactcaggagagatagtacattgtacaactataggagatgtaaaaatactggatgcaaaagaatactacaattttgtaaccgaacattacgcaaataatagaagaaagaaagagaaactactattagaagacattcctcaagaatttttaaatagacaaatgaatgactcaaggtatatcagtaagaaagttatggcaattctaagtaatattgttcgcgaagaagacgaacaagaaacaaatagcaaattcgtagtctcttgttcgggaggcattacagatcgcctaaaacaagattggggattgaatgatgtttggaatagtattgtttacccgaggtttgaaagactgaataaattaacccaaacagaggctttcggcagatgggaaaataaagaaggcaaacaagtatttcaaacaagcctacctctagaattacaaagaggattctcaaagaaaagaatagatcacagacaccatgcaatggacgcattagtcatagcatgtgcatcaaggaatattataaactacctaaataacgaatcagcgaaaagccaagaacaacgggaagaccttagaaagaaattatgcgacaaaaaccgcataatacgtaaaccttgggaaacctttacacaagatgcgcgaacggccttggaggatgtcgttgtatcctttaaaaactacgtgagagtaatcaataaagcaacaaactactatgaaaaatatgacgagtcagggaagaaaggcatggctgaacagaaaggacaagacatgtgggctattcgcaaacccatgcacaaagaaaccgtatttgggcaagtcaacctaagaagaaaagtaacagtaaaacttaaagacgcattagaaaatataccagctatatgtgacaaagcattaagagactacgtaaatgaccttatagcaaagaaatttaatacaaaacaaatgctagcccatttcaaatcaataaactaccgactaaatatgaaaagcgttaataaagttggaatctgggtattctcggacgaaaaagaacctatggtagcaacccgtaaggccatagacatatcattcgatgcaaaaaggatagatacaatcacagatacaggtatacaacaaatattatgcaaatacttgaaaagcaaaggaaacgatccgaacgtagccttcacgcccgaaggtatagcagagatgaataaacatataatagattataacaacggaaaacaacaccaaccaatcctaaaggtaagagtttcagaaccgaaaggagcaaaatatcaagtaggggagaccggtaataagaccaagaaattcgtagaagcgcaaaaaggcacaaatttatattttgcaatatatgaggataaagatggtaacagatcatacaacactattccacttaacgaggtagctgaaaggctaaaacagggtttaagtcctgttccagaaaagaatgaaaaaggaatatctctaaaattttatttaagtccaaacgacttagtttatgtacccacagaagaagaaaaattatctaatgaatgcaaattatccaaagaaaggatttacaaaatggtaagcagtacatcaaacgaatgtcattttattccgtacacaacggcgaaaccaatctatgataaatttgaatatgaagccaaaaacaaaatgggcagagcactaacaggagaaatgataaaagctgtttgctggaagttagaagtagatagactaggaaacatattaaaaataattaaatga

SEQ ID NO: 5717 - RNA, 4452 nt, synthetic construct
  misc_feature 1..4452: note = Cas9 variant
  source 1..4452: mol_type = other RNA
atgaaaacgatccttggattagatctaggaacaaatagcattggatgggcaaaaatatcaatagatgataacggaaattatttacgagacatacaaatgggaagcaggattataccaatgagtcaagacgttctaggcaattttgactcaggagtaaccgagagtcaaacggcggttagaacagggtttcgcggactacgaaggatacgagaacgatcgcttcttcgtagagaaaggcttcatagagtactacacgtcatgggtttcctgcctccacactatgactccgcaataggatggaataaagaggaacccaccacatatggtaaatttttaaatcatggagaaccaaaattagcatgggaaagacaaggcgacggtagcatgcgatttctatttatggacagtttccacaaaatgatggaagatttcgctccccatcaacccgcccttgtggccgatggaaggaaaataccgttagattggacactatattacttaagaaagaaagctctaacacagcccataaagaaagaggagctcgcatggatactactaaactttaatcaaaaacgaggatactaccagctcaggggagaagaagaagaagaaaacccgacgaaaagagaggaatatcatgaactaaaagtagtatctgtggaagctgcagaagagggaaagggaggcaacacatggtataatgtaaaattagaaaatggttggatttatcgacgaagttcaaagatcccattggatgattgggtaggcaaaacacgaccattcatcgtaacaacagaatatgaggctgatggaatcactttaaagaaaaataaagaaggagaagtgaaaagatccttcagagcaccaggagaagacgactggggcttaagaaagaaacgaacagaaagtcaattagaagcaagtggcaaaacagtaggggcattcatttatgaccatctattggcggaacctgcagacaagataagaggtaacttcatacgcacaatagaacgcaaatattacaaacaagaacttgcagatatattaagagaacaatcaaaataccacgaagaacttcaaagtaagaaaatattagcggattgtgcagaagaactctatagatccaaccaaccccatagggactctttattaaagaaagatatggtatacttactcttaacagatataatattttaccaaagacctttaaaaagcaaaaagtcattaatagccgattgtccatacgagtattatgaatatgtagacaaagagacaggagaaataaaaagacaaggaatcaaatgcgtagcaaaatccaacccatattatcaagaatttagactatggcaattcgtactcaatttacgcctctatgacagaacagaagacaaagaagtaaccgctgaatacttaccttccaaggaagattacgctagactttttgtatacctgaacgatcgaaaagagattaatcaagaaacgctcctaaaagactttttcaaactcaagaaagtcaaacaaagatcagaaaaagagttccccgtaagatggaactatatagaagataaagaaaagaaatacccgtgtaacgaaactcgccatgaattgcttatggccttagacagagcgggaatcgaacgtagttggctagacgatacggcaagacaatgcagattatggcacctattatatagcatagaggtaaaagacgaggcagaaagggctctacgaaaactaaaagatgatgacgagttcgtatcggcttttctaaaagttaaaccatttaagaaagattatggagcttatagcgaaaaggcggtcaaaaagctgctcgcagtaatgcgaatgggcagtcactggtgtgaagatgacatatgcaaagaaacgaaagaacggatagaacacattctacaaggagatgtagaagagaaaataaaggaaagaatgaaccacacagcatatagtttgggcgaattgagtgacttccaagcattaccggaatggcttgcgtgttatgtagtatacggacgacactctgaagcgacagatataaagcactggaaaacacccgaaagccttatggcatacatcaacggattcaaacaacatagtctaagaaatccaatagtggaacaatgcatactcgaaacactcaggactgtacatgacatatggaaagaagcaggacacatagacgaaatacatgttgaactaggtagatcaatgaaatcaacatccgatcagagagcacgtatgactgaaaacatactaagaaatgaaaacactaatcttagaattaagagcctattaatggagctcaaaaacgacgccgacataaaagatgtacgaccttattcaccaatgcaacaagaaatattaagaatatacgaagaaggtgccctgcaggaattaacaaaagaagataatgattatgaagaaatttttaaaatatccaaaatgccccaaccaagcgctaaagaactactcaaatataaactgtggcttgaacaaaaataccggtcaccatacacaggtaagcccatatccctgtcgaaattgttcacatcagcatatcaaatagagcacatcatacctcaaagcagatatttcgatgacagctttaacaataaagtaatatgtgaatcagaagttaatgcgttaaaaggaaacatgcttggctatgagttcattaaaaatcacggaggagaaatagtacactgtacactactcggcgacgtaaaggtacagaatgaaagtgagtataaggcgttcgttacagaacattatgctaacaacaaatataagaaagaaaaattgctaatggaggatatacctcaagattttcttaatagacatttaaatgatagtcgatacattagtaaagtagtcaaaactcttctatcaaacatagtccggacagaagacgaaatggaaacaacatcgaaattcgtcgtaagctgtacgggaggtattaccgatcgattaaagaaagattggggtctaaatgacgtatggaactcaatagtttatagcagattcgaaagactaaatgaattaactaaaagcgatgcatttggacggtgggagaataaagaaggtaaacgagtatttcaaacaagtgtacctttggaactgcaaagaggttttaataagaaaagaatagaccatcggcatcatgccatggacgcactcgtaattgcatgtgcatcaaggaatataataaattatttaaataacgaaagcgctaatagcccaaagaaaagagaagatttaaggcaacaattgtgtgataaaaatagaataatacgcaaaccatgggaaagttttactcaagatgcaagagcagcactggaagacgtagtagtctcatttaaaaactacgttagagttataaataaagctacgaattactacgagaggtatgatgccgacggtaagaaaaccataacaaaacaaaagagcagagaaatgtgggcagttagaaaaccaatgcataaagagaccgtatttgggcacgtaaatctcagaagaaaagcaatagttaaactaaaagatgcactcgaaaatatacccagtatatgtaataaagaattacgggattacataaatggtctagtagaacgaaatttcaacacaaagcaattacatgcacactttcgaagtactgattatagatggaataagcaaaatgttgacaaagttgaagtatggcgcttctcagatgaaaaggaaccattggtcgcaactcgaaaaccgctagatacctccttcgatgccaaacgtatagacacaataactgatactggaatccagaaaatactactgaattacttagaagcaaaaggaggagatcccttaatagccttcactcccgagggaatagcagaaatgaaccaaaacattgccttatacaacgatggaaaaatgcatcagccaatattaaaagtacgaatcagtgaacccaagggtgcaaaatatcaaataggacaaactggaaacaaagctgacaaatttgtagaagcacaaaaaggaacaaatttatactttgctatatacgaggatgaagaccgaaaccgaacctacaatacaataccactaaatgaagtagctgaacgcttgaaacagggcctaccacccgtacccgagaaaaacgaaaaagaagtgcctttaaaattctatttaagtccgaatgatctcgtgtatgtaccaacagaagaggagatccttatgaaagaatgcaaactaaataaaaacagaatatataaaatggtaagttcaaccggaaaccaatgcttctttataccttttagagtggcagtatctatagttaataaaatggaatattccccattaaataaaatggaaaaagcaataagctctgaaatgataaaagcagtgtgctggaaactagaagtagatagattaggtaacattataagggtggtaaaatga

SEQ ID NO: 5718 - RNA, 4452 nt, synthetic construct
  misc_feature 1..4452: note = Cas9 variant
  source 1..4452: mol_type = other RNA
atgaaaacaattctgggtctcgatttaggaacgaactcgatcggttgggcgaaagtatccttagatgataatggtaactatcttcatgatataaaactggggtgccgcataataccgatgtcacaagacgtattggacaatttcggaaaaggagtaactgtaagccaaacatcagtaagaacaggcttcagaggtgtaagaagaataagagaaagatcattacaacgacgagaaagattacaccgtgtattacaccgtctgggattcttgccgcaacattacgacgcagccataggatgggacagcgactgcgcaaaaacttatggaaaattcctagacaacggggaacctaaattagcatgggaaagacaagaagatgggtcaatgagatttctattcatgaacagcttctatgaaatgatagcagacttcacgagtcatcagcctgcgctagtagcagacggcaagaaaataccgcttgactggactttatattatctaaggaagaaagcattaacgcaagcaataagaaaagaagagttagcgtggatattacttagcttcaatcaaaaacgaggttattaccaactaagaggggaggaagaagatgaaaatccgacaaaaagagaagaattttgcgaactaaaagtggtagcagtagaagcagcagagaaaggcaaaggagatgacatatggtataatgtacatctcgaaaacggatgcatatataggcgatcaagcaaaatctcattagacgactgggtgggaaaaacaaaacaatttataataaccactgaatacgaaaaggatggtgtaactcccaagaaagacaaagacggcaaagaaaaacgatcttatagggctccgaaagaagatgattggggtttaaggaaaaagagaacggaaacagatttagaagcgagtggaaaaacagtgggcgccttcatctacgagcatctcctagctgaaccattcgacaagataagaggaaattttattcatacgatcgaacggaagtactatagagcagaactagaagcgatacttacagaacaaagaaagtaccacgaagagttaagaagcgaacaaatgctggcggtatgtgctgaagaattatacagatccaatctaccacaccaacagagtcttctaaagaaagacatggtatatctcctcctgagcgatctgatcttttaccaacgaccactcaaaagcaagaaatcacttattgctgattgcccatacgaatattacagatacgtagataaagaaaccggagaaataaagaaacaaggcatcaaatgtatagctaaaagcaacccttattatcaagagttccgattatggcaatttgtgctaaacttacgcttgttcgacagaatgaccgataaagaagtgacagcagattacctccccacgaaagaagattacgtaagacttttcgactacctaaataacagaaaagaaattaaccaagagacgcttcttaaagacttcttcagattaaagaaagttaaactcggaagggaaaaagaatttgaaataagatggaattatatagaagataaagagaagaaatacccatgcaatgaaacaagatacgaactgttagtcgcactagacagagccgggatagacagaagctggatagatgaagatggaagacagtaccgtctttggcatttgctatattcaatcgaagtcaaagcagaagctgaatctgctttaagaaaattaaattctgatgatgcatttgtcagttcttttctaaaagtaaaaccatttaagaaagactatggcgcatatagcgaaaaagccgttaagaaactcttggcagtaatgcgaatgggaagtatgtggagcgaggctaacatatgcgaggaaacccaaaaccgaatacgtagtataataagaggagacattgaagagaaaataaaagaacgtatgggacatacggcaaggagctttaatcagatagatgactttcaagcactacccgaatggttagcatgctacgtagtatacggcagacactcagaggtaacagacattcaacattgggaaaccccagaacaattacaatcctatataaacggatttaaacaacatagtctgagaaatccaatagtcgaacaatgtatcttagaaacgctcagaacagtccatgatatatggaaagaagcaggacatatagatgaaatccacgtcgagttaggaagagatatgaaaagaacagctgatcagagagcccgtatgactaaaaacatcctcaaaaacgagaatacaaacctaagaattaaatcattactcatggaactgaagaaagatacggacataaaagaagtgagaccatatagtccgatgcaacaagaaatattaagaatctacgaagaaggtgcactgctgcaattaaaaagagacgacgaagcattcgcagatataagcaaaataagccaaatggctcaaccaactgccacagaattacgcagatacaaattatggctagaccaaaaataccgttctccctacactggtaaatttatatccctaagtaaactatttacatcagcctatcaaattgaacacgtcatacctcagagtagatattttgatgatagcttcagtaataaagtgatatgcgaagcagaggtaaaccggttaaaatcaaatatgctagggtacgagttcataaaagcgcacggaggagaaattgtccactgcacaatgttaggagatgtgaaaatcctatcagaatctgaatataaggcttttgtaaatgaacattacgtcaatcatagagcaaagaaagaaaaactcttaatggaagatattccacaagaatttctaaataggcaaatgaatgattcaagatatatatcaaaagttgtaaaagcgttattatccaacattgtaagaacagaagatgaaatggatgtaacttcaaaattcgtggtaccatgcagcggaggtatcacggacagattgaagaaagattggggtctaaacgacgtttggaatagtatagtttaccccaggtttgaacgactaaacagaatgacaggtacagaagcatttggacactgggaaaataaagaaggaaaaagagtattccaaacttcagttcctattgaattacaattaggtttcagcaagaaaagaattgatcacagacatcatgcaatggatgcattagtcatcgcatgtgcaagccgaaacataataaattatctgaacaacgaatcagcaaattctcaaaagaaaagagaagacctcagaagactactatgcgacaaaaacagaatcatacgcaaaccatgggagagcttcacccaagacgcgagagtagcattacaagatatagtagtatcattcaaaaattacgtacggattatcaataaagccacaaattattatgaacgatacgatgaacaaggtaagaaaactacggcggaacaaaaatctagcgaaatgtgggccataagaaaacccatgcataaagaaacagtattcggtcacgtaaacttaaaaagaaaaacaacggtaaaactaaagaacgccattgaaaatataccaaatatatgtaataaagaattaaaagcctatataaacgagctagttgaaaaacatttcaatactaaacaaatgttagcccactttaaatcaataaattacagatggaatagacagaatgtagaaaaagttgaagtatggcagtattcagatgaaaaagaacgcatggcagcaacaagaaaaccattagatacatcattcgataagaaacgtatagaaaccataactgataccggaatacagaaaatactgcttaactacctcgaagaaaaaggaggagatccaaatattgctttcacacccgaaggtatagcagaaatgaataaaaatatcagcttattcaatgacggaaaacttcaccaaccaatattaaaagtaagagtagctaaaacaatgggagcaaaataccaagtaggacaaacagggaataaagcagcaaaatatgtaggagcccaagaaggaactaacttatactttgcgatatatgaaaacgaggaaggagaaagatcgtataatgctgtaccattaaatgaggtggctgagcgcctaaaacaaggcatgtcacctgtgccagagaaaaacgaaaaagacgtaccactaaaattttatttgtcgccaaatgacctagtctatgtacctacagaagaagataaactaagcaatgaatgtaaattagataacgaaagaatatacaaaatggtgagtgcaacaggaaagaaatgccatttcctaccgtactcagtcgcaaatatcatatacaataaagtagaatttgaaagcatgaataaaatgggaaaagccttaagcggagaaatgataaaagccgtgtgttggaaactagaagtcgacagactaggaacgatattgagggtaataaaatga

SEQ ID NO: 5719 - RNA, 4452 nt, synthetic construct
  misc_feature 1..4452: note = Cas9 variant
  source 1..4452: mol_type = other RNA
atgaaaacagaactagaccttaacaaagatcgactatataaacatgtattaggtctcgaccttggagtaacatcaatagggtttgcacacgtagttgaaagcgaaaataggaatgaatcagaaataaaacaaataggagtaagagtaatacaactcgataattttgataaagtagataaatcaggaaaaacatcagaaagcaaaaaccccgcagtggatttcgcagcagggaaaggtctcacaccaaacgggtcaagaaccaagaaaaggggagcaagacgaaatttagataggtatcaagacagaagggataatttgcttgaagtattaacaaaatccggattcataaacagtgaaacaaaacgtactgaagacggaaaacatacaacacaccaaacatgggaaatcagagctaaagcagtaagcgaaaaagtagaaaaagaagagttcgcgcgaatactccttgctatcaacaagaaaagaggatataaatcgtcaagaaaagccaaaaacgaagacgaaggtcaagcagtagacggaatggcagtagctaaaagactatatgaagaaaacctcacaccaggacaatatgcgtacgaagtattgtctgggggaaagaaatcaattccagacttctacaggtcagatttacaagcagaatttgacaaaatttggaactttcaaaaacaattttacccgaatatacttacagatgaattttacgaagaactcaaagggaaagggcaaagagcaacgagcgcagcattctggaaaattcatcaatttaacacagccgacattaaagatttagaagacgagttgaaaaacgaaagaacaataaaattatctaaaagagatcagaagaaactacaggcttataaatggcgatccgaagcggtagtgaaacaattaggtaaagaagaagttgcatatgtgttaacagagataaataacaacttaaacaacagtagcggatacctaggagcaatctcggatcgctccaaagaactgtattttaacaaacagacagttggacaattcctatacaaacaactcaaagagaacccccacacaagactcaaaaatcaagtattctataggcaagactacctagatgaatttgaaacaatatgggaaatgcaagcacaattccacccagaactaacacaagaattgaaagaagaaattcgagacattattatattttatcagaggaaactaaaatcacagaaagggcttatttctttttgcgaattagaatccaaagaagtagtaattaacgatacgaagaaaatcattggcctaagagtggcgccgaaatcatcaccattattccaagagtttaaaatttggcaaaatttgaataacgtcttagtgagaaagaaagggtcacgtaaaagaatggtgaaagctcaaaaccaacattcactttttgaagaacctaaagaaatctttagcttagatttagcatccaaagaaaaactattcgaagaattaaacttgaaaggtaacttatcagctaaaaattgtctcgatatcttgggacttaacagcaatgaatgggaattgaattacacacaactagaagggaacaggaccaacaaatctctctacgaagccttcctcaaaatactagatattgaaggatatgatgtaaaagacctactaaaagtcaaatcatccaaagacgaagtagaactagacgatctaaaagtgcccgcatctgaaattaaaaacatggtaagagaaatattctcgacgaataaaatagacactgaaatattggacttcgatgcagaaatagacggaaaagcattcgaaaaacaaagtagttatcaattatggcatctactctactcatacgaaggtgacgattctcaatcaggaaacgaaaaattgtacgagctattggctaaaaagtttggattcaagagagaacatgctcagatactcgccaatgtatcattagttgacgattacggaaatttatcaagtaaagcaatgagaaaaatatatccacatataagagaaaacaactactcgaccgcttgtgaattagtcggatacagacattctaaacacagcctcacaaaagacgaacttaaagatagggtactggaagacagattagagctattaaagaaaaattctttaagacaacccgtagtcgagaaaatactaaaccaaatgattaatgcagtaaatgctttaatagagaaaaactccgaacgagacgagaacggtaatatcacaaaatattttaaattcgacgagatcaggattgagctagcaagagaactaaagaaaaatgcagcagaaagagctgaaatgacaacaaacataaatgcggcgaaattagttcatgagaaaatattcaaaatattacaaaatgaatttgggatcaaaaacccaacacgaaatgatattattcgataccgattatacgaagaactaaaaggtaatggatacaaagatttgtacagcaatacctatataccaagagaaatactatttagcaatcaaatagatatagatcacatcttaccccaatctaggcttttcgatgactccttcagcaataaagtcgtagtgttccgcaaagacaatctaaagaaaggtaaccaaacagcaattgattacattggaagtgaagttggtgaggaaggactcaaaaacttcatagaaagagtcgaaagcctatacgaacttggcaagaaaaataaagaagaaggaatctctaaagcaaaatatcagaaactattaaagtcagcttcagagataggagatggattcatagaacgagatttaagggaatcacaatatatagctaagaaagcgaaagaattactcttcaaagtaaccagatcagtagttagtacaagtggatccataactgacagattgagagaggactggggtctaataaatgtgatgaaagaattaaacttacctaaatataaatcactcggactcacagagatacaagagagaagaaatggacatcaagtagaagtgataaaagattggacaaaaagaaacgatcacagacatcacgcaatggacgcattggctgtagcatttacaaaacataatcacatacaataccttaattacttgaacgctcggaaaaatgaaagccacaaattgcatggcaacatcatagctatcgaaacactagagacagaagtcaaaattgacgacctcggtaacaagaaaagggtatttaaggaaccaattccgaacttcagacaagttgcaaaagaacatctagagaacgttctaatttcacacaaagccaaaaataaggtcgtcaccaaaaataaaaacaagattagtggcaaagaaaaattacaaataacacttacaccacgaggccaattgcataaagaaacagtctacggtaaatacaggttctaccagagtaaagacgaaaaagtcagcgcaaaatttgacctagaaacaatagaaaaagtagcaaacccaagctataaagcagcacttctacaacgattaaacgaaaatgaaaacgatcctaagaaagccttcagcggcaaaaacgccttatctaaaaacccaatctatatatcaatggaaaacgacattaaagtaccagacaccgttaaacttgtgtggctagaagaagattactcaataagaaaagatgtaacacctgaaaatttcaaagacgagaaatctattgagaaaatattagatgaaggtgttaaaagaatactgaaaaacagacttaaagaatttggtggtgatgcaaaagaagcatttagcgacttagacaaaaacccaatctggctcaatgaggagaaaggaacaagcattaaacgagttagaatttccggtgttaaaaacgcagaaccgcttcactataagaaagatcacttcggtaatgacatactagacggaaacggtaataaaattccggcagatttcgtatccacaggaaataaccaccacgtagccatatataaagaaccggaatttgataagaaaggacaaccagtgctcgatgaattaggaaaccagaaatataacttgcaagaaaaagttgtatcattcttcgaagctgtcgaaagagtcaaccaaggattaccaataattgataaaacttacaaccaacatctgggatggcaattcttctttacaatgaagcaaaacgaaatgtttgtatttccaaacgagaaaacacggttcaatccaatagaaatagacctcctagacccaaataataagaaactcataagccttaatctatttagagtacagaaaatagcaaataaaaactacatgtttcgacatcacctagaaacaaatgtagatgacaagaaagaaatgaaaaatatcgctttcatacatatccaaagttgcaatttacttaaagaaataattaaagtcagactaaatcatttaggagacatagtaagtgtaggagaatactga

SEQ ID NO: 5720 - RNA, 4452 nt, synthetic construct
  misc_feature 1..4452: note = Cas9 variant
  source 1..4452: mol_type = other RNA
atgaaaacaatactcggtctagacttaggtaccaactcaataggttgggcaaaagtatcagtcgatgatcatggtaactacttgcacgatataaaattgggcagccgaataatacccatgagtcaggatatactaggaaacttcgacaaaggtgtaacagaatcacagacagccatcagaaccggtttccggtctgtaagacggataagagaaagatcattattaagaagagaaagacttcatcgagtcctccatgtcatgggatttttgcctccgcactacgattcagcaataggctggaatcgggaagaggcatcaacatatggaaaatttctcaaccatggagaaccaaaactggcgtgggaacgtcttgaagacggaagcatgcgctttctgttcatggactcattccatgaaatgatggcaaacttcgcaagacatcagccagcgctcgtagcagatggaagaaagatacccttggattggacactctactacctaagaaagaaagcactatcacaagctgtaggaaaagaggaactagcatggatattgttgaattttaatcaaaaacgaggatattgccaacttcgcggcgaagaagaagaagaaacacctacaaaaagagaagaatattacgaactaaaagtggtatcggtcgaagcagcagaggaaggaaaaggtggaaatacatggtatcgcgttcaattagaaaacggatggatatatcgaagaccatccaaaatagcattagacgattgggtgggaaaaacaaaacagtttatagtaacaacagagtatgaaaaagatggaactacactaaagaaagacaaagacggagaagtaaaaaggagcttcagagcaccaggggaaaatgattgggggttaagaaagaaaagaactgaaagccaacttgaggcatctggtaaaacggtaggagcatttatatacgaccatcttttagctgaaccagccgataaaatacgtggtaattttataagaaccattgaaaggaaatattataaacaagaattagaagcaatactaagagaacagaccaaacatcatgaagaactaagatcaaaagaaatgcttgctaaatgtgcagaagaattatatcaaagcaaccaaccacatcgtaaaagtctcttaaacaaagacatgacctatctacttcttaccgatttaatattctatcagagaccacttaaaagtaagaaatcactaattgcagaatgtccatacgaatactacaaatataaagataaagaaaaaggtaaaaagaaaagacagggaatcaaatgtgtagcaaaatcaaatccatattaccaagaatttagactatggcaattcatagtaaacctcagactatttgacaggacagatgacaaagaagtaactgccgaatacttaagaagcagagaagactatgcacgtttatttgcctacctaaacgataggaaagaaattaaccaagaaacgcttttaaaagacttctttggactaaagaaagtaaaaattggagctgagaaagaatttgccatcagatggaactatattgaagataaagagaaaaagtatccttgtaacgaaactcggcatgaacttcttctagcattagaccgagcaggcatggaccgaagttggcttgacgatagcgaattgcaatacagactatggcatttattatactccgtagaagcaagagacgaagcggaaggggccttacgaaaactaagggacgatgatgaatttgtaggagcctttttaaaggtgaagccctttaagaaagattatggtgcttatagcgaaaaagccgtaaagaaattgttagcggtaatgcgaatgggatcttggtggcatgaagaagatatatgcaaacaaacacgtgacagaatagaaagaatagtacaaggagacatagaagagaaaattagagaacgtatgggccacgctgcatattcattttcccgattagcagactttcaagggctcccggaatggctcgcttgttatgttgtatacggacgacacagtgaagctacccacattttgagatgggacagtccagataaactattaagttacattaagggttttcggcaacatagtctcagaaacccaatcgtagagcaatgcatattagaaacgttacgaacagtccatgacatatggaaagaagcgggacacatagacgaaatacatgtagaactagggagaagtatgaaaagcacagcggaacagcgtgcacacatgaccaaaaatatcttaaggaatgaaaacacaaacttaagaatcaaatgcttacttatggaattaaagaatgacgccgatgtgaaagatgtaagaccttatagccctatgcaacaagaaatactacgaatatatgaagagggagcgttgcaacagctgacgaaagatgacgcggaatatgcagaaataagcaaaataagtaaaatggcgcaaccctcagcaaaagaacttctaagatataaattatggctagaacaaaaatatagaagtccttacacaggcaaacctatttcactatcaaaattgttcacatcagcataccaaatagaacatgtgatcccgcaatcacgctattttgatgactcctttaataataaagtcatatgcgaatcggaagttaatacactgaaaagtaatatgctagggtatgaatttattaaaaatcactgtggagaaatagtacactgcactatgttaggagatgttaaagtattttcagagagtgagtataaagcatttgtaacagagcattactcaaacaacaaatataaaaaggaaaaacttctcctagaagatataccacaagaatttcttaacaggcaaatgaatgacagtcgctatataagcaaagttgtaaaaggtttattatcaaatgtagtccgaacagaagacgaattagaagcgacatctaaattcgtggtcagctgtacgggaggcataacagacagacttaagaaagactggggattgaatgacgtatggaacagcatagtgtatagcagatttgagagattaaacggtctaacgaaaagtgaacattttggccactgggaaaataaagaaggaaaacgcgtatttcaaacctcagttcctatggaattacagcgcggcttcaacaagaaacgtatagaccacagacaccacgcaatggatgcattagttatagcatgtgcatcgagaaatattattaattacttaaacaacgaatttgccaaaagtccaaaacaaagagaagatctacgtcaacttctctgtgacaaaaatagaataatcagaaaaccttgggaaacttttactcaggatgctagggccgcattagaagatgtagtcgtgtccttcaaaaattatgtaagagtcataaataaaacaactaattattatgaaaggtatgatgctgacggaaagaaaacaatggtacctcaaaaaggtaacgaaatgtgggctgtaagaaaaccaatgcatgaaggcacaatgtacggaagagtcaatctaagaagaaaagctgtcgtaaaattgaaagaggcacttgaaaatataagtagcatatgtaataaggagttaagagactatataaatgttctagtagaaaagcagtttaacacaaaacaactgttagcacacttcaaatccatggactacagatggaataagcaacatattgacaaggtagaagtctggagattcagcgacgaaaaagtacaaatggtcgccgcccgtaaacccttagacacgagcttcgataaagaatgtatagcaagtattacggacacagggatacagaaaatacttctaaattacctagagtcaaaaggaggagatcctgcaatagcatttacaagcgaaggtatcgcagaaatgaatcaaaacatagcagtttataatgatggaaagaaacatcaaccagtcataaaagttaggaaatccacgaaattaggaaagaaatttgcagtaggtcaaataggatgcaaaagcaaacaatttgtagtggcggaagcaggtacgaatctatactttgcaatctacgaggacgaagaaggaaaaagaagttacgacacaatccccttaaacgaggtaacagaaagattaaaacaaggattaagccccgtaccagagaaaaatgaaaaagaagtaccactcaaattctaccttagtcctaacgatctggtatacgtccctacagaagatgaaatgcaaatgaaagaatgcaaactcaataaagaaagaatttataaaatggtatcgagtactggtaatgaatgtcactttctaccatacagcgtagcaagtgttatttataataaagtagaatttgaaagcatgaacaaaatgggtagagcactaactggagaaatgatcaaagctgtctgttggaagttagacgtagatagattgggaaatatattaagggtgataaaatga

SEQ ID NO: 5721 - RNA, 4452 nt, synthetic construct
  misc_feature 1..4452: note = Cas9 variant
  source 1..4452: mol_type = other RNA
atgaaaacaatactaggactcgatttgggaacaaattcgatagggtgggcaaaaatttcaattgacgataatggcaactacttacgagatattcaattaggcagtagaataatacctatgtcacaagatgtacttggcaattttgacaacggtgtaacagaatcacaaacagcagtaaggacagggttcagaggattacggcgtatacgggaaaggagtctactaaggagagaacgtttgcacagggtactgcatgtcatgggatttctccctccccactacgacagcgccataggctggaataaagaggaaccaacaacatatggcaaattcctaaaccatggagaaccaaaactggcatgggaaagacaaggtgatggttcaatgagatttttatttatggattcttttcacaagatgatggaagatttcgcacctcatcaacctgcattagtcgctgacggacgaaaaatacctttagactggacattatactatttacgaaagaaagcactaacgcaaccaataaagaaagaggaactagcgtggatacttttaaactttaatcaaaaacgaggatattatcaactacgaggagaagaagaagaagaaaaccctacaaaacgcgaagaatatcacgagctaaaagtagtaggagtagaagctgctgaagagggtaaaggagggaacacgtggtacaacgttaaactagaaaatggctggatttatagaagaagttcaaaaattccactagacgactgggtaggcaaaactagaccattcatagtaacgacagaatatgaagcagatggtataaccctaaagaaaaacaaagaaggagaagtaaaaagatcatttcgagccccgggggaagacgactgggggttatggaagaaaagaacagaatcgcaattagaagcatcaggaaaaaccgttggcgcgtttatctatgatcatctattagcagagcctgcagataaaatccgaggtaactttatacgtacaatagaaagaaaatactataaacaagaactagcagacatattaagagaacaatctaaataccatgaagaacttcaaagtaagaaaatcctagcggactgcgctgaggagctatatagaagcaatcaacctcacagagatagcttactcaagaaagatatggtttacctcttattgacagatttgatattttaccaacgaccgctgaaatcaaagaaatcattaatcgcagactgtccctatgaatattatgaatacgtagacaaagagacaggagaaataaaaaggcaagggatcaaatgtatagccaaatccaacccgtattatcaggaatttcgactttggcaattcgtactaaatttgcgactttatgacagaacagaagacaaagaagttacagcagaatacctcccctcaaaagaagattatgcaagactattcgtatatctgaatgacaggaaagaaataaaccaagagaccttacttaaagatttctttaaattgaagaaagtaaaacaaagatcagaaaaagattttcccgtgaggtggaattatatcgaagacaaagaaaagaaatacccctgcaatgaaacacgacatgaattgttaatggcattagatagagcaggaatagaaagaagttggctagatgacacggcaagacaatacagattatggcacttgttatatagtatagaagttaaagatgaagcagaaagagcattgagaaaactaaaagacgatgatgaatttgtaagtgctttcctaaaagtcaaacccttcaagaaagactatggcgcgtattcggaaaaagcagttaagaaactgctagccgtgatgcggatgggcagtcattggtgtgaagacgatatttgtaaagaaacaaaagaaagaattgaacatatcctacaaggagacgtaggagagaaaataaaagaacggatgaaccatacagcgtactcactcggagaattaagtgacttccaagcattaccagaatggttagcatgttacgtagtatatggtagacatagtgaagccaccgacattaaacattggaagaccccagaatcactaatggcatatataaacggtttcaaacagcacagccttcgaaacccaatagtcgaacaatgcatattagaaacgttaagaactgtacacgacatatggaaggaagcaggacatatagatgaaattcacgtagaactaggaagaagtatgaaaagtacatctgatcaaagagcgagaatgacagaaaacatacttaggaacgaaaacaccaacttaaggataaaatcacttctaatggagttaaagaatgacgccgacatcaaagatgtacgaccctatagcccaatgcaacaagagatattaagaatctacgaagaaggagctctacaagaactcacaaaagaagataatgattacgaagaaatattcaaaattagtaaaatgccacaaccgtcagccaaagaacttttaaaatacaagctatggttagaacaaaaatatagatccccatatacaggaaaacccatttcactctcgaaactatttacaagtgcataccaaattgaacacattatcccccaatctagatacttcgatgatagcttcaacaacaaagtaatatgtgaaagtgaagtaaacgcattaaaggggaacatgttaggttacgagttcattaaaaaccacggaggcgaaatagtacactgcacactactaggagacgttaaagtacagaatgaaagtgaatataaagcctttgtcacagaacattacgcaaacaataaatacaagaaagaaaaattactaatggaagatataccacaagacttcctgaacagacatcttaatgattcaagatacatatcaaaagtagtcaaaacactactatcaaatatcgtaagaacagaggatgaaatggaaacaacatcaaaattcgtcgtctcttgcaccggaggaataacagataggttaaagaaagactggggactaaatgacgtctggaactccattgtttactctcgatttgaaagacttaatgaattgacaaaatcagatgcctttgggcgatgggaaaataaagaaggtaaacgtgtattccagactagcgttcccctagagcttcaaagaggattcaataagaaaagaatcgatcacagacaccacgcaatggacgccttagtgatagcatgcgccagcaggaacatcataaactatctcaataatgaatcagctaactctccaaagaaaagagaagacctcagacaacaactttgtgataaaaatagaataatacgaaaaccctgggaatcattcacgcaagacgcaagggctgccctcgaagatgtagtagttagtttcaaaaactatgtcagagtaatcaataaagcaactaactactatgaaagatatgacgcagatggaaagaaaacgataacaaaacagaaaagtagggaaatgtgggcagttagaaaaccaatgcataaagaaacagtatttggacacgtgaacttacgaagaaaagcaatagttaaattgaaagacgcacttgaaaacatcccttcaatatgcaataaagaattaagggattatataaatggtttagtagaaaggaatttcaacacaaaacaactccacgcacacttccgcagcaccgattacagatggaacaaacaaaacgttgacaaagttgaagtatggagatttagcgacgagaaagaaccgctagtagcaacaagaaaacctctagatacaagttttgatgccaaaaggatcgacacaataacagatacaggaatacagaaaatattactaaactatctagaagctaagggcggagacccactcattgcatttacacctgaaggcatagcagaaatgaaccaaaatatcgccctatataacgatggaaaaatgcatcaaccaatcttaaaagtaagaattagtgaaccaaaaggcgctaaatatcagataggtcaaacgggaaacaaagcggacaaattcgtcgaagctcagaagggcaccaacctatatttcgcaatatatgaagatgaggacagaaatcgtacatataacacaataccactaaacgaggtcgcagaaagacttaaacaaggattaccacccgtaccagagaaaaacgaaaaagaagtacctctgaagttttacttgtctcctaatgatctagtgtacgtaccgactgaagaagaaatattaatgaaagaatgcaaactcaacaaaaatagaatatacaaaatggtttcatcaactggaaatcaatgcttcttcataccattcagagttgccgtctcgatagtcaataaaatggaatactctcctcttaacaaaatggaaaaagccatatcatccgaaatgataaaagctgtatgctggaaattagaagtagaccgcctaggaaatataataagggtagtcaaatga

SEQ ID NO: 5722 - RNA, 4458 nt, synthetic construct
  misc_feature 1..4458: note = Cas9 variant
  source 1..4458: mol_type = other RNA
atgaaaaacatacttggcttagacttaggaactaattctatagggtgggcaaaaatctcaatagatgacaacggtaaatacatcaaagactcaataaaactcggatcacgtatcattcccatgtctcaagacgttttgagcaatttttcaaaaggagttacattaagccaaaccagtgagcgaacaagtttcagaggagccagaaggctccgagaaaggaccttactacggagagaaagactacaccggatacttcacctactaggcttcctacctaaacactacgaaaaagccataggctgggatagaaatgacaataaaacctacggaaaattcattaaccacgcagaaccaaaattggcatggtgcaaagacaataacggcaaaatgagatttttatttatggactcatttcacgacatgctctccgagtttagcgaaaaacacccagaattactcgcaaacggtaagaaaattccattagactggacgatatactacctaaggaagaaagcgctatataaagccataacaaaagaagaactagcatggattttactaaatttcaaccagaaaaggggatattaccagcttagaggcgaagaagacagagatagcgaagcaaacaagaaagaatacttagaattaaaagtaattggcgtagaagcaacaggagagaagaaaggtaacgacatatggtataacatacacctagaaaacggctggatatatagaagatcctctaaaaatcctctcaatgactggctaggaaaagttaaatcctttatcgtaacaacagatctagacgccgatggaaaccccaagaaagacaaagacggaaatatcaaaaggagcttcagagcaccgtcagaaggagactggacattaataaagaaaagaacagaatcccttcttgaaaacagtggtcaaacggtaggccaatttatatataatcacattttggaggagccatcagccaaaataagaggaaatttcataagaacaatagagcgaaaatactacaaagacgaactaaaagcaatactcgaaaaacaaaaagagttccatcacgagctaagctcagaatcactactcacagaatgtgcgaaagaactatataaacgcaacatcgcacatcaagaagtcttacttaagaagggcatgattcatcttctcctaaatgacatcctgttctatcagcgacccctcaaaataaagaaaagcctgatagataattgtccgtatgaaaactataaatacgtagacaaaaagtctggggatataaaagtaaaaagcataaaatgcatagccaaatcaaatccattcttccaagaatttaggctctggcaattcgtgagtaaccttagactatacagaaaatcagatgacaaagacgttacaagcgaacacttagtaacgacagacgactacgccaacctttttacctatctaaacaatcgaaaagacataaaacaatctgtacttctcaaggaatacttcaaaatcaagaaagttaaaacaatcaacggggctgaatatcctgtccggtggaattatatagacgacgataataaaacatacccgtgtaacgaaaccagatatgatatcttacacgcactttctaaaacggaattaaaatccgaatggttgacaccggaacgaacctataggttatggcacttattgtactctatagaaagtaaagaggaaacaaagaaagccctgaataaattaaatttatcagacgatttcacagaggcttttctcaccattaaacctttcaagaaagaatacggaagttattcagagaaagcaattaagaaactactgtcattaatgagaatgggatacttatggagtgaagacgaagcaataaaacaagtaggtgcggaaatagagaaaacaatagaaggagaactaccggattacgtgttacaaagattagaaaagagccaacacaattataataaaatatcagacttttcaggccttccactatggttagcatcttacattatctatggaaggcactcagaagccaaagaaataattcactgggataacccagaatccatgatggcctatataaaagattttagacaacactcaatgaggaacccaatagtggaacaatgtgtactagaaactttaagaacagtccacgacatctggaaagaaataggacacatagacgaaattcatatagaattaggtagagaaatgaaatccacttctgaacaacgtaaagccatcacacaaaacgtactccataatcaaaacacaaacataagaataaaattgctactacaagaacttaaaaacgataacaacataacaggggtccgtccgtacagtccgatgcaacaagaaatactacgtatatatgaagaaggagcactacaaggcctaaccaaagaagataaggactataacgatatattaaagataagccaaacagcgcaaccaacaagtaatgaactcaccagatataaactatggctcgaacaaaaataccgaagcccatacacaggaaaagcaatttcgctaagtaaactatttacatcagcataccaaatcgaacacgttataccacaatcccgatactttgacgattcactctcaaacaaagtaatatgcgaatcggaagtaaatacattaaagaaagccatgctaggtatggaatttataaaaacatgtggaggacaaaaagtccattgcacgctactaggagacgtagaaatatacaacgaagaagattataaagccttcgtcaatgaacattatagcaataatagaactaaaagaaataaacttttaatggaagatatcccacaagagttcatcaaccgacaactcaacgatagtcggtatatatctaaaatggtcaaacaacttttatcagcaatcgttaggggacaagaagaagtagaagcaacatcaaaattcgtaataccatgcaccggcggaataacagatcgactaaagaaagactggggactaaatgatatttggaacaatttggtaagtccacgatttcaaagaatgaacgcactaacaggctctgaatacttcgggcactgggaaaataaagaaggcaaaagagtatttcaaactacaatgcctattcaactacaacaaggtttcagtaagaaaagaatagaccatagacatcatgcaatggacgccctagtgatcgcatgcgcatctagaaacataatcagttacttaaataatgaaacagcacaagataccgaacgaagaagagacttacgacaaaaactttgtgacaaagggggttctgtaagaaaaccctgggacagttttacacaagatacccaatatgcactaaaagatatcatagtcaccttcaaaaactacgtccgcattattaacaaagcaaccaattattatgaacactacaaaactgacggaaagaaaggtatgatttcacaaaaaggtgacgaactctgggcgataagaaaacccatgcacaaagaaacggtattcggaaaagtcaacctaagaagacccaaaagagtctcactttcaaaagctatagattcagtagatgtaatttgtaatcgaaaattgaaaaagtacataaaagcacgactaaacgagggcctacaaaagaaacaaatattaaacattttcaaagaagtaaataacgtatgggaaggcatcgacgtcaacaaaatagacatctgggagatgtcaaacgataaagaaccaatggtggcgacaagaaaacaactcgacactagcttcgacgaaaagaaaatccgatcaatttcagacacaggaatacagaaaatattattaaactacctgattacgaaaaacaataatcctgaacttgcattcacacctgaaggtattcaagaaatgaactctaatatatcagaatataatgaccacaagaaacaccaaccaatatataaagtgcgcgtcacagaacctcttggagcaaaatatccaatcggaacaatggggaacaacccaaagaaattcgtggaagcacaagcagggaccaatctttatttcgccatatacgaggataaagaaggtaatcgaaactacgacacaatccccttaaacatcgcagcagaaagattaaaccaacaacttagcccagtccccgaaaccaacgaaaataatactccactaaaattctacctaagcccaaatgacctcgtatatgtacctagcgaggaagagaggcatagtggtaacaacatacaactagataaaaaccgcatatacaaaatggtatcaagcaccagtaagcaatgcttctttatacaccaccgtgtggcaatatccttagtagataagaaagaatttagtgcacaaaacaaaatggaacgatcaatagacaacgaacaagtaatgattaaatcagtatgttggaaactgattactgatagactcggaaatattataaaagtcataaaatga

SEQ ID NO: 5723 - RNA, 4458 nt, synthetic construct
  misc_feature 1..4458: note = Cas9 variant
  source 1..4458: mol_type = other RNA
atgaaaaacatattaggacttgatctcggaaccaattcaattggatgggcaaaaataagtatagatgataacggtaaatacataaaagatagcattaaactaggatcaagaatcataccaatgtctcaagatgtcctatcaaactttagcaaaggcgtcactctttcacaaacaagcgaacgcacatcatttaggggagccagacgcctccgggaaagaactctattgcgaagagaacgtttacaccgcattttacatttattagggttcttaccgaaacattacgaaaaagcaataggatgggacagaaacgacaacaaaacatatggcaaattcataaaccacgctgaacccaaactagcatggtgtaaagacaacaatggcaaaatgagatttttatttatggatagctttcacgatatgctatcggaattttccgaaaaacatcccgaattattggcaaacgggaaaaaaatccctctagattggaccatatactaccttcgaaaaaaagctctatacaaggctattactaaagaagaactagcatggatactactaaactttaaccaaaaaagaggctactaccaactacgcggcgaggaagatagagactctgaggcaaacaagaaagagtacttagaattaaaagtaataggagtcgaagcaacaggagaaaaaaaaggtaacgacatctggtacaacatacacctagagaatggctggatttaccgaagatcttcgaagaaccccttaaacgactggcttggcaaagtaaaaagctttatagttacaaccgatttagacgcagatggaaatccaaaaaaagacaaagacggaaacataaaacgaagtttccgtgccccctccgagggagattggacactaattaaaaagcgaactgaaagcttattagaaaattcaggtcagacagttggacaatttatctataatcatatcctagaagagccatcagcaaaaataagaggaaattttatccggacaatagaacgaaaatattataaggacgaactcaaagcaatacttgaaaaacaaaaagaatttcaccatgaactgtcgtctgagtcattgctaacagaatgtgctaaagaactatacaagcgaaatattgctcatcaagaagttttactaaaaaaaggaataattcatcttttactaaacgacatattattctatcagagaccactgaaaatcaaaaaatcgctaatcgataactgtccatacgaaaactacaagtatgtggacaaaaaaagtggagatataaaagtcaagtctattaaatgcatcgcaaagagcaacccattttttcaagaatttcgactatggcaattcgtatccaatttaagattataccgaaaaagtgacgacaaagacgtgacctccgaacatttagtaaccacagacgattacgcaaatctatttacatacctaaacaatagaaaagatatcaaacaaagcgtgctacttaaagaatacttcaaaattaaaaaagtcaaaaccataaatggagctgaatatccagttagatggaactacatagacgatgataataaaacctatccatgcaacgaaactagatacgatattctacacgccttatcgaaaaccgaactgaaaagtgaatggctaactccagaaaggacatacagactatggcatttgctatattccatagaaagtaaggaagaaactaaaaaagcgctcaataaattaaatttaagtgatgacttcacggaagcatttctaacaattaaaccatttaaaaaagaatacgggagttatagtgaaaaagccataaagaaattactaagcctaatgagaatggggtatttatggagcgaagacgaggctataaaacaagtgggagctgagattgaaaaaacaattgaaggagaacttccagattatgtcctacaaagactagaaaaaagtcaacataactataacaaaatatcagatttctctggactacccctatggctagcgagctacattatttacggaagacactccgaagcaaaagaaataatacactgggacaaccccgaatcaatgatggcatacataaaagactttcgacaacactccatgcgaaatccaattgtagaacaatgtgtcttagaaacacttagaaccgtacacgatatttggaaggaaataggacacatcgacgagatacatatagaattaggccgagaaatgaaatcgacatcagaacaacgaaaagccatcacacaaaacgtcttacacaaccaaaacaccaatataagaataaaactcttattgcaagaattaaaaaacgacaacaacataactggagtcagaccatatagccccatgcaacaagaaatattacgtatatacgaagagggagcactccaaggattgacaaaagaagataaagactataatgatatactgaaaatatcccaaacagctcaaccgacaagcaacgaattaacccgctataaactatggctagaacaaaagtacaggtctccgtacaccggaaaagcaataagcttatctaaattatttacatcagcataccaaatagaacacgtcataccacagtcaagatactttgatgactcactgtctaacaaagtaatatgcgaatcagaagtaaacacacttaaaaaagctatgctaggcatggaatttataaaaacctgcggtggacaaaaagtccactgtacattactaggagacgttgaaatatataatgaagaagattacaaagcatttgtaaacgaacattattccaacaaccgaactaaaaggaataaactactaatggaggatataccacaggaattcataaaccgacagctcaacgatagcagatatatatcaaaaatggtaaaacaactgctatcagctatagtacgaggacaagaagaggtcgaagcaacgagcaaattcgttataccctgcaccggaggaataacagacagactaaaaaaagactggggcttaaacgatatttggaacaatttagtaagccctcgcttccaacgaatgaacgctctaacaggtagcgaatacttcggacactgggaaaacaaagaaggtaaacgagtattccaaacgacgatgccaatacagctccaacaaggcttttctaaaaaacgaatcgaccaccggcaccacgcaatggatgctttagtcatagcttgtgctagtcgaaatatcatcagttaccttaacaatgaaacagctcaagacacggaacgtagaagagaccttcgccaaaaactttgcgataaagggggatcagtgcgaaaaccctgggactcattcacacaggacacacaatacgcccttaaggatatcatagtcactttcaaaaactatgtacgtataatcaacaaagcaacaaattattacgaacattacaaaaccgacggaaaaaaagggatgatctcacaaaaaggcgatgagttatgggccatacgaaaaccaatgcacaaagaaaccgtcttcggaaaagttaatctccgcagaccaaagcgagtatcgctaagcaaagccatcgactcagtcgacataatatgcaaccgaaaactaaaaaaatatatcaaagcgagactaaatgaagggctacaaaaaaaacaaatactgaacatattcaaagaactgaacaatgtatgggaaggtatagacgtaaataagatagacatatgggaaatgtcaaatgacaaagagcctatggttgcaacccgaaagcaacttgacaccagttttgacgaaaaaaaaatcagatcaatatcagacaccgggatacaaaaaatacttcttaattatctaattacgaaaaataacaaccctgagctagctttcaccccggaaggaatacaagagatgaattcaaacatttcagaatacaacgaccacaaaaaacaccaacctatatataaagttagagttacagagcccctcggcgcgaaatatcccataggcacgatgggaaacaatccaaaaaaattcgtcgaagcacaagcaggaacaaacctatattttgcaatatacgaagacaaagaaggcaagaggaattacgacaccataccgctaaatatagcagccgaaagactgaatcaacaattaagtccggttcctgaaacaaatgaaaacaatacaccactcaaattctatctctctcccaatgatctcgtatatgtacccagtgaagaggaacgtcactccggcaataacattcaactcgacaaaaacagaatctacaaaatggtttctagcacttctaaaagatgcttctttattcatcacagagtagcaatttcattagttgacaaaaaagaattttcagcacaaaacaaaatggaacgaagcattgataacgaacaagtcatgatcaaaagcgtatgctggaaacttatcacagacaggttgggaaatataataaaagttatcaaatga

SEQ ID NO: 5724 - RNA, 4458 nt, synthetic construct
  misc_feature 1..4458: note = Cas9 variant
  source 1..4458: mol_type = other RNA
atgaaaaacatactagggctagatcttggaactaactccattgggtgggcaaaaatctcaatcgatgacaacggtaaatatataaaggacagtatcaaactcgggagtagaataataccgatgtcacaagacgtactatcaaacttcagcaaaggagtaacactttctcaaacatcggagcgcacaagctttcgaggagcaagacgtctacgcgaaagaacacttttaagaagggaacgactacacagaatactccacctcctaggttttctgcccaaacactacgaaaaagcaataggatgggataggaatgataataaaacatatggcaaatttataaatcacgcagaacccaagctagcatggtgcaaagataacaatggcaaaatgcgttttttatttatggatagctttcacgacatgctatctgaatttagtgaaaagcaccctgaactactagcgaacggcaaaaaaatcccacttgattggacaatatactatttaagaaagaaagctttatacaaagccataacgaaagaagaactcgcctggattctactaaactttaatcaaaaaaggggatactatcaactacgaggagaagaagatcgagacagtgaagcaaataagaaagaatatttagagttgaaagtgattggagtagaagcaacaggggaaaaaaaaggaaatgatatctggtacaacatacatctagaaaacggctggatatacagaagatccagcaaaaaccccttgaatgattggttaggaaaagtaaaaagcttcatagtcacaacagacttagacgcggacggtaaccctaaaaaagataaagatgggaacataaagagatcattcagagcaccatcagaaggcgattggacactgataaaaaaacgaaccgagtcattattagaaaactcaggacaaaccgttggccaattcatatacaaccatatattggaagaacccagcgcaaaaataagagggaatttcataagaacaatagaacggaaatactataaagatgagctcaaggccatacttgaaaaacaaaaagagttccaccacgaactatcatcggaatcgctgctcactgaatgcgcaaaagaattatacaaacgaaatatagcccaccaagaagtattactaaaaaaaggaatgatacatttactattaaatgatattttattttaccaacgtccactaaaaatcaaaaaatctttaatagataactgcccttacgagaattacaaatacgtagataaaaagtcaggtgatataaaagtaaagagcataaaatgcatagcgaaatcaaacccattctttcaggaattcagactatggcaatttgttagcaaccttagattatataggaaaagcgatgacaaggacgtcacttcggaacatcttgtgacgacagatgattacgcgaatctatttacatacttaaacaacagaaaagacataaaacaatcagtactcttaaaagaatacttcaaaataaaaaaagtcaaaaccataaacggcgctgagtatccagtcagatggaactacatcgacgatgataataagacctacccatgcaacgaaaccagatacgatatactacacgcactatctaaaactgaactaaaatcggaatggttaacccccgaaagaacatacagattatggcatttattatactctatagagagcaaggaagaaactaaaaaagctttgaacaaattaaatctatcagatgactttactgaagcctttctaacaattaaaccttttaaaaaagaatatggttcatactccgaaaaagcaataaaaaaactgctcagcttaatgcgaatgggctatctatggtccgaagacgaagccattaaacaagtaggtgccgaaatagaaaagacaatagaaggtgagctgcccgactatgtgctgcaacgattagagaaatcacaacacaattataataagatcagtgatttttcggggttaccgctatggcttgcatcctacataatatatggaagacacagtgaagccaaagaaatcattcattgggacaatccagaaagtatgatggcgtacataaaggactttagacaacacagtatgagaaatccaatagttgaacaatgtgttctagaaaccctaagaacagtacatgacatatggaaagaaatcggacacattgacgaaatacatatcgaattaggcagagaaatgaaaagcacgagtgagcaaagaaaagctataacacaaaacgtattacataaccaaaacaccaacatacggattaaactacttctccaagaattaaaaaacgacaataacataacaggagtacgaccctatagtcccatgcaacaagaaatcttgaggatatacgaagagggagccctacaagggttaacaaaagaagataaagactacaatgatatcctaaaaatttcacaaacagctcaaccaaccagcaacgaattgacacgatacaaattgtggttagaacaaaaatatcgttccccatatacgggaaaagcgatttccttaagcaaactatttacttctgcgtaccaaatcgaacatgttataccacaaagtcggtatttcgatgactcattgagcaacaaagtcatatgtgaaagtgaagtaaacacactcaaaaaggctatgttgggtatggaatttataaaaacctgtggaggacagaaagtacactgcacactcctcggtgacgtagaaatctataatgaagaagactacaaagcttttgtaaatgaacactatagcaacaaccgaaccaaacgaaataaattactaatggaagacattccacaagaatttataaataggcaattaaatgatagccgctatataagtaaaatggtaaaacagttattatcggctatagtaagaggtcaggaagaagtcgaagcaacctcaaaattcgtaataccatgcacggggggcataacagatagactcaaaaaagattggggtctaaacgatatatggaacaacctagtaagccctagatttcaaagaatgaacgcactaacagggagtgaatatttcggccactgggagaacaaagaaggtaaacgggtcttccaaacaacaatgcccatacaattacaacaaggattcagtaaaaaaagaatagaccacagacaccacgcaatggatgcacttgtaatagcatgtgcaagtcgtaatatcatatcatatctaaacaacgaaacggcgcaagatacggaaagaagacgagatttgcgacaaaaactatgcgacaaaggaggaagtgttagaaaaccctgggattcatttacacaagatacacaatacgcattaaaggatatcatcgttacatttaagaattatgtacgaataataaacaaagccacaaactactacgaacactataaaactgacggaaaaaaaggaatgataagccagaaaggcgatgagctatgggcaattagaaaaccaatgcacaaagaaacagtattcggtaaagtaaacctgaggagaccaaaaagggttagtctaagtaaagccattgatagtgttgacgtcatctgcaatagaaaattgaagaaatacataaaagcaagattaaacgaaggacttcaaaaaaaacaaatattaaatatattcaaagaactcaacaacgtgtgggaaggcatagacgtgaataaaatagacatatgggaaatgagtaatgacaaagaaccaatggtagcaacaaggaaacaacttgatacatcttttgatgagaaaaaaataagaagcatatctgatacggggatccaaaaaatattattaaactacctaattactaagaacaataatccagaactagcctttacaccagaaggaattcaagaaatgaatagtaatatcagtgaatacaacgatcataaagaacatcagcctatttataaggtaagagtaacagaaccactaggagcaaaataccctattggaacaatgggaaataaaccaaaaaaattcgtagaagcacaagcaggaaccaacctgtatttcgcaatttacgaagacaaggagggcaacagaaactacgacaccatacctctcaatattgcagcagaaagattaaatcaacaactaagtccggtccctgaaacgaacgaaaacaacaccccattaaaattttacctcagtccaaacgatcttgtatacgtaccatcagaagaagaaagacatagtgggaataatatccaattagacaaaaaccgaatctataaaatggtcagcagcacttcaaaacaatgctttttcatacaccacagagtagccatatcgttagtagataaaaaagaattcagcgcccaaaacaaaatggaacgatctatagataatgaacaagttatgatcaagtctgtatgttggaagttaataaccgatagactcggtaacataatcaaagtaataaagtga

SEQ ID NO: 5725 - RNA, 4461 nt, synthetic construct
  misc_feature 1..4461: note = Cas9 variant
  source 1..4461: mol_type = other RNA
atgacaaaaattttaggattagacttgggaaccaacagcataggatgggcaatcagagaagacgaaaatgaaggcgtaaatcaaatcatagacaaaggagtacgtatattctcagaaggggtgaaatcagaaaatggaaaagaaataagcagagctgccgaacgcacggcttatagatcggccagaaaaatcaaatatagacgcaaactacgaaaatatgaaaccctaaaagtgctatcagtaaatggaatgtgtccactaagcgtggaagaagtagaacaatggaagaaaagcgggttcaaagaatacccactaaacccggaatttctaaattggctaagaacaaatgaagacaaaaatatcaatccttacttctttagagataaagcatccaaacaaaaagtaacactgtttgaacttgggagagccctatatcacatagcacaacgacgaggattcctaagcaatcgcttagatcaaagcgcagaaggggttttcgaagaacacaatcctcaaattcaaaatttaatagaagatctagactcaagcaacacgatactcaacgaactaaaagaatattatataaatctgggaataatagatgaatcagaaaaatctggattcaagaaagatcttgacgagggagagaaaaatctcaagaaattgtatacgagcttagtgtcgataaccaagaaaaatgcaaatgacatagaaacctgcaaacaagaattaattgccaggctaaacaagaaagaagacctaggtaaagttaaaggagagatcaaagatatctctcaagcaatgctcgacggcaacttcaaaacgctaggacaatactttttcagtttatataacaaaacccgaatacgtaatcaatataccagccgagaagaacactacctcgaagaatttataataatctgtcaaacacaagggatcgaagaaataaatacaaatgaaaaattaccagagaagaaattcaccggtttagcaaaagacctttatcgagccatattcttccaaagaccattgaaaagccaaaaaggactaataggaaaatgttcatttgagaaaaataaaagtaggtgcgcagtatcacacccagattatgaagaatttcgtatgtggtcatacctaaacaccataaaaataggaacccaaagtgagaaaacactacgatttttgacactggaagaaaaactaaaacttgtcccaaaattctatcgcaaaaacgattttaacttcgaagttctagcaaaggaattagtagaaaaaggagcaagtttcggatattataaatcgtccaagaaaaacgaatttttctactggtttaattacaaaccaacagattcagtatccgcatgtgttgtaagtgccagcctagaaaatgcaataggtaaagactggaaaactaaaacatttgaatatcaaacatcaaatacaaagaaagaagaggtaaccaaatctgtaaattacaaagacttatggcatttactatcagtagctacatcggatacatacctctacgactttgcgatagaaaaacttaaattagaacccaaaaacgcaaaagccttctccaaaaccaaattaaagaaagattttgcaagcctaagtttagccgcaatagcaaaaatcttaccatacttaaaacaaggactgctatattcacatgccgtattcatcgccaatattgagaacatagtggacgctgatatatggaaagacaaagaacaacaaaaatttatacaatccaaaatagtagacctcattgacaattacctcgtagaaaaatcaaaattagaaataataaactgcctactcaaaatatataatacagaagatatcgagggccgcaaagtttattattcaaaagaggccgaatctttattcgaagcagacttacgtaagaaactcgtcccgttctataaagcaaacacaataagcgaacagcaagaacaagaaatcatattcaaagacctatttccagtcttaatagaacaattgaagaaacaagagttcataaaaattgttcgtttagacaagaaaatagaagccttcctgaaaggagaaaacgaagaaggacaaatattttgtaattatccagaaaaatttaagaaactataccatccttcagacatagaagtgtttaaaaagaaaataataaaagatgaatggggcaatgaaaaagtagtcctcggttcacctttaactacttccatcaaaaatcctatggctatgagagccttacaccaactacgcaaagttttaaatacactaatattagacggacaaatagacgagaaaacaaggatccacatagaaatggctagggaattaaacgatgcaaataaacgtaaaggtatacaagatttccaaaaagaaagagaagaactgtataaaatatatgaagcaaaaattaaagaactttaccaagtcaaaactgggaaagaactactacacgttactgatgaagacttacaaaaattcgaatgggcgctcgaacaaacaaaggacggtagaataattactaaagaagagttaataaaatacaaaatatgggaagaacaaaaccacatctgcatatatacaggtaaaacaataagtatagactcatttctcggcggaaacccgaaattcgatatcgaacatacaataccgagatcaatctcccaagacaacagcttaatgaataaaaccctctgtgacaaagactttaaccggtcagtgaaagggaagaaaatgccggtagaacttagtaactacaacgaaatcctcccaagaatagcccactggaagaaacaagcagaagaactaacacgacaaatcgaaactatatcgcgcagcatcaaaagcgcagcaacaaaagtcgccaaagataaaaacataagaaagagacactatctaacactaaagagagactacattcaaggaaaatacgaccgctttacctggggagaaccaaaagttggatttaaaaattctcaaataccagacaccggcattatcactaaatatgcacaagcatacttaaaatcctatttcaaaagagttgaatcagtcaaaggaggagcagttgccgaatttcgaaaattatggggtatacaagaatcattcatagatgaaaatggcttcaaacacttcaaagaaaaagataggtcaaaacatacacaccacacaatcgacgcaataactattgcatgcatgccaaaggacaaatacgatctgctcgcacacgcatggcgtttagaagatgaacaaaataaaaaggcagccaaagctctcattgaacaggcaaaaccgtggaaaaccttcaaagaggatatagagaaaatagaagcggaaattcttgtaagccacttcacaccagataatgtcaagaaacaagccaagaaaattctacgggtacgaggcaagaaacaatacgttgcagagatagaacgcaacgctaacgggaaagcaatccccaagaaagatgcctccggtaaaataatatataaattaaatgagagaggcaataaaatacctatattacaacaaggagatacaattcgaggatccttgcatcaagactccatttacggagccattaaaaatccactaaatactaacgaaataagatacgtcataagaaaagacctagaaagcctcaaggccaatgatatcgaaaacattgtcgacgagaatgtcaaagcaaaagtaaaagaagctgtagcaaacaaaatactacttatttcttcgaaccctcaacagaaaaacaaattcgccgagggtaagaatgtatggatgaatgaagagaagaaaataccaataaataaagtcagaatatacgccaattccgtcaaaaacccaattgagatcaagaaacattcaacgttatcaaaaagtaaacatgaacataagcaaactgtatacgggcaaaacgacgaaaattatgcaatggctctttacgaattagacggaaaacgagaatttgaattaataaacaatttcaacttggctaaactactcaaacaaggacaaggttactaccccttgcataaagaaaaagaaataaaaggtaagaaagttcttattcccatagaaaaacggaacaacagagacgtagtacttaaaagaggacaacaagtagtcttctatgacaaaacagtagaaaattcgaaagacataagtgaaatagtcgacttccgaggaagagtataccttatagaaggtttaaccatacaaaggcagaaggataagaaaacaggaaaagttaatgaatatggaatcatacaactccgttatttcaaagaagctagaaagtcagaagaaataagcaaagattcatttaaacctgacggagagttcaaaataaacgaaaacaaaccgacaagaaaaatgaaccataatcaatttacagcgttcgttgaaggaattgatttcaaagtactaccaagtggcaaattccagaaaatatga

SEQ ID NO: 5726 - RNA, 4464 nt, synthetic construct
  misc_feature 1..4464: note = Cas9 variant
  source 1..4464: mol_type = other RNA
atgaaaaacgtgctaggacttgacttaggttcaaatagcgttggttgggcgctcgttaaaacggaagataacggtaatcctatagggtccataaaaatgggatcccgtattatacctatgtcacaggatatactcggaagttttgaaaaaggagacacagtatcacaaactgctcaacgaacactatacagaggcaaaagacgcttaattgaacgacatgtcctccgaagggaaagactttgcagagtactacatattatgaactttctaccagatcacttcgacaaattactaggttgggacaaaacggacaataaaacttatggaaaatttatagatgatagcgaacccaaattagcatggcgccaaaataagaatgagaaagagaaaatggaatttgtctttatggatagttttcatgaaatgctcagcgacttcgcgaaacaccaaccgcaactcatagccaatggcaagaaagtacccttagattggactatctactacttacgaaagaaagccctaacccagttgatttcaaaagaagaactagcctggattttgctaaattttaacaagaaacgaggatattaccagttgcgcggagaggaagaagaggaacaaccaaccaagaaagaagaatacaaagtgctcaaagtgattagcgtagatgcggatgaaggccaaaaaggaaacggcatatggtacaatatacacctagaggatggtggaatttacaaacgaaaaagtgacactccattatatgactgggtaggaaaaacactacaactaattgtcgtaacgatatacgaaaaagacggaaaaacacctaaaatttttgactcaggtaagcaaaatccatcctacagactcccaaaagaagacgattgggggctaataaagaaaagaacggaatcgcaaatacaatcctcaggaaaaactgtaggggcgtttatatatgacaatattctaagcaaaccggacgacaaaatacgaggaaatttagtaagaacaatcgaaagaaaatactacaaaaaggaacttatagaaattttacaacaacaagcaaagtaccatgacgaactacacaaccaaaatttactggaatcgtgtgcgaaagaattgtacgcacataacgacgtaagatataacgaagtagtcaaaagtaacatgatccacctcttagttgacgatataatattttaccaaagaccattaaaaagtaagaaatctcttatagctaattgcaaatatgaaagttatgaatacgtagataaagaaacaggagaagtaaaagaaatgccaatcaaatgcatagcaaaaagcaacccttactatcaagagttcagactctggcaattcatacacaaccttagactatctgacgtagtaacaagagaagatgtaactgcgcaatacctatcaactccccaagactactgtaacttatttacatacttaaatgatagaaaagaaattaaacaagacatactactcaaagactttttcaaaataaagaaagtgcaaattgacaaagaaaaagtattcccgatagaatggaattacataaaagacgctacgaaaacatacccatgcaatgaaacacgatatgaactactgtccgctctgaaaagagcaggcatggacaagcaatggctggatgacacacctaacatgcaatacagactatggcacctactatactcagtcgaagaacaagaagaaagcgcgaaggctttaagaaaactatacgacaatgacaacttcgtatcgtcattccttaaaataaaaccctttaagaaatgttacggcgcatatagcgaaaaagctattaaacggctcttaacattaatgagaatgggcaaagcatgggacgagcaagctatagatgctaaaacgctcaaatgtatacaacaaataataacaggaaatatcgactcaaaattaaaagagaaaattgatgacagtagatatgtattacatcacgtatcagattttcaaggtcttccaacatatcttgctagttacgtaatttacggccgacactcagaagtaaccgacataagatgttgggatacaccgaaagacctactcaaatttatatgtggctttccacaacatagtttacgaaacccaatagtagaacaggttatacttgaaacattaagagtagtctacgatatatggaaagcggaaaaacacatagacgagattcatgttgaagttgcaagagagatgaaacttacagcacaacaaagaaatgaagcaaatctcaggaatctaaataacgaagcaacaaacctaagaataaaatatctattagaagaacttaaaaacgatacatttataaaagacgtaaggccattaagcccgatgcaccaagaaaagatgagaatttatgaacaagccgtactcggaaatttaaataaacaagacaaggactatgacgacataatcaaaataagtaagaaagaacgaccaacatcagctgaacttataagatataaactttggctagaacagaaatattgctcaccatataccggtaaagcaattagcctaagtaaattatttactacagcttaccaaatcgaacatgtcattccacagtcgagatattttgataatagctttaataataaagtaatttgtgaatcagaagttaataaagagaaagataaaatgctggggtacgaatttataaaaggtcgcggaggagacagaatatactgtaccgcacacggaaaagaagttacaatactaaaagaagaagagtataaacaattcgtaaacgaacactatgcacataataaaagaaaaagagacaacctacttgcagaaaatatacccgaatccttctcatcgagacagttaaatgacacccgttacattacaaaaacaataatgtcattactaagtaatgtagtccgacaacaaggcgaggaagaagcaacagccaagaatttattaccgagttcaggagcagtcacagacaagttaaagaacgactggggattaaaagacgtatggaacacaatagtgacaccacgtttcgaaaggctaaacaaactaagtgggacaaacgactttggagaaatgaaagaagagaacggcaaccgatactttcaaactaacgtacctagcgaatacgaaaaaggcttcaaaaagaaaaggatagaccacagacatcatgcaatggatgcactggtgatcgcatgtacaactaggaacatggtaaactatatctctaatgttaatgctaatagccctaaacagcgagaagatttgaggcaactgctatgtgataaaaataggataataaataaaccctggaacacattcacccaagatgcactaaaagcattaaatgatatagttgtgtcctttaaaaacaacgttcgaataataaatcgggccacaaaccgctaccaacgatacgataaaaatggaaagaaaatgatttgttcacaaaaaggtaatgatatgtgggcaatccgaaaatctatgcataaagagaccgttttcggacgagtcaaccttattaggaaagaagcactacctatcgcaaaagcattagataatatatctgccatatgcaatgctcaactccgcgcatacgtaaacgacctggtagacaagcactttaataaaaagcagttagttgcccatttcaaatcattagattacaaatggaacagacaagacgtaagcaaagtcgaagtatggataagttcagacgacaagacacctatggtagctgtaagaaaacccctagatacatctttcgataagaagaaaatagcttctataacagatacaggaatacaagcaatactactaaactaccttgaaagcaaaggaggagacgccctcgtggcatttgccccagaagggattcaagaaatgaactcaaatatagagctatataataatggaaaagcacacaagccaattaaaaatgttcgactaagtgaaactttaggagcaaagtaccaagtcggtgaaagaggtgcgaaaaccaagaaatacgtggtcgctgacaaaggcactaatctcttcttcgcaatatacgaagatgaagaaggaaaaaggtactattacagtgtacctctaagagaagcgatagaaagacaaaaacaaaaattatcacctgtaccagaatataatgaaaaaggagtggcactaaaattctatctaagcccgaacgacctagtatacgtaccgaccgaggaagaacgcacgatgggaacatgtcatatcgataagactagaatttacaaaatggtgtctagctcggaaaatcgttgctgttttgtaccgagcactatagcaaaagtaatagcagataaagtagaactcctttcacataacaaaatcgaaaaagcaatcacaggcgaatctataaaggaagtttgttggaaattgaaagtagatagactcggaaacatccttaacgtaataaaatga

SEQ ID NO: 5727 - RNA, 4464 nt, synthetic construct
  misc_feature 1..4464: note = Cas9 variant
  source 1..4464: mol_type = other RNA
atgaaaaacgtactaggactagacctaggaagcaactctgtaggatgggcactggtcaaaacagaggataatggaaaccctataggatcaataaaaatgggttcaagaataatcccaatgtctcaagacatattgggatcgtttgagaagggtgatactgtttcacaaacagcccaaagaacattatatcgaggtaaaagaagactaaccgaacgacatgtcttaagaagggaaagactctgccgagtgctacatattatgaatttcctaccagaccattttgataaactgcttggatgggacaaaaccgacaataaaacatatggaaaattcatagacgattcagaaccaaaactggcatggagacaaaacaagaacgaaaaagagaaaatggaatttgttttcatggactcatttcacgaaatgttatcagactttgcgaaacatcaaccacaacttatagcaaatggaaagaaagttccattagactggaccatatattatctaagaaagaaagctctcacacagttaatttccaaagaagaactagcctggatactacttaatttcaacaagaaacgtggatattaccaattaagaggtgaagaagaagaagaacaacccactaagaaagaagaatataaagtcctcaaagtaattagcgtagatgctgacgaaggccaaaaagggaacggtatatggtacaacatccatttagaagacggaggaatatataaaagaaaatccgatatcccactatatgactgggtcggcaaaactttacaactaattgttgtaacaatatatgaaaaagatgggaaaactcctaaaatctttgatagcggcaaacaaaatccatcataccgccttcctaaagaggatgattggggactaataaagaaacgcacagaatcacaaatccaatcctctggtaaaaccgttggggcttttatctatgacaacatactatctaaaccagctgacaaaataagagggaatctcgtaaggacgattgaaagaaaatattacaagaaagaactaatagaaatattacagcaacaagctaaataccatgacgaactacacaaccaacacttactagagtcatgtgcaaaagagctatatgctcataacgacgtacgctacaacgaagtagtcaaaagcaatatgatacacctcctagtagacgacataatcttttatcagaggcctcttaaatcaaagaaaagccttatcgataactgcaaatatgaatcatacgaatacgttgacaaagaaacgggagaggtaaaagaaatgcccattaaatgtattgcaaaatctaatccatactaccaagaatttcggttatggcaatttattcacaatctaagattatcagacgttgtaacaagagaagatgtcaccgcgcaatatttatcaactccacaagactattgtaatctttttacatatctaaatgaccgtaaagaaatcaaacaggatatcctactaaaagacttctttcaaattaagaaagttcaaattgacaaagaaaaagtatttccaatagaatggaattacataaaagacgccaccaaaacatacccgtgcaacgaaacaaaatatgagctattatctgcattaaaaagagcgggaatggacaaacaatggctggacgacactccgaacatgcaatacaggttatggcaccttctatacagcgtagaagaaaaggaagaaagtgcaaaggccctaagaaaactctacgatgatgacaatttcgtttctagctttctcaagataaaaccctttgaaaaatgctatggagcctactcagaaaaagccattaaaagattattaacacttatgcgaatgggaaaagcatgggatgagcaagcaatagacgcgaaaacactgaaatgtatccagcaaataataactggaaacattgatagtaaattaaaagagaaaatagacgattcgagatatgtcctccatcacgtaagcgattttcaaggattacctacatacctagcaagttacgtaatatatggaaggcatagcgaagtgaccgacataagatgttgggatacccccaaagacctactaaagtttatttgtgggtttccacaacattctttacgaaacccaatagtagaacaagtcatattggaaacattaagagtcgtatatgacatatggaaagcggagaaacacatagatgagattcatgtagaagtagcacgagagatgaaactaaccgcgcaacaacgtaacgaggccaacctacgcaacttaaataacgaggccacaaacctacgaataaaatacttacttgaagaacttaaaaatgacacatttataaaagacgtccgaccgttaagtccaatgcatcaggagaagatgcgaatatacgaacaggcagtacttggcaatttaaacaaacaagacaaagattacgatgatataatcaaaatatcaaagaaagaacgacccacatcagctgaacttattagatacaaattatggttagaacaaaaatactgttcaccctataccggcaaagcaatcagcttatccaaattatttacaaccgcctatcaaatagaacacgtcataccgcaatcaaggtattttgacaactcatttaacaacaaagtgatatgcgaatcagaggttaataaagaaaaagataaaatgctcggatacgaatttataaaaggaaggggcggagatcgtatatattgcacagcccatggtaaagaagtaactatattaaaagaggaagaatacaaacagtttgtaaatgaacattacgcacacaataagcgtaagagagacaacctattagcagaaaacataccagaatcattcagtagtcgtcaattgaacgacacaagatatataacaaaaactataatgagcttacttagtaacgtagttagacagcaaggagaagaagaagcaactgctaaaaacttactaccctcatccggagcagtcacagataaactcaaaaatgattggggtctaaaagatgtatggaatactatagtaacacccagattcgaaagactaaacaagctatcaggcacgaatgactttggtgaaatgaaagaagaaaatggaaatagatatttccaaactaacgttccaagtgaatatgaaaagggtttcaaaaagaaacgtatagatcatcgtcaccatgcaatggacgcacttgttatagcatgtacaaccagaaacatggtaaactatatatccaacgtaaatgccaattctccaaaacaaagagaggacctaagacaactcctatgtgacaaaaaccgcataatcaataaaccctggaacacattcacacaagatgccctaaaagcattaaatgatatagtggtgagcttcaaaaataatgtaagaatcattaatcgcgcaaccaaccggtatcaaagatatgataaaaatggcaagaaaatgatatgttcacaaaaaggtaatgatatgtgggccatacgaaaaagcatgcataaagaaaccgtattcggaagagtaaacctgattcgaaaagaagctctaccaattgcaaaagcactagacaacatctcagcaatctgcaatgcacaactacgcgcatatgtcaacgacctagtagataaacacttcaataagaaacagctagttgcccatttcaaatccctagattacaaatggaatcgacaagacgttagcaaagtagaagtatggatatcatcggatgataaaacacccatggtagcagttagaaaaccgttagatacatcgtttgacaaaaagaaaatcgcctccattaccgatacaggaatccaagccattctactaaattatttagaaagcaaaggaggcgacgctctagtagcattcgcaccagaaggaatacaagaaatgaactcaaatatagaactctataataatggtaaagctcacaaacctatcaaaaacgtccgattatcagaaacattgggggcaaaatatcaagtcggtgaaagaggggctaaaactaagaaatatgtggtagcagacaaaggtacaaatctcttcttcgcaatatacgaagatgaggaaggaaaaaggtactactactcagttccattacgcgaagccatagaaagacaaaaacaaaaattaagcccagttcctgaatacaacgaaaagggtgtagcacttaaattctatttaagtccaaatgatctagtctatgttccaactgaagaggaaagaacaatgggaacgtgccatatagacaagacacgaatatacaaaatggttagcagctcagaaaacagatgctgtttcgtacctagtacaatagctaaagtaattgcagataaggtagaactactttcacataataaaatagaaaaagctatcaccggggaaagtattaaagaagtatgttggaaattaaaagttgacagactcgggaacatcttaaacgtaataaaatga

SEQ ID NO: 5728 - RNA, 4464 nt, synthetic construct
  misc_feature 1..4464: note = Cas9 variant
  source 1..4464: mol_type = other RNA
atgaaaaacatattaggactcgacttaggatccaatagtgtaggctgggcattagtaaaagtggaagaaaatgggaacccaatagggagcataaaaatgggatcaaggataataccaatgagtcaagatattctaggctcgtttgaaaaaggcgatacagtttcacaaactgcacaaagaactttatatagaggaaaaagacgacttatagaaaggcacgtgttaagacgcgaaagactatgtagggtattacatataatgaacttcttacccgcccatttcgacagattgctgggatgggataagaccgataacaaaacctatggaaaattcatagacgactcagaacctaaattagcttggagacaaaacaaaaacgaaatgggcaagatggagtttgtatttatggattcatttcacgaaatgttatcagacttcgccaaacatcaacctcaactaatagcgaacggaaaaaaagtgccactagactggacgatatactatctacgtaaaaaagcattgacgcagctcatttcaaaggaagagttagcatggattttactaaacttcaataaaaaaagaggttattatcaattaagaggagaagaggaagaagaacagccaactaagaaagaagaatataaagttttaaaagttatatccgtagatgccgatgaaggacaaaaaggtaacggaatctggtacaatatacatcttgaagatggaggtatttataaaaaaaaaagtgacataccgctgtatgattgggtgggaaaaaccttacaactaatagtagttaccacatacgaaaaagacggtaaaacacccaaaatttttgattccggcaaacagaaccccagttacagattaccaaaagaagatgactggggactcgtaaaaaaaagaacagaatcgcaattacaatcgtcgggaaaaacagtcggagcattcatatatgacaacatactatcaaaacccgacgataaaattagaggaaatcttgtacgaaccatagaaagaaaatactacaaaaaagaactgatcgaaatactacaacaacaggcaaaatatcacgatgaattacacaatcaaaacttactggaaagctgtgcaaaagaactatatgcacacaacgacgtacactacaacgaagtaatcaaaagcaacatgataaatctactggtaaatgacataatattctatcaaagacccttaaaaagcaaaaaatctcttattgcaaactgcaagtatgaatcctatgagtacgtagacaaagaaacaggggaaataaaagaaatgccaatcaagtgcatagcgaagagcaatccttattaccaagaatttagactatggcagttcatacacaacctaaggttgtccgatgttgtaactcgcgaagatgtaaccgcgcaatatttatcaacacctcaagactattgcaacctatttacatatctgaacgataggaaagaaataaaacaagatatcttattaaaagactttttcaaaatcaagaaagtacagatcgacaaagaaaaggtcttccccatcgaatggaattatataaaagatgcaactaaatcgtacccatgcaatgaaacaagatatgagcttctaagcgcacttaagagagcaggaatggataaacaatggttagatgacactccaaacatgcaatatagactttggcatcttctatacagcgtagaggaaaaagaggagtctgcaaaagctctaagaaaattatacgatgatgacaagtttgttacatcctttctaaaaatcaaaccatttaacaaatgttacggggcctactccgaaaaggcaatcaaacgtcttctaacactaatgcgaatgggaaaagcttggaatgaacaggctattgacgccaaaaccctaaagtgtatacaacaaattatcacagacaacgtagacagtaaattaaaagaaaaaatagacgatagtcgatacgtattacaccatgtctcagattttcaaggactaccaacttacttagcatcatacgttatctatgggaggcattccgaggtcaccgacatccaatgctgggacagtcctgaggacctactaaaatttatacgagactttaaacaacattcattacggaatccaatagtagaacaagtcattttagaaacacttagggttgtgtatgacatatggaaggcagaaaaacacatcgacgaaatccacgtagaagttgctagagaaatgaaattaacagctcaacaaagaaatgaagcaaatcttagaaatctgaacaatgaagccactaatctacgaatcaaatacctactagaagaattaaaaaacgatacatttataaaagatgtcaggcctctaagtcccatccaccaagaaaagatgcgaatatatgaacaagcggtcctcggaaacttaaataaacaagacaaagattacgacgatataataaaaatatcaaaaaaagagcatccaaccaacgcggaactaattagatataaactgtggttggaacaaagatattgcagtccatacacgggaaaagcaatttctttaagtaaattatttacaaccgcctatgaaatagaacacattattccacaatcaaggtactttgataactcattcaataataaagtgatatgcgaagctgaagtcaataaagcaaaaggaaatatgctgggatacgaattcataaaaaaacaaggaggacaaaagatatactgtacacaactaggtaaagcagtcacaatattgaaggaagaagcatataaacaattcgtaaatgaacattacgcacacaataaaagaaaaagagacaaccttctagccgaaaatataccagaatcatttagttctcgacaattaaacgacacgagatacatcaccaaaacaatcatgtccttattgtccaatgtggtacgccaacaaagtgaagaggaagcaactgcaaaaaacttactcccgagttcaggaagcgtcacggataggctcaaaaacgactggggcttaaaagacgtttggaacaccatagtaacacccaggttcgaaagacttaacaaactaagtggaaccaatgacttcggagaaatgaaagaagaaaatgggaacagatatttccagacaaatgtaccactggaatatgagaagggcttcaaaaaaaaacgcatagaccatagacaccatgcaatggacgctttggtaatagcatgtacaaccagaaacatggtaaattatatatcaaacgcaaacgccaactcacccaagcaaagagaagacttaagacagctattgtgcgataaaaatagaataatcaacaaaccctgggacacatttacgcaggacgcactaaaagcactaaacgatattgtagtaagtttcaaaaataacgtacgtattataaaccgagcaactaacagataccaaagatacgataaaaatggcaagaaaattatattcagtcaaaaaggagacgacatgtgggctattagaaaaagcatgcataaagaaacagtctttgggcgtgtaaatctaatacgaaaagaagtactaccaatagcaaaagcgctagataacatctcagccatttgcaatgcacaactaagagcatacgtcaatgacttagttgacaaacactttaataaaaagcaattggtagcacacttcaagtccttaaattacaaatggaatcgacaagacgttagcaaagtagaagtctggattagttcagataataaaacacccatggtagcagttcgaaaaccactcgatacaagcttcgacaaaaaaaaaatagcatccattactgacaccggcatacaaaccatactacttaactacttagaaagcaaaggaggagatgctagtgtagcattcgcaccagaaggaatacaagaaatgaattctaacatagaattatacaacaatggcaaagctcataaaccaataaaaaacgtcagattgtcagaacccctaggcgcaaaataccaggttggagaacgcggggcaaaaacaaagaaatacgtggaagcagataagggaactaacttattctttgctatctatgaagacgaggaaggcaaaagatattattacagcgtacccttacgtgaagcaatagaacgacaaaaacaaaaattgagtccagttccagaatacaacgaaaaaggcgttgcattaaaattttacctcagcccaaacgatttagtctacgtccctacggaagaggaacgtacaatgggcacttgccatatcgacaaagctagaatttataaaatggtaagctcaacaggttgcagctgctactttgtaccaagtacattcgcaaaagtgatagtagacaaagtagaactccaaagtttaaacaaaatggaaaaagcaattactgatgaatgtatcaaagaagtatgctggaaactaaaagtcgacagactaggcaatataataaacgttataaaatga

SEQ ID NO: 5729 - RNA, 4485 nt, synthetic construct
  misc_feature 1..4485: note = Cas9 variant
  source 1..4485: mol_type = other RNA
atgaaaaacatcctcggattagatctcggaaccaacagcattggctgggctctcatagataacgaaagtcatagaataataaaatcaggcagcaggataatcccgatggatgccgccacaatgggagattatgaaaaaggtaacttaaaatcggccgattggaagagaacgagctttcgcggcatgcgaagactatacgaaagagccaaattaagaagagaacgattattgcgggtattaaacattttgggatttttacctgaagagttcagaagacagatagacttcgaacaccatccaggacaatttatcgacggaaaagaaccattaatagcgtaccaccatgacgaaaatggacagagagtattctcatacatgtcagcttttgaagagatgctaacagatttcagagctactcagtcagagctagttagagatggcaggcgagtaccatatgattggacgatttactacctacgtcataaagccctaactcaaccagtaaccaaggaagaactagcctggatcatactgaatttcaatacaaaaaggggttattatcaacttagatctgaatctgaagaagtcacgactaataaaaacgaagaatacgctgaattaaaagttgtctcagtagagaaaacaggcgaagataagaaaagagctggatactactggtacacaatcacatatgataatgaagcggaacagaaaatcacaagtaccatacccccgcgacaaatcggagataaagttgaattaatagtaacaacagcaagagacaaagcaggagaaataaagaaatcagttcgctcaccaaaagaagacgattggacactaatgaagaaaaggaccgagcacaatatagaagaggaagaatgcactgtagggtcatacatataccaacatatcttagcagacccaacagtaaaagtaagaggaaaactggtacacacgattgaacgaaaattctataagaaagaattgaaacaaatactaaacaaacaaaaagaatttattccagaactacaagacgcatccttatacgaagcatgcataaaagaattatatagaaacaatgaagcgcatatccaatcaatcgcaaacaaggattttacagatctatttgtaaatgacatcatattttatcaaagacctcttaaaagtaagaaatccaccatttcaaactgcccatacgaatcatactattacaaaaataaagaaaccggcgaactaataagaaaacctataaaatgcatcgctaaatcaaatccattataccaagagttccgactatggcaattcgttcacaacctaagaatctataagaaaagtgaagaagtaagtggacgcctgcaaacagatgttgacgtaacagaccgatttttgacaacgccagacgattatgctaaactattttcttggctcaacgatagaaaagaaattaaacagaaagaattacttagatatgaagcctttggcttaagcaaaagttatggagattatagatggaacttcgtagaagataaaccttatccctgcaacgaaacacttcatgaaataaatcgcagaatgaaatcgatattatcagacaagaaactatcatcagaagcctaccaacagttatggcatatattatattccattgacgaccctattgaaatacgcaaagcgctcacaagtttcgcacaaaatcaagaaataaacagcgacgactttgtaaacgccttctatcagtatgtacctgagaaaactaaaagctacggagcatatagtgaaaaagctataaagaaactactacccctaatgaggagggggtcctactgggccatagggaatattgatgagaaaactcaccgacgactagataacatcataaacggggtagcagatgactcgatatcaacatgtaccagagaaaaattaaacaatctaactgatataactatgtgccaaggaatgccattatggcaagcatgctacgcagtatatgacagacactcggaagcagccgataccaccaaatgggaacaacctgacgacatagacacttatctaagcaccgaactcaaacaacattcactaagaaacccaattgtcgaaacagtaattagcgaaacattaagagtagtacgcgacatttggaaagcgtacggacggccagaagagatacacgttgaattaggtagaaacctaaaacaagacgccaaatcacgaaaacaagatgcaatcaggatggcggaaaatgagcaaaccaatctaagaataagggcattactgcaagagctctcgaatcccgaatgtggtgtagagaacgtcagaccccattctcccagtcaaatggaactattaaaaatctatgagaatgaagtattacaaagcactgatgacatacctgaagaaataagtaacataataaaagatctaggaaagacagattccaaaaagagaccatccctaagtgacatcaccaaataccgcctatggttagagcaaaaataccaatccccttacacaggacacataatacctctatccaagttatttactccggcataccaaatagaacacgtaataccacaaagtcgctactttgacgattccatatccaataaagttatatgtgaagcagaagtaaacaaagagaaagacagaatgctcggttatgagttcattataaataaaggtggaagcattgtcaaaggatcattcggtcaacaattcaaaatattcgataaagtacaatatgaagacttcgtaaaacaaagatatgcacataacaaaacaaaaatgaagaaacttctaatggacgacatcccggatggattcatccaaagacagttaaacgactccaggtacatgtcaaagaaaatcatctcaatattatccaatatcgtaagagaagacggagaaaaagaagcgacttctaaacacataatagtaacatccggagcaattactgacagattgaagaaagaatggggtataaaagatgtatggaacgacataattgccccaaggttcaaacgactaaataaactaaccgactcaaacaactacggcatggaaactgaaaaagaaggacgacagtattttcaaattaacgtaccaactgaattatctacaggactcattaaaaagcgaatagaccatagacaccatgcaatggacgcgatcataatagcatgcacgacaagaaatcacgtaaacttcttaaataactcgacggccgctagtgatcaaaaagatatacgtcgagaccttcaacataccctatgtacaaaaacaaaaactgattctaacgggaattatgtttggcgatttaataaaccctgggatacattcactcaagacacgagacaagaactcgaaggcataatagtatctttcaaacagaacttaagaataattaacaaaatgtcaaattactaccaacactatgtggacgggcggaaaaccatatcacgacaaaataaaggggatgggtgggctatacgaaaaagccttcacaaagctaccgtttcaggaaaagtgaatttaaaaagaagcaaaacagttggattcaaggaagcacttaacgactggagtgccataaaagataaaaccagcaaagcaatattacagaaaataattgctcaatataaaaactacgacccaaaaacaattttcaaatattttaaagataggaacttcaaagtcgaaggaaaagacttttcaaaactagaagtatactacaacacgtcagataaagaaccaatgtctgcccaccgagttaatattgacacaacatttgacgaaaaagaaataagatcaatcacagatactggaatccaaaagattatgttaaaacatctacacacttacgatgatgcacaaggaaaaacccaccccgaagcagccttcagcccagaaggtatagagaaaatgaaccaaaacattcgaatgctcaacggaggcaaagaccataaacccatatttaaagtaagaaaagccgaaatcctcggcatgaaattcgcagtcggagaaagaggacacaaggacaagaaatgggttgaagcagacaaaggaacaaatttattctttgctatatacgaatcggaagaaaataaacgaagctactcctccataccactaaatgaagccatcgaccgtttgaaaagaggggaaaatattgcagacgaaagagaccaaaatggaaataaattgttattcgtattatcgccaatggatctagtatatgtgccagatccagacgatgctcatatagacgaagttaaaggcaacaacaacatatttaaaatggtttcatgcacgggtacagaatgctatttcgtacctgaaacatatgcaaatgtaatttgcaaaggaaaagaattagaaagcaaaaacaaagtcgaatcatatgatgggataaatatcaagaaaagttgttataaaataacggtagacagactaggcaaagtaagaaaaatatttaaaggatga

SEQ ID NO: 5730 - RNA, 4491 nt, synthetic construct
  misc_feature 1..4491: note = Cas9 variant
  source 1..4491: mol_type = other RNA
atgaaaacaatattgggactcgatcttggaacaaatagcataggctgggcaaaagtatgcgttgatgataacgggaattatttaagggatataaaattagggtctaggatcatccccatgagccaagatgttctaggaaactttgacaaaggagtcacagaaagtcagacatccgtcaggaccggatttcgcggagtgaggagaatacgagaaagaagtttgctacggagggaacgtctacatcgagtacttcatgtattaggttacttaccaccacattatgatagcgctataggttggaataaaaatgaacctagcacttatggcaagtttctaaaccatggggaacctaaattggcatgggaacacaaagaagacggaagcatgcgatttctattcatggagtcctttcatgaaatgatggcagactttgcaaaaagccaaccatccctagtaagcgatggaaagaaaattcctttagattggaccatttattacttaagaaagaaagcattatcccaacctataagaaaagaagaattagcatggttattattaaatttcaatcaaaaacgtggctactatcaactaagaggcgaagaagacgatgacaatccgacaaaatgtgaagaatattatgaactaaaagtagtaggcatagaggcagacgaagaaggtaaaaatggaaatacatggtacaacgtcaaactcgagaacggatggatctacaggagacaaagcaaaattcccctagatgactggatcgggaaagttagagaatttatagtaacgacagagtatgaaaaagacggaattacattaaagaaagacaaaaatggagacgtaaaaaggagcttcaggtctccttcagaagatgactggggcctaagaaagaaaaggacagagaaattactagacagttccaaaatgacagttggagcctttgtttacgaccatttattagctgagccaagcgataaaataagaggtaaattcattcgtactatagaaagaaaatattacaagaaagaactttacgccatactatgcgaacaaagtaaatatcatgaagaattaagatccggcgactatctaaataaatgtgcagaagaattatataaaaataatcaaccacatagaaattcgctccttaccaaagatttggcgtacttattattggaagatcttatattttaccaaaggcccttgaaaacaaagaaatctttaatagctgaatgcccatatgaggcttataaatatgtggataaagaaacaggtgaaataaaacgtcaagggattaaatgtatagctaaatcaaacccatactatcaagaatttagactatggcaatttattagcaacctacgtttatttaataaagctgatgacaaagaagtcacggccgactatttgccaacacaagacgactacgtgcgattgtttgcttacttaaatgatcgaaaagaaataaatcaagaaactttactgaaagagttctttaaactcaagaaaataacagtcaattcggaaaaagtatttcccattagatggaactatatcgaagacaaagaaaagaaatacccgtgcaacgaaacaagacacgaactacttctagcactagatagagcgagaatagatcactcctggttagaaaaaccaggtcaggaataccggctatggcacctactttacagtgtagaaagcaaagaagaaacaaaagaagcgctaagaaaattaaaagacgacgacgcatttgtggaatcatttctgaaagtaaaaccttttaaaagggaatatggagcctactctgaaaaagccataaagaagctactagcagtaatgagaatgggaagtttatggagagaaactgatatatgtgacacgaccaaaggaaacataacaaaaattctgcaaggtgaaatagacgaaaaattaaaagaaaagattagcgcaagtgtaagcagctacaatcaactaagcgactttcaaggtttgccagtatggctagcttgttatgttgtttatgggcgccattcagaagccgcagaaatacaacattggaaaacaccagagtcattactagcatacatcaatggatttaaacaacacagtctacgaaatccaatagtagaacaatgcatacttgaaacattacgcactgttcacgatatatggaaagaagtaggacatattgatgaaattcacgtcgaattaggaagaaatatgaaatccactgccgaccaaagagcaagaatcagtgaaaacgtgctaagaaatgaaaatacaaacctcagaataaaatcattactacttgaacttaagaatgaccccaatataaaagacgtcagaccatatagccccatgcaacaagaaaaattgagaatttatgaagaaggcgtactccaagaattaacaaaagatgataaagactttacagagattactaaaatatcaacaatggcgcaaccatcagcaaaagagctacaaagatataaattatggctggaacaaaagtatagatcaccatatacaggcaaatcaatatcgttaacaaaattatttacaagcgcgtatcaaatcgaacacgttataccacaaagccgatatttcgatgattcatttagtaataaagttatatgcgagtcagaggtcaactcattaaaagataacatgttaggatatgaatttatcaagaatcacggcggagaaataatccactgtaccatgctcggcgatgtgaaagtactttcagaaagtgaatacaaagcgtttgtaaatgatcactatgctcataataaacgcaagagagaaaatcttttgttagaagatataccacaagagttcctaaatcgacagatgaacgacagcaggtacatttccaaagtagtaaaagctctcttaagtaacatcgtcagagccgaaggagaagaagaagcaacatcaaaattcgtagttagctgtagtgggggcatcacagatagattaaagaaagactggggccttaacgatgtgtggaataaaattgtataccctaggtttgaacgactaaacaggttaacagggaccgaggcttttggacaatgggaaaacaaagacggaaaaagagttttccaaaccgccgtacctctagaattacaaagaggctttaataagaaaaggattgaccaccgacatcacgcaatggacgcgctagtgatcgcatgcactagcaggaatataattaactacctaaacaatgaaagtgcaaacaaccctaagaaaagagaagacttgcgacaaaaattatgtgataaaaataggactatacgcaaaccatgggaaacctttacccaagacgcaacagcagcattagaagatgtaatagtatcattcaaaaattatgtacgtattattaacaaagcaacaaactactatgaacgatacgatgtcgaaggtaagaaagtaatagcagaacagagaggcgatgacatgtgggcaataaggaaaccaatgcatgaagcaacatactacggtagagtaaatcttcgaaggaaaaagaaagttaatctaagagtcgccctggaaaacataagcagtatttgtgacaataaactacgaatctatataaatggtctagtagaaaaaggatttaacacaaaacaaatcctcgataaattcaaaaacactaatgatcatttcagtatgcagaaaatcgataaagtagaaatttggcaattcacaaatgaagaagaaaaattagtcgctactcgtaaacctctagatacgagcttcgatacgaagaaaatagcgagcatcacagacactggaatacaaacaattctactaaattatttagaaaccaaaggaggtgattcaaccatagcattcacaccagaaggaatagttgaaatgaaccaaaacatatcaaaatataacaatggaaaagaacatatgcctatattaaaagtaagactctataccaaattaggtaagaaaatcccagtaggacaaacaggatgtaaagcaaaacagttcgtaatagccgaagcaggcacgaacctatactttgcaatatatgaggatgaagaaggtaaacgatcttatcggaccatacctttaaacgaagtagtagagagattaaaacaaggtctttcaccagtaccggagaaaaatgataaagatgtacatctaaaattttatctaagccccaacgacctcgtttacgtacccattgaagatgaacacgagagcttggcaaaagaccacatatacaaattcgtagattcttccggcacaacggctaattttattccccacaggtccgctaacgtaatatttgaactgaataagaaagacgcagaaaaattttgttcaggatcaataatacaaaatgaatatggcgtcggaagtagccaaagtaaaaaccaaaaagcaataacaggtgaaatgataaaagcagtttgtcgaaaactagaagtagatagattaggtaacgtaattaaagtaatctga

SEQ ID NO: 5731 - RNA, 4497 nt, synthetic construct
  misc_feature 1..4497: note = Cas9 variant
  source 1..4497: mol_type = other RNA
atgaaacatattcttggtttggatctaggaacaaattccattggatgggcagtaataagagcacaccaggatgcagacggccatacaactcttcaagatatattagcagccggatcacgaataattccaatggatgccgcaacactgacagacttcgataagggtaatgctagaagtggcaccgcggaaagaaccagctttagatcgatgaggcgaagaagagaaaggcaattacttagaagagaacggcttcacagagtcttaatgctactaggatttttacctcagcactatgcgaactcattaacaagatacggagagttcgcagacaatagagaatgcaaattaccatgggtaaaagacgaaagtgatggtaaatatcatttccttttccaagacgccttccacgaaatgtgcgaagattttaggcaattagcaccgcaatgggtagccgacggaaagaaagtcccttatgactggaccctatactatttaagatgcaaagcactttcgcggaaaatatcaaaagaagaactagcctggatccttttaagtttcaaccagaaaagaggatactatcaagcacgagacgaagaagatgaagttaccaccaataaattagaagaatattatgctgggaaagtagtccgtgtagatgacacaggagaacgcaaagggaaaaacgtctactatgatataaccttggaaaatggatgggtataccgatatgctgcacgaatatatcccgactgggtaggacaagtcaaagagttcattgtaacaactacactcaatccagatggtactcctaaaacagataaagctggagaagtgaaacgatcattcagaatgcctaaagatgatgattggacgcttattaaaaagaagaaagaaagagacatagaccgatcacaggaaacaataggacaatatatttaccacgcactattaaaagatccctcacagaaaatacggggaaaactaataggaaccgtagaaagaaaatattataaagatgaattaagaagaatcctagatcgacaaattcaattccacccagaattgcgcgatagggaattatattacgcatgccttcaagaactatatccgtctaatgttgcattccggaacactctagtaaatcgtgacttcacatatcttttcctagacgacatcctcttttaccaacgaccactaaaatcaaagaaaagtcaaataagcgattgtccttatgaagaacacttctataccgataaagaaaccggtgaacgtataagcgtccctgttaaatgcatagccgtttcacatccactatatcaagaatacagactatggcaatttatacaaaaccttagaatatactgcagagaagctcggattgatggcaacctaatgattgactgggaagtaacaaatgaactattgcaaaccgaagaagacaaaacagcactatttgattggctaaatgataaagaatcagttaaacaaccagagctagttgctttccttcttggaggaaaagcaaacaagaaacaaataaaagcctacagatggaactacatggacgatgatacaaaaggctacccttgcaacgaaacacgggcctctttacttaaatacttacgcgaagctcaaacagactctagttttctaacacgtgaacgagaagaagcactatggcatatattatactcaataagcgacaaaggagaattgaaatcagcattaggcaaattcgccgttaaacatggactaaacgaaagattcgttacagtcttctctaaatttccacctttcaagaaagactatgggtcatacagcgcaaaagctctcaagaaactgctaccactaatgagaatgggacaccattggcaagaagcctcatttatacctagtacgaggcaacgcatggaaaaattcataaatggcgaatatgacgattcaatagacaaacgcacttatgaaaaactcgaaagtctaactgaagtaagccaatatagaggactaccaggttggttggcatgttatgtagtatatgaccgtcatagtgaaggacgagatatagaaagatggacatctccatcagatatagactcctatttggctcaattcaaacaacatagtcttcataatcccatagtagaaagggtcgtactagaaacattaagaacagtacgtgatatctggaaacaagtagatcatattgatgaaattcatatcgaactcggcagaaatatgaaactgccagcagataaaaggagacaaatgacagaacaggcttggaaaaatgaacaaacaaacctacgaataaaggctttactattagagttcgcaagacccggatacgatatagaaaatgtgcgaccatactcaccctaccaacaagatcaattacgaatctatgaagaagcagtattaggagcaaacgaatgcccagacgacatatcagcaatactgaagaaattcaacggattaaacccaccaacaagtgctgaagtattaagatataaatgttggctagaacaaaaatataggtcgccatacacaggtaggacaattccattgtcaaaactttttaccagtgcctacgaaatagaacatataatcccaaaacaaagatatttcgacgattcatttagcaacaaagtcatatgtgagagtgaagtaaacaaaaagaaaggagcaatgcttggatacgagttcatcaaatcataccatggagctagtataacacttaatagaggtggaacagcatcaatatttagcgtagaagcatatgaaaacttcgtgaaagagcattatgcacataataggggaaaaatgaagaaactactcatggatgacgttcccgattcgttcatatcaagacaattaaatgatagtagatatataagtaaattaatgaaatcaatcctatcaaacctagtacgcgaagaaggagaaaaagaagctataagcaaaaatttaatagtttgcactggaggtataacggaccggctaaagaaagactggggaatacacgatgtgtggaacgacatcatctttccgagattcaaacgactcgacgaaatggattcaagtcatacatatataactttaaatacacacaggcatccaatcccctcaatgcccctagagttccaaagaggcttcagtaagaaaagaatagaccacaggcatcatgccatggatgcaattgtaattgcatgcgcaacacgaaatatagtaaattacttaaataacgaatctgcacggcatgacgcaaaaacttcgaggatggacttacaaagattattatgtacagccaacagaaaactaatagataaaccatggaaaacttttacacaagatacttgtaaagtactagaagatatgatagttagctttcaacgaacattaagaataattaacaaaactaaaaactactacctcaggttcgaagacggtaagaaacgacgagttctacaaacaaaaggggataattgggctatcagaaaaccactacataaagaaacattctatggagaaatcaatttaaggcggatagaaacactttccttgaataaagccttggaacgaatacctgatatagtggaaagagacttacggaagaaactaagtgaactactatccctgggatacaacgccaaaagaattaaagggtatttcgaggaacacaaagaagaatggtcagatgttaatctcagtaaaattaaggcttattacttcacaaaacagaaaaacaaaagatactttgctgctcgaaccgagttggacacttcgtttaacaaagataaaatagaaaacaaaatagctgatacggctatacagaaaatcctacttcaacacctcgaagcatacggaaatgacgtagaacaagccttcagccccgagggtatagatacaatgaatcgcaacattcgtcaattgaatggcggtcggtcacaccaaccaatatacaaagttagagtatatgaagaagcgacaaaatttgccgttggccgaagaggcaacaaaagtacaaaattcgtagaggcagcgaaaggaaccaatttatttttcgcaatatatgaaatctcgcaagtagatggtaatggaaatagacaaacatcgaggactttttcatccattccattgaatgttgcagtagaaaggttgaaacaaggtctcccaccagtcccagaagatgaagaaggaaatgctcccaaatacgtattatccccgaatgatctggtatacctccctactgaaaaggaactcaaaagaagagaaatagcaatgccaatagacaagtctagaatatataaaatggtttcttgcactggtaaagattgtttctttataccagcaaacacagcggtaccaatagtcgatcgatatgaatacagtagcatgaacaaaataggtagagcactgactggagaaatgattaaagaaatctgcctaccattaaaaatagacagactaggtcaaatcatagaaatatctactttctga

SEQ ID NO: 5732 - RNA, 4506 nt, synthetic construct
  misc_feature 1..4506: note = Cas9 variant
  source 1..4506: mol_type = other RNA
atgaagaaaatcctcggattagatttaggaacgaactccatcggttgggccgtcataaataaagcagaaaatgaaggaaaagacgtgctatgtggaatagaagcagcaggttcaagaataataccaatggacgctacaataatgggggactttgaaaaaggaaattcagtaagtcaaacaaaagaccggcgtgaacatagatcaacaagaagactatatgaaagggggaaattaagacgcgaaagattgaaccgagtcctatcagtcatgggttttcttccagatcattacgtgagtcaactagatagatacgggaaattcctatctaataccgaacccaaattagcatgggtaagaaacgcagactgcaaataccatttcctatttatggacagtttcagcgaaatgttacaagaatttaaaacaaactcaccacaatatatttcggaagaatcaaaagtaccttacgactggaccttatactacttaagaaagaaagcattaactcacaaagttacaaaagaagaattggcatggatcctattaaattttaaccaaaaacgaggctactttcaactaagagacgaatcagaagaagagaagaaaccatccaaaataagacaatactttgaacaccaaaaagtggtagacattatagataccaacgaagtttataaaggcctaaaagtcctgatcgtaattcttgctaacgggatatcaggcaaaatctttaagaaagaaataccggactggatcggggtagaaaaagacataatagtcaaagtagacattgataaagacggaaaagacaaattcaacgaagatggaagcctaagttgtagattcaacatacccacagaagcagaatgggacactgaatgggaacttataaaacagaaaacacaaaatgacttggacgcatcaggtaaaacggtcggagagtacatatttgacacattattaaggaaccccgaacagaaaataagaggaaaactcgttagaaccatagaaaggcgttactataaagaagaaataaacgctatcctaaagaaacaaaaagaatttcaccccgaactgtctgatagggccttatatgaaaaatgtgttgaagaattatacccaaacaatcccgcacatagaaacatgatgcttatacacgacctaagttactttctagtaaatgatatactattttaccaaagacccttaaaatccaagaaatccctaatcgacgaatgcccttacgaatcccatctatatatagacaagaaatctggagaacgcaaacctgtagcagttaaatgtatagcaaaaagtcacccattataccaagagttccggttatggcaatttatatcaaaccttcgaatataccagaaaacgaaagaagtgggtaactcactaaaagttgatgtcgacgtaacaaacgagtttttaaaaggagagaacgattatgtggaattgtttgattggctaaatacaaagaaagaaataaaacaagaggactttttaaaatacaaaccattcggtttcactaaaggtaacattaataattatagatggaactacgtagaagataaaatatatccatgcaacaaaacccactatactatattaaaaggcttggaaaaagcagatattactttcgacgagttcatctcccatgattcactagcagaagaaaatctgtggcatattctatactcagtatcatcaaaagaagaactaaaacacgctttagagtcctttgctgataaacgagggctaagtataaaattcgtagatgcattcataaacacaccagctttcgaaaaatcgtacggtgcctactctgcaaaagcaatcaagaaactactaccactaatgagaatgggtaaatactggaaagaagaaaacatatgtgattcaacaagggaaagaatcgataaaataataacaggagaatatgacgaaaatatccgagacagagttagagagaaaagcataaatttaactgacataacattatttagaggtctaccattatggttagcatgctatgtagtgtacgatcgacattccgaagcaggaaatacagaaagatggaccagcccctcagatattgaccactacattagaaaatttaaacaacactcattaagaaacccaatcgtagaacaaatagtactagaaacactaagaactgtacgcgacgtctggacagaagtaggaggaatagacgaaatacatgtagaacttggacgagaaatgaaaaatccatctgacaaaagacggaaaatgtcgctacaaatgcaagaaaatgaaaacacgaacttacgaatcaaagcactacttgctgaatttataaatccagaactgggcattgaaaacgtacgaccatattctccatcccaacaagacctactacgtttgtacgaagaaggcgcatggaatagcccagaaattgacgaaaaacaagtagacgaaatgttagctattctcaagaaattcaacgaaacagacagttcaaaaagaccaaccaaaagcgaaataaaacgatatagattatggttagaacaaaaatataggagtccatatacaggaacgcccatacctctaagtaaattattcacaaccgcatatgaaattgaacatgtcatacctagaagcagatttttcgacgattcactaaccaacaaagtaatatgcgaatccgaagtaaacaaactaaaaggaaacatgttaggttacgagttcattaaatctcactatggagaaaaagtacaattatcgagcggatctgaagtacaaatatttagtgtcaacgactacgaaaaattcgtcaaagaccactactctaaaaacaaagcgaaaatgaagaaattattgatggatgacataccggaaaaattcaccgaaagacaaatgaacgattcaagatatatttcacggctaatagtttcattactatccaatatagtacgagaaaaaggggaacaggaaagcataagtaaaaacgtcttggtttgcacaggaggggtgacagacaggctcaaaaatgattggggagttaatgacgtctggaataaaatcattctaccacgttttaaaagaatgaatgaaataacagactcaactgattacacatcagtcaacacttcagggcatataattccggcaatgcctcttcacttacaaaaaggctttaataagaaaagaatagaccatagacatcacgcaatggatgccatagttattgcatgtgcaggaagaaacatcgtaaactatctaaataatcaatctagtaaaagcgacgttagccgacacgacttgcgaaatcttctttgcgaaaaagataaaagcgaccgaaaagaactaataataaaaccgtgggatacttttacccaagacgtctacagtgtactatcatcaataatcgtatcaataaaacaaaacctcagagtaataaataaaaccaaaaatatttatcaaagaaaagaagatggtaaggtaatcatcagtaaacaagagaacaatataaactggtgggctattcgaaaaccgctgcataaggaaacagttagtggggaggtaaacttgagaaaagaaaccacaataagtctgaaggaggcaatcgacaacccggctagaataatagataaagatttcaaaaagaaactaagagaattaattctaatgggatacaacgaaaaactaattaagaaatatttctacgacaataacgaatcctggcaagatgtaaacctcaagaaaattccagcatattactttacgaaagatactaacgatcgatatttcgccagtcgctcactgttagacgagaattttgacaaaaagaaaatagaaaacaaagttacggacaccggaatacgaacaatcctattaagacacttggaagtagagggcggagactcaaaagtagccttcagtccagaaggtctagaaagaatgaacaagaatatagaaatactaaatggaggaaagaagcacaagcccatatacaaggtaagagaatacgagaaagcggaaaagtttgcagttggcatgagaggaaacaaggcttcaaaattcgtagaagccgcgaagggtactaacttattctttgcagtttacgacaacggaaagaaacgcagctttgcaaccgtacccctaaacgaagtaattagactacaaaaagaaggactcccatcagcccctgcaaacgaagagggtttactacccaaattcgtgcttagcccaaatgacttagtttacgtacccaccgaagacgaactcagatcaggactattacccgagaaccctgcacccgaaagaatctacaaaatggtttcgtgtacaggttaccaatgcttcttcatacacttttcggtatcaggagtactttgtgacaagaaagaatttagttcattaaataaaatggaaagagcaatctcaggcgaaatgatcaaagagatttgcatcccattaaaagtcaacagacttgggaaaattatgtataacttgtga

SEQ ID NO: 5733 - RNA, 4506 nt, synthetic construct
  misc_feature 1..4506: note = Cas9 variant
  source 1..4506: mol_type = other RNA
atgaaaaccatactcggactggatctagggaccaattccataggatgggcaaaaatttcaatcgacgataatggaaactatctaagagacatccagctcgggagcaggataattcccatgtcacaagacgttctaggaaaattcgacaacggggtcactgaatctcaaaccgccgttagaactggattcagagggttaaggagaatacgagaaagaagcctattaagaagagaacgtctacatcgagtactacacgtaatgggctttctccctccacactatgactcagcgattggctggaacaaagaagaaccatctacatacgggaaattcttaaaccatggggaaccaaaattagcctgggagcgacaaggcgacggctctatgagattcttatttatggacagctttcataaaatgatggaagacttcgcgcctcatcagcctgcactcgtagcagatgggagaaaaatacctttagattggacattatactacctacgaaagaaagcactaacacagccaataaagaaagaagaacttgcctggatcctactaaactttaatcagaaaagggggtactatcaattaagaggggaagaagaggaagaaaacccaaccaaacgtgaagaatatcatgaattgaaagtcgtatctgtcgaagctgcagaggaagggaagggaggcaatacgtggtataacgttaaactagaaaacggttggatttatcacagaccatcaaaaatagatctatcagattgggtcggcaaaaccaaacaattcattgtaacgatggaatatgaggcagatggtataacattaaagaaaaacaaagagggggaagtaaaaagatcatttagggtaccggacgaagatgactggggactaaggaagaaaagaacagaaagtcaattagaagcaagtgggaaaacagtaggtgcgtttatatatgatcaccttctagcagaacccgcagacaaaataagaggaaacttcattcgtacgatagaaagaaaatactacaaacaggaattagcagatatactacgtgaacagtcaaaataccacgaagaattacaaagtaagaaaatattagccgactgtgccgaggaactatatcgatcaaatcagccccatagagatagtctactcaagaaagatatggtatacttactactcacagacctgatattctatcaacgaccattaaaaagtaagaaaagcctgatagcaaattgtccgtacgagtactacgaatatgttgataaagaaacaggtgagatcaaacgacagggcataaaatgcgtagcaaaaagtaacccatactaccaagagttcagattatggcaattcgtcttaaacttaagactttatgacagaacggaagataaagaagtaaccgcagaatacttaccaagtaaagaagactacgcacgtttgttcgtatatttaaacgaccgcaaagaaattaatcaggaaacattactaaaagatttctttaaactaaagaaagttaaacaacgatctgaaaaagaatttccagttcgatggaactacatagaagataaagagaagaaatatccttgcaacgaaacaagacatgaacttctaatggcattagacagagcaggaatggaacgaagctggctagatgacacagcaaggcaatacagattatggcatctattgtattcaattgaggtgaaagatgaagcagaacgagcgctaagaaaattaaaagatgacgacgagttcgtaagcgcattcctgaaagtcaaaccctttaagaaagactacggagcatatagcgaaaaagctgtcaagaaactcctcgcagtaatgcgaatgggttcacattggtgcgaagatgacatatgcaaagaaacaaaagaaaggattgaacacatattgcagggcgacgtagaagagaaaatcaaagaacgaatgaaccacacagcatactccttaggagaattatcagacttccaaggtttaccagagtggctagcgtgttacgtagtgtatggaagacacagtgaagcaacggacatcaaacattggaaaactccagaaagccttatggcatacattaatggattcaaacaacactcactaagaaacccaattgtagaacaatgcatactcgaaaccttaaggactgtacatgacatatggaaagaagcaggtcatatagatgaaatacacgtcgaacttggaagaagcatgaaatcaacgtcagatcagagggcgagaatgacagaaaacatactacgcaacgaaaacacgaatctaaggataaaaagtcttctaatggaactaaagaatgatgcagacatcaaagacgtacgtccgtattctcctatgcaacaagagatactacgtatctatgaagaaggcgcgttacaagaattaacaaaagaagataatgattacgaagaaatttttaaaataagtaaaataccacaaccatcagctaaagaattactaaaatataaattgtggctggaacagaaatacagatctccatacaccggaaaaccaattagcctgagtaaacttttcactagcgcctaccagatagaacatataataccgcaaagtagatattttgatgattcatttaataacaaagtaatatgcgaaagcgaggtaaacgcactaaagtcaaatatgcttggatatgaatttattaaaaatcatgggggcgaaatagtccattgtacactattaggtgatgtaaaagtccaaaatgaatccgaatataaggcttttgttaccgaacattacgcaaacaataaatacaagaaagaaaaactcctaatggaggatatcccacaagatttcttaaatcgacatctaaatgatagtagatatataagtaaagttgtcaaaaccctacttagtaatattgtccgaacagaggatgagatggaaactacttcaaaatttgtagtctcgtgcactggtggtataacagatcgattaaagaaagactggggtttaaacgacgtctggaactctatagtctatagccgattcgagagattaaatgaactaacaaaatcagacgcattcggacgatgggagaataaagaaggtaaaagagtatttcaaacttcagtacctttggaattacaaaggggatttaacaagaaacgaatagaccacagacaccatgcaatggatgctctggtaatagcatgcgcatcaagaaacattataaactatttaaacaacgagagcgctaattcccccaagaaacgagaagacctaagacaacaattatgtgataaaaatcgaattatccgaaaaccatgggagtcctttacccaagatgcacgagcagccctggaagacgtggtagtatcattcaaaaattatgtaagagttattaacaaaacaacgaactactacgaaaggtatggagcagacggcgagaaaaccatagccaaacagaaaaacagtgaaatgtgggcagtccgaaaaccaatgcatgaagccaaatactatggcagggtaaatttacaacggaaaacagaagtacgtttaaaagctgcattagaagacataccaagcatctgtaataaagaattaagggattacattaatcgcctagtaaaatccggattaaatgcaagacaactgcttgctcatttcaaatcaactgattattgttggaataaacaaaatgtggataaagtagaagtatggcgattctctgatgaaaaagaaccattagtagcaatacgtgaatccctagacacttcgttcgatgcaaaaaggatcgatacaataacagacactggtatacagaaaattcttttaaattatttggaagcgaaaggtggggatcccgcaatagcattcactccagaaggaatagcagaaatgaaccaaaatatggccttgtataacaatggaaaaatgcatcaaccaatactcagggtacgactgtctaagaaaaggggaaagaaataccaagttggacaaacaggttgtaaagcaaaacaatttgtaatcagcgaatcgggcacaaatttatattttgcaatctatgaagacgaagacagaaacagaacgtacaacacaatcccattaaatgaagtagcagaacgtttaaaacaagggttatcccctgtaccagagaaaaacgaaaaagaagttccattaaaattctacctaagcccaaatgacttagtctatgttcccacagaagaagaaattctgatgaaagaatgcaaactaaacaaaaaccggatatataaatttatagattcaagcggaactacagcgaatttcgtaccacacagatcagctagtctaatttacaatgtagataagaaattggccgaagccttttgcaacgatgaaataatacagaatgaatacggcgtcggatcgcctcaatcgaaaaaccaaaaagcgctaacaggagaaatgatcaaagccgtatgttggaaattagaagtagaccgtctgggaaatatcataagagtaatcaaatga

SEQ ID NO: 5734 - RNA, 4515 nt, synthetic construct
  misc_feature 1..4515: note = Cas9 variant
  source 1..4515: mol_type = other RNA
atgaaaaatattgtgggtctagatctcggcactaactcaataggttgggcagtagtaaacgggaacataaatgatgatggaagcgaacaactcgtgaaaatacaagcctcaggatcaagaataattccaatggatgctgctatgataggggactttaacaaaggtaattcaataagtcaaacagcagaacgtacaagactcagaggaattagaagattgtcagaaaggtatttattaagaagagaacgactacatagaatactcgacatacttgggttcttaccctcacacttcgcacgagacttagacagatacggcaaaatcgttaaagacaaagaaccaaaactggcatggaggaaaaacgaagcaggacagtttgaatttatatttcaaaatagctttaaagaaatgcttgaagatttcaaattaaatcacccgaacttaattacggacgataagaaagttccctacgactggacgatatactacttacgaaagaaaggtctaacatcaaaaatatcaaaagaagaactcgcatggatcttacttaactttaatcagaaacgaggatactatcaacttcgaggtgaagaagaagaagaaaataaaaataaacaagtagaattttatgctttaaaagtgatagcggtagaagattccggagagaagaaaggaaaagacacatggtacaacgtacatctagaaaacggttggatttatagaagaacatcaaatatgccattagactgggttggaaaaacgaaagaatttatagtaacaaccgatttagaaaaagatggcacaccgaagaaagacaaagaaggaaacataaaaagatcattcagagcacctaaagaagatgattggagcttagtgaaaaagaaaacggaagcagacatcgatcaaacccacaaaaccgtaggcacttacatatatgatactctacttggtaatccaagtcagaaaatcagaggcaggttagtacgaactattgaacgaaaatattacaaagaagaattaaaactgattcttgacaaacaaaaagaatttcatccagagctacaagacagagctttatatgcagcatgtgtggaagaactttatacaatcaacgaagctcaccgaaacaacatcggaaacagggatttcacttacctgttcttagaagacatcctgttttatcaaagaccacttaaaagtaagaaatctcttattgacaactgcccatacgaagaaaatcattgtctcgataaagaaactggagaaataaaattctttccagtcaaatgcattgccaaatcgcatccgctatttcaagaatttagactttggcagttcatagtcaacttgcgcatatataggaaagggttggcacaagacgttgacgttacaaacgaattgttaaaaactgaagaagactatgtcgctctatttgactggctcaacggcaagaaagaaatagaccaaaaagcctttctaaaatacccgccatttgggcttaagaaagaagtagaaaactacagatggaactatgtacaagataaaagctacccctgcaatgaaacacgtagccttatgttagctcgactagaaaaatgtgacatatcaatcgaatttttaacaaaagaaaacgaagaagcactctggcacatattatactcagtagaggacaaaaacgaaattgtaaaagcattacaaaaattcgcggataaacataatttaaatgcttcattcgttgacgtattccagaaattcccatcatttaagaaagaatacgggagctactccgccaaagcaatcaagaaactcctgccattgatgagaatgggtaaatattggtcggaagattcaatagacaaaggcacacgagaacgaatggacaaaattataacaggagaatacgacgagaaaatagaaaatagggtaagggaaaaagcaattcatcttgcggacatttccgaatttaaaggactccctctatggttggtatgctatatcgtatatggaaggcacagcgaatctaaagagattgctaaatgggaaagcccggcagatatagattcatatcttaaaagtttcaaacaacactcgttaagaaaccccatagtagaacaaattattatagaaaccttaagagttgtgagggatatatggaaacaagtgggcaatattgacgaaatacacgtagagttaggaagggaaatgaaaaacccagccgataaaagacgaaaaatgacacaacaaataagtgaaaatgagaacaccaacctaagaattaaatatttgcttactgagttcttaaatcctgagtacgaagtggaaaacgtaagaccgtattcaccaagccaacaagacatactaagaatctatgaagaaggagtgttaaattccgtgtccaatttaccagaagagatatcagacatacttaagaaattcacagaaaccgatctaaagaaaagaccgtcacgtagtgaagtcttaagatacaaactttggctagagcaaaaatatcgatcaccatatacaggagaggtgataccacttggaaaattattcacgcctgcttacgaaatagaacacgttataccacaatcaagatattttgatgactcattctcaaataaagtaatatgtgaagcagaggtaaacaaactaaaatctaacttacttggtcacgagttcatagtaaaacaccacggagaaattgtggaactacctttcggaaagaaagtaaaaatatttactgtagacgaatacgaacagtttgttaaagataactactccagaacaaggggaaaaatgaagaaactattagtagatgacataccagaagagttcgtagccagacagctgaatgattcaagatacatctcaaaagtcgtaaaatctcttctctcaaatatcgtacgtgaaaaaggggaagaggaagccatcagcaaaaacgtaatcccatgcactggtggagtaactgatagattaaagaaagactggggagtcaacgacgtatggaataaaatcatcttaccaagatttcaacgcctaaatgaattaacaggtaccaataaatttactacaatgtcactcaacaaccatgaaatacctgcaatgcctttagaactacaaaaaggcttcaacaagaaaagaatagaccatcgccaccacgcgatggatgcaatcataatagcttgtgcgaacagaaacataataaattacttaaacaatgaaagcgcgacagcaaaagcagaactctcacgttacgatctacaacgactattatgtgataaagccaaaacggatgacaatggtaattacaaatgggtaataagaaagccatgggcttcattcacacaagacgtacatggcgtactggaggacataatagtcagcttcaaacaaaacttgagagtcattaataaggctacaaaccattttctacattataatgaggaaggtaagaaaatttttgttaaacaggaaaaaggtgactcatgggcaatacgaaagagcatgcataaagacacagtgttcggagaagtcaacctaagaagaataaaaacagtagctctaaatgaagctatgaaaaacccacaatcaattgtagtcaaggactttaaaagaaaattactagagttattaaacttaggctttgatgcgaaaaggataaagaaatacttcgaagacaacagagagacatggtctgacatcaatttaagtaaaataacagtttattatttctctaaagatacgaaagatagattctttgcaacaagaaagccactagatacctcatttgacagaaagaaaatagaaaacaacataacagatactgggatccagaaaatattactgagacatctcgaactaaaagataataatcccgacatagcgttcagcccagatggaatagacgaaatgaaccgcaatataatacaactaaataatggcaaataccaccaacctataataaaagtaagatggtacgaacaggcagacaaatttgcggtcggacagaccggaaataaatcatcaaaattcgtcgaagctgcgaaaggcacaaacttattctttgcagtatacgaatcaaacatactggatgagaaaacaaacaccataatcaagaaacgaaattatgctacaatacctcttaacgtagcaattgaaagacaaaaacagggattatcagtcgcacctgaagaggaaaatggaaacgaccccatatttgtcttatctcctaatgatttagtatacttaccaaccacagacgagttagcaaacggagtagtcgcccaacctttagataaagagagaatatataaaatggtctcgtgtacaggaaatgaaggacattttatcccagcaagaattgcaaatccgatactacaaacaatagaactcggatcaaataataaagcgcaaaaagcatggaccgacgagatgatcaaagaaatctgcatgcctataaaagtggacagactgggtaacattctcgaatcaagttcactacacaagaaatga

SEQ ID NO: 5735 - RNA, 4515 nt, synthetic construct
  misc_feature 1..4515: note = Cas9 variant
  source 1..4515: mol_type = other RNA
atgaaaaacatagtcggactggacctgggcacaaattcaataggttgggctgtagttaacggatcagtcaacgatgacggttctgaacagctagtaaaaatacaagcatcaggcagccgaattatcccgatggatgcagctatgataggcgatttcaataaaggaaatagcatatctcaaacagcagaaagaacacgattaaggggagtcagaagactgtcagaaagatatcttttaaggagagaacgattacatagaattctagatatattaggattcttaccgtttcactttgcacaagacttagaccgtcatggtaaaatagtaaaaggcaaagaacctaaattggcttggcgaaaaaacgaagcaggacaattcgaatttatatttcaagattcctttaaagagatgctggaagactttaaattaaattatcccaacctaataacggatgacaaaaaagttccttacgactggactatatattacctacgaaaaaaaggcctaactagtaaaatatctaaagaagagctcgcgtggatattacttaattttaaccaaaagagaggatattatcaactacgaggtgaggaagaagaagaaaacaaagataaattggtagaattctatgcacttaaagttgtagccgttgaagactcaggagaaaaaaaaggaaaggacatatggtacaatgtacatttagaaaatggttgggtatacagacggacatccaacatgtcattagattgggtaggcaaaacaaaagaatttatcgtaacaaccgacctagaaaaagatggaacacccaagaaagacaaagaaggaaacgtgaaacgttcatttagagcacctaaagaagacgactggtcattagttaaaaaaaagacggaagcagacatagaccaaacacataaaacagtaggagcatatatatatgacacacttttgggcaatccttctcaaaaaataagaggcagattggtaaggaccatagaaagaaaatattacaaagaagaattaaaattaatcctcgaaaagcaaaaagagttccatctagagctacaagaccgagcactctacgcagcctgtatagaagagttgtacccaataaatgaagcccacagaaataacgtcgggaaccgcgactttacatatttgtttctagaagatatactattttatcaaagaccattaaaatctaaaaaaagcctcatagacaattgcccttacgaagagaatcaaggattagataaagaaacaggagaaattaaatcttttccagtcaaatgtatagcaaaatcacaccccctctttcaggaattcagactatggcaattcataattaatttacgaatataccgaaaagacctagcacaagacgtcgacgtaacaaacgaactcctaaaaactgaagaagattacgtagctctatttgattggttaaacggaaaaaaggaaatagatcaaaaagcctttctcaaataccctgtctttgggttgaaaaaagaaatagaaaactatcgatggaactacgtccaagataaaccatacccctgtaacgagactagatcactaatgctagcgagactcgaaaaatgcgatattagcatcgaatttctaacaaaggagaatgaagaggccctctggcatattctttatagtgtcgaagataaaaatgaaatagtcaaagcactacagaagttcgctgataaacacgacttaaatgcatcctttgttgatgtttttcaaaaattcccgccattcaagaaagaatatggctcatattcagcaaaagcaataaaaaaactcctaccgttaatgaggatgggaaagtactggtcagaaaattccatagataagggaacgagagaacgcatagacaagataataactggtgaatatgacgaaaaaatagaaaacagggtacgcgaaaaagctatccatcttgccgatgtgtcagattttaaaggactaccattatggttagtatgttacatcgtatacggaagacactcagaagcaaaagaaataattcagtggaaatcaccagcagatattgattcatatctgcgatcattcaagcagcattcactaagaaacccaatagtcgaacaaataatcatcgagacgctaagggtggttagagatatttggaaacaagtaggaaatatagacgagattcacgtcgaattaggcagggagatgaaaaatcctgccgataaaagaaaaaaaatgacccaacaaatgagtgaaaacgaaaataccaatttgaggattaaatatctactaaccgaattcttaaatccggaatatgaagtagaaaacgtccgaccctattctccttctcaacaggacatactccgcatatacgaggaaggagtattaaatagcgtgtcagatttacccgaagaaattagcgatatactaaaaaaatttacagagacagatttaaagaaaagaccatcaaggagtgaagtattacgttacaaactatggttggaacaaaaatatagatcaccatatacaggagaagtcattcccttgggaaaactctttacccccgcttacgaaatagaacatgttataccacaatcatgctactttgatgatagcttctcaaacaaagttatatgtgaggctgaagttaataaacttaaatctaatttattaggacacgaatttatagtaaagcatcatggggaaatagtagaacttccatttggaaaaaaagtaagaatcttcaccgtcgatgaatacgaacaatttgtaaaggacaattacagtagaacaaggtcgaagatgaaaaagttactcatggacgacataccagaagaattcgtaacaagacagctaaatgactcaagatacatatcgaaagtagtaaagagtctactaagcaacattgttcgagaaaaaggagaagaagaagcaatatcaaagaatgtaatcccttgcaccggtggagtcacagacagactaaaaaaagattggggaataaatgaagtatggaataaaataatattgccacgctttcaaagattaaacgaattaacaggaacaaacaagttcacgacgaaaaatgtcggaattcaagaaataccaacaatgccactagaattacaaaaaggtttcaataaaaaacggatcgatcatcgacaccatgccatggatgctataataatcgcatgtgcaaacagaaatataataaattatttaaacaatgaatcagcaaccgcgaaggcggaattatcacgttatgacctccagaaaatgctttgtgacaaagcaaaaacagacaataatggaaactacaaatgggtaattaggaaaccttgggccagttttacacaagatacttatcttgctttagaaaacataatcgtctcttttaaacaaaacttaagagtgataaataaagcaacaaatagattcttacattataatgaagaaggaaaaaaaatatttgtaaaacaaggtaaaggagacaattgggcgataagaaaatcaatgcataaagataccgttttcggcgaggtaaacctcagaagaatcaaaacggtagcgttaaacgaggcaatgaaaaatccacagtcaatagtagttaaagactttaaaagaaaattgttagaactatggaaccttggttttgacgcgaaacgcataaaaaaatattttgaggacaatcgagaaacttggtcagatatcaacttaagtaaaatagaagtatactacttttccaaagataccaaagatagattctttgcaactaggaaacccctagatacttcctttgaccgcaaaaaaatagaaaataacataacagatacaggaatacaaaaaatactgctaagacacttagaattgaaagataataatccagatatcgctttttcacctgacggaatcgatgaaatgaatcgaaatatcatacaactaaacaatggaaagtatcaccaaccaataattaagataaggtggtacgaacaagccgacaagttcgcggtaggacaaaccggaaacaaatcgagtaaatttgtcgaagcggcaaaagggacaaacctttttttcgcagtatatgaatcaaacatattggacaaaaaaacaaacacaattataaagaaaagaaattatgcgaccattcctttaaacgtcgccatcgaaagacaaaaacaaggactaccagttgccccagaagatgaaaatggcaatgatccaatattcgtcctatcaccaaacgatctggtttacctaccgacagatgacgaactcgcaaatggaatcatagcacaaccattggaccgcggaagaatatataaaatggtatcatcctcaggagaacaatgcttttttatcaagcatatagtagcgaatgtgctagtagacaaatttgaattctcacccctgaacaagatggagagagcattaacgggggaaatgataaaaatgatatgcataccaataaaggtcgatagacttggaaatgtactcgaatcaagctccagttacaaaaaatga

SEQ ID NO: 5736 - RNA, 4515 nt, synthetic construct
  misc_feature 1..4515: note = Cas9 variant
  source 1..4515: mol_type = other RNA
atgaagaacatagtaggattagatctaggaacaaactccattggatgggctgtagtaaatggcagcgtaaatgatgatggatcagagcaattagtcaagattcaagcaagcggctctcgcattatacccatggacgctgcaatgataggggattttaataaaggaaattccattagccaaacagcagaaagaacaagactaagaggtgtacgaagactatcagaacgctatctactaagaagagaaagattacatagaatattagatatcctaggatttctaccattccatttcgcacaagacctagatagacacggaaaaatcgtaaaaggcaaagaacctaaacttgcatggcgtaaaaacgaagcaggacaatttgagttcatattccaagattcgttcaaagaaatgcttgaagattttaaattaaaccatccaaacttaatcacagacgacaagaaagtaccatacgactggactatatactatctcagaaagaaaggccttacttctaaaatatccaaagaagaactggcttggattttattaaatttcaaccagaaaagaggatattatcaacttagaggagaagaagaggaagaaaataaaaataaattagtcgagttctatgcattgaaagtagtagccgttgaagactctggagaaaagaaaggaaaagacatatggtacaatgttcaccttgaaaatggatgggtatacaggcgaacatcaaatatgccactggattgggttggaaaaacgaaagaatttatcgtaacaacagacctagaaaaagacggaacaccgaagaaagacaaagaaggaaacgtaaaacgatctttccgagcccccaaagaggacgattggtcattggtcaaaaagaaaacagaagcagatatagaccagacccataaaacagtaggtgcttacatctatgatactttgctcggaaatccgagtcagaaaattcgtggtagattagtaagaacaatagaaagaaaatattacaaagaagaactgaaacaaatattagaaaaacaaaaagaatttcatttagaattacaagatcgagcgttatatgcagcatgcatagaagaactctatccaataaatgaggcccataggaataatgttggcaatagagacttcacttatctgttcttggaagacatactgttttaccaaaggccattaaaatctaagaaaagtcttatagataactgtccttatgaagaaaaccaaggattagacaaagaaaccggcgagataaaaagttttccagtaaaatgtattgcaaaatcacatccattatttcaagaatttcgactatggcaatttataattaacttaagaatataccgtaaagatttagctcaagacgtggatgtcacaaacgaactactcaaaacagaagaagactacgttgcactatttgattggttgaacggcaagaaagaaatagatcaaaaagccttccttaaatacccggtgtttaggctgaagaaagaaatagaaaattatagatggaactatgtccaagacaaaccatacccatgcaatgaaacaaggagtctgatgctcgcaagattagaaaaatgtgatatctcaattgagttcctcacaaaagaaaacgaagaagcactatggcacatactttactctgtagaagacaaaaatgaaattgtaaaagcactacaaaaatttgctgacaaacatgatcttaatgcttcattcgtagacgttttccaaaaatttccaccattcaagaaagaatatggaagttactctgcaaaagctatcaagaaactattacccttaatgcgaatgggtaaatactggtccgaaaacagcatcgacaaaggaacacgcgcacgaattgataaaatcataacaggagaatacgatgagaaaatagaaaacagagtaagagaaaaagcaatacatctggcagatgtgtcagactttaaaggcctacccctatggctagtatgttatatagtatacggaagacatagtgaagcaaaagaaatcattcaatggaaaagtccagcagatatagactcctatcttcgctctttcaagcaacactcgttacgaaaccctatagtagaacaaatcataattgaaacactaagagtagttcgagatatatggaaacaagtcggaaatatagacgaaatacacgtagaactaggaagagaaatgaagaacccggcggacaaaagaaagaaaatgacacaacaaatgtctgagaatgaaaataccaatctacgaattaagtacttattaaccgaatttcttaacccagaatatgaagtagaaaatgtgagaccatattcgcccagtcaacaagacatattgcgaatatatgaagaaggcgtattaaacagtgtgtcagacttacccgaggaaataagtgatatactaaagaaattcacagaaactgatctcaagaaacggccatccagaagtgaaatcctgcgctacaaactctggttggaacaaaaatacagatcgccatacaccggcgaagtcattccacttgggaaactcttcacaccagcatatgaaatcgaacatgtaatcccacaaagctgttactttgatgattctttctcaaacaaagttatatgcgaagcagaagtgaataagctaaaatccaatctcctagggcacgagttcatcgttaaacaccatggggaaattgttgaactaccctttggtaagaaagttagaatatttacagtagatgaatatgaacaatttgttaaagataattacagcagaactcgctccaaaatgaagaagctacttatggacgatataccggaagaatttgtaactcgacaattaaatgacagtcgttacattagcaaagtagtaaaatcattactatccaatatagtaagagaaaaaggtgaagaagaagctatatctaaaaatgtcattccatgcacaggtggtgtaacagatagactaaagaaagactggggaataaatgaagtgtggaataaaataatactaccgagattccaacgattaaatgaactcacaggaacgaacaaattcacaaccaaaaacgtaggattacaagagatacctacaatgccattagaactccaaaaaggcttcaataagaaacgtatagatcaccgacaccatgcgatggatgctatcataatagcctgtgcaaacaggaacataataaactacttgaacaatgaatcagccacagccaaagccgagttatctagatacgatctacagaaaatgttatgtgataaagctaaaacagataacaacggaaattacaaatgggttatacgaaaaccatgggcctctttcacacaagacacctatttagcactagaaaacatcatcgtctcattcaaacaaaacttgagggtaatcaacaaagccacaaacagattcctacactacaatgaagaaggaaagaaaatattcgtgaaacaaggaaaaggggataattgggctattagaaaatcgatgcataaagacaccgtttttggagaagtaaatctacggagaataaaaactgttgcattgaatgaagccatgaaaaaccctcaatcaatagtagtaaaagacttcaaaaggaaactattagaactctggaacctcggcttcgacgcaaaaagaatcaagaaatatttcgaggacaatagagaaacatggtcagacataaacttaagtaaaatcgaagtatactacttctcaaaagacacaaaagatcgattctttgcaactcgaaaacccttggatacgtctttcgaccgtaaaaagatagaaaacaacattacagacaccggaatccaaaagatactcctgagacatcttgaactaaaagacaacaatccggatatagcattttccccagatggcatagacgaaatgaacagaaatataatacaactaaataacggaaaatatcaccagccaataataaaagtcagatggtacgaacaagcagacaaatttgctgttggacaaacaggaaataaattctcaaaatttgtagaagcagctaaaggaacgaatttattcttcgcagtatatgaatcgaatatattagataagaaaaccaatacaataattaagaaaagaaattatgcaacaatacccctcaacgtcgctatagaaagacaaaaacaaggattaccggtggcgccggaagacgagaacggcaacgaccccatattcgtcctaagcccaaatgatcttgtctacttacccaccgatgacgaacttgcaaatggaatcatagctcagcccctggatcgaggaaggatctacaagatggtttcctcaagcggggaacaatgcttctttataaagcacatagtagcaaatgtattagttgacaaatttgagttctcgccactaaataagatggaacgtgccttaacaggagaaatgataaaaatgatatgtataccaattaaagtagaccgactaggaaatgtattagaatcgtcctcatcccataaaaagtga

SEQ ID NO: 5737 - RNA, 4515 nt, synthetic construct
  misc_feature 1..4515: note = Cas9 variant
  source 1..4515: mol_type = other RNA
atgaaacgtatattaggactagacctaggaactaattcaataggttgggcgctaatagaaaacgacttcaatcgaaaagaagggaaaatcgaagcactcggatcgcgaataatacctatgtctcaagatatactaggtaaattcgacagtggagtcacagtgagtcaaacggcagcaagaaccaattatagaggaatcaggagattgtaccaaagggacaacctcagaagagagaggctacatcgggttttaaacatcctaggattcctaccaaaacactacgcagaatcaatagattttgaagataggttaggacaattcaaaccagaaacagaagtaaagctaccctacagaaaagattctgatgataattaccacttcatatttcaagaatcatttaatgaaatggtagaagaatttcaatttaaaaacccatcattattttacacaaaagcaaacggagaacaatcgaaaataccttacgattggacattatactacctacgcaaaaaagccctaagcaaaaagatttcaaaagaagaactagcatggatcttactaaacttcaaccaaaagcggggatattatcaattgcggggagaagaagaagccgacagtaaagataaactagaggaataccatgcactaaaagtaagcgatgtacaggcaaccgaggatactaacgctaaaggaacttggtacaatgtaatccttgaaaacggatggatctaccgcagacaatcaaaagacagcttattcgactggaaaggaaaaacaagagaatttatagttaccacatcacttgagaaaggtggagcagtcaaaatcgacaaagaaggaaatgaaaaaagatcattccgggctgttgacagtgaaaaggattggattgcaataaagaaaaaaacagaaaacgatctggctaatgctggaaccaccgtaggagtatacatttacgagacattactgcgtaaccccgatcagaaaatcagaggaaagcttataaaaacaattgaacgaaaatattacctggaagaattgaaagcaatcctagcaaaacagattcaagaacatgccgaattacaaaaccgaagtttatataaagactgcatagaagaactataccaaggtaatgaagctcacaagaacaacataaaggagaacggattcgattacctattcttagaagatatcatattctaccaaagaccactcaaaagcaaaaagagtacaatatccaattgtccatatgaaagcagagtattcatcaaagatggcaaaaaggaaatacaaccaataaaatgtatctcgaaaagcaaccctatatatcaagaatttagactatggcaattcatacacaatctgaaaatctatgaaaaagaagctatcgacgatggtaagacagtaataaataaagacgtaactaccgaattccttaacacacaagaggcatatgcagcactattcgaatttttaaatgacaaagcggagatctctcaaaatgccttactaaaatattttaaactatcaacaaatacacatagatggaacaacgtagaagataaaaaatacccatgtaatgaaacaagatcagaatttataaaaaggttatccaaaatggacggtattgacctaggcaagacactctcccctgcctttgaaaagagtctatggcatataatctattctgtaaaagataagaaacaatacgtgagagccttagaaacattcgctatgaaaaacggactagatataaaccaattcagagagaactttgaaaaattcaaaccctacgattcagcctacggagcctattccgaaaaagcgttaaaaaaagtccttccactaataagacgaggaacgtactggaaaaaagacgcaatcccagcagcggtccaggagagaatcgtaaatataatgaaaagaatcgaaagcgtcgattttaacctagaaaaaatagaaaatttcgcagatgatgacatccccaaacagttacttaaatcattcgcaaaaggaaaggacccaatgcaaggcctcaacacatatcaagcgtgctacgcagtatacaataggcactctgaagtatcagatatccaactatggaagagtcccgaggacattacgaaatatttggattcctttaaacaacactccctgcgcaatcccatcgtagaacaagtggtaatggaaacacttagagtagtcagagacatatggcagtattacggtaatggagctaaagactttttctctgaaattcatgtagaattaggacgcgaaatgaaaaatgataaaaaaacacgagaaaggataagtaaatccataactgaaaacgaaaacactaacgaacggataaagaatatattaaaagaactgatgggagacgaagccttacaaggagacatacgaccatatagcaaaggtcaccaagacattctcaaactgtatgaagaaggagtctttgcaaacgctcctgaaacatataaaaacataaagatagacgacatagaaaaaattcgtaaaaataattctccttctaaatcagacatagtgaaatacaaactgtggttagaacaagggtacatatcgccctacacaggaagccctatccctctatccagattatttacgacagattaccaaatcgaacatataataccaagatcaagatacttcgacgactccatgggcaacaaaatcatctgtgaatcggcagtcaacgaagaaaaaacaaataagacagcgtatgaatttattaaagaaaacgcaggtcgaatcattgatctaggacaggggaagcaagtccccctgttcgatttagaagcatacgaatcgcactgcagagggtatttcaaaggcaatacaaaaaaattaaaatttctgttgagtgaagacatccctgaaggattcattaatcgacaacttaacgacagtcgctatatatctaaggtggtcacttcgttactatccaatgtagtcagagaggaaggagaacaggaagcaacaagcaaaaacttagttcctctagtaggtacgattacctcaaagttaaaaaaagactggggactggaagcaatatgggatgatctgattgctccaagatttgaacgaatgaatcaactaacaaaatctaccgactttcgaaaagaagtgattgacggtcatgggaacagatattttataaacacggtccctgacgacataaaaaaaggattcagtaaaaaaaggatagaccatcgtcaccacgcattagatgcccttgtaatagcttgcactactaaagaccacgtaaattatataacctcactaaacacacaaaggaataatagatctcttgttagcaaattaagaaaaatcgaagaaaaaaccataaaagataaaagaacagggcagccaaaaacaattaaaatagcaaaagcttatcacaaaccttggcccaacttcacaaaagaaacttttgaaaaactctcaaaaactgttgtaagtttcaaacaaaaccagaggatcataaataaaacgaacaataagacgtggggttgggaaaaagtagacggtgtaatgaaaaaagttctcaaaaaacaagaaaagagaaattgggccataagaaagcccatacacaaagaaacttactacggcaaagttaaagggtttgacagtccaaaaggaaaaataacaacggctacaagaaagtcactccgagaaatcacaaacgaacgtcaattaaacacaattacagattccggcattaaaaaaattctaaacaatcaccttaaaactttcatagatgaatccggtaaaataaattttgaacctgcatttaaccaagacggaatcgaccttcttaataaaaatatacaacaactcaatgaaggaaaaaaccatcagccaatttacaaagtaaggatgtacacacataacacaatgtttagtgttggggatgaaggcaataaatcgacaaaatatgtaataccagaatccggaaccaatttattttttaatgtatactgggatgaagaaaataacaaaagaaactttgagacagttccactaaatagagtcattgcctttcaaaaacaaacctcccatataccgaggaaagaccgaactgacgtcccgatcgataataccttaggaagatttttattcacactatcgccagatgacttagtttacctcccaacggacgaggaaagcgagtctttcactacctttgaaatagacagtttgaactcaaaacaagtagcaaacatttataaattcgtagacggaagcggaacaacaggaaactttgtcccagcagaagcagccagggtaatagcaaacataaaagataaaaaagtacgatctaacttctgcaaacgcaacaatctaagcgataaacaactaataaaaaatgaatttggattgggatcacctcaactaaaaaatcagaactcattagatgggaggcaaataaaatccatctgctggaaactggagattaacagactaggaaaaattataaaggtgataaagtga

SEQ ID NO: 5738 - RNA, 4515 nt, synthetic construct
  misc_feature 1..4515: note = Cas9 variant
  source 1..4515: mol_type = other RNA
atgaaaaaagtcctaggactagacataggaactaactcagtaggctgggcagtagtcaaccaaaacgataaaggcgaattcctttccattgaaaaaattggtagcagaataatcccaatgagtcaagacgtcatggataaatttggagcagggcaaaccgagagcagtaccgcacaaagaacacagtatcgtggagtcagaagacttagagaaagatcactgttaaggagagaaagattacacagagtgttacacatactacacttcctaccccaacattatgacgctgcaatcggatggaacaaaaaagaaaataaaacatatggcaaatttctccctggcgtagaagtaaacataccatgggtcgcgacagatcaaggacaccagttcatattcatggattcatacgcagagatgctaaaagatctaaaacaacaccaaccacacctattcgaaaaatcatctacacctgttcccctagattggacaatatactatctcagaaaaaaagcgttaacccaagcaatatcgaaggaagagttagcatggatcttactaaactttaaccaaaaaagaggatattatcaactgcgcggtgaagaagtcgaagacaatacaaaaagagaagaattttatgctttaaaagtagtaaaagtagagctagacaaagataacacaagcgctaaaacgtggtataaagtgcacctagaaaatggttttatatatccatgcccaagtgatactccaattgactcatgggtgggcatggtgaaagattttatcgtcaccacaacactagaaaaagatggttcagagaaacgaaccgctgacggggaaataaaaagaagctttcgagccccaaaagaggacgattggacattattaaaaaaaaaaacggaatccgaacttgaaaaaagcggtaaacaagtaggcgctttcatatacgatactttgttatccaaccctgatcaaaaaataataggcggactgattaaaaccatagaacgaaaatattataaaaaagaattagaacaaatattagaaactcaacaaaaatttatagcagaacttagcgacaaaaaacttttccaagcgtgtgccgaagaactataccctctaaatgatagtcatcgtgaaaacttattagaaagagatttcaaacacctattcgtccaagatataatcttttatcatagaccactaaaaactaagaaaagcctaatatcaaattgcacatacgaatatagaacattttataaaaacggagaaaaacaaataagcccaataaaatgtattgcaaagtctaatccattattccaagaatttagagtatggcaattcgtgcaaaatttaaggatattacaacgacaaaggtcagagggtgattctataaaatataacgtcgatgtcactgcggaatttctaaaagatgagaacgacatagcaaacctattcacatggttaaacgaaaggaaagtaataaaacaggatcaactattaaaatcctacttcaaactaaaggttaataaagaaacaaaagaattagactacagatggaattacgtagatgataaaaacaaagagtacccttgcaatgcaaccagaacacacattctgtcatttttagaaaaatgtaaagaagagaaacgtatagaagacgatagatttgtctattcattatggcatcttctatatagcgttgtagagccaattgaactacgtggcgcgttagcaaaatttgctgagagagaacacctgcatccatcattcgtcgacgtttttgcacagttccctcccttagaaaaagaatatggatcatattcagaaaaggcgataaaaagattattaccacttatgcgtatgggagattactggcacgaagacaaaatcgacgtaaaaacaaaacaaaggatacaacgaataattgacggagaagcagacgatgacataacacaccgtagcagagagaaggtagagaacttacgttctataacagacttcaaaggactgcctttatggaaagcgggatacgttgtttataataggcattctgaatccggtgaactaacgaaatggaaaacccctcacgagttaagtaattacatacaaaacgaatttaaacaatactccctaagaaacccaatagtggaacagatagtcctagaaacgctcagagttgtacatgatttatgggtaaaacatggtgatttctcagaaatccacttagagctcggtagagatataaaaaactccagtgataaaagaaaaagaatggcggagcgacaacaagaaaacgagaattcacgacaaagagtactagaaatgttgattgacctgaaaaaagaagcagcctttgccgatttaaacccttattctccatctcagcaagaaaaactacggattgtagaagatggtgtcctaaggtccaacatagaaatcccaaaagatatagaaaagataacaaaatcagcaaaaccaacttcacgtgaattaacaaaatataggttatggctagaccaaaagtatcgatccccttacaccgggcaacccataagtctcgcacaactatttacttcaaagtatgaaatagaacacgtcataccacaagcaaaatatttcgatgactccttcaccaataaagtaatatgtgaaagcgaagtcaacaaagagaaaggaagtatgttagcacacgaatttattttaaaaaacggaggaagtactgtaaatgtcggaggaagacaagtacaagtgctaaaaaatgacgcatacgtagaattaataaaccgactatatggaaaaaacaacccggtcaaagcaaaaaaattgctcgcagaagacatcgatgaagtagttggcgacttctctgagcgccaattaaacgacacaaggtatataagccgtgtagttcaaaaattactaagtaacattgttagagaagaggacgaacaagagagtacttcaaagcatgtaatagggtgcagtggccaagtaactacagcgttaaaaaaagattggggccttaacgacatatggaataaaataattcaacccagattcgaacgtttaaacgagatgacagctaccgaagattacggcgtgtggcaaagtccaaatcactttcaaataagggtaccagaagaaatccaaaaaggatttacgaaaaaaagaatcgatcacagacaccatgcaatggacgcattggtaatagcttgtgcgactcgaagtcacatcaactatatatcgaaccgttcaggacaagatagaaatgcgaaatttgaaaccacgagaaccgatttaagatcaaaactttgctataaagaaaattcgagtggaaacaactacaactatatattcaataagccatgggatacgtttacacaagacgcccaccgagctctagaaaatattgttgtaagccataaacagaacttaagagtgttaacaaaaacaaataattatacgcaattcataaacaaagacggcaaaaaagatctacaaaagcaggtcaagggtgaccactttgcagtacgaaaaccaatgcaccaagaaacaatatacggaagggttagcattaggagtattaaggaagtcgccctaaaaaaagcgctggagaattggaaacagatagtagacaggacccttaaagacaagataagagaactgataggagcctacggaaaatatgacgcacaaacaatattaaaatattttaaagatagggactacaaatttaacaacctgaagataaaccgagttgaagtttatgaatacgatcacaactgcgccgctgtaaggaaatcaataggagacgatttgactataaaacaaatagagaggatcaccgatgaatcaataagaaaaattctgatgaatcacttatcaaactacgatgataacttaaaagaagcattctcacccgaagggttaatggaaatgaataaaaacataaaagaactgaacggaggcaaaaatcaccaaccaatttataaagtaagactatttgaggatctaggtagtaagtttccattaggagtctcacataacaaccccgataaatacgctatagccgccaaaggaacgaacctattttttggtatctacgaagatcaagaaggaaaacgaatgttcgattctattccactaaacatagtaattgatcgattaaaggagaaaaaatcaccagtccccgaaacctacaacgaatctaaattgaaattccacctcagtccaaatgacctagtatatgtccctacagacgaagaacaaaagcaacctgagctagtcgacgtagatcacttatcagatgaacaaaaaggtcgagtgtacaaagcggtctcattcactgggaatagagcattttttgtaaatcacagagtaagtaaagtaatacatgattacgtagaattcgggacaaaaaataaaatcgaaaacgacgacgacaaacgaagtctaaaacacatatgctggaaattgaaagtcaacagattgggggaaataacggatgtcaaacgatga

SEQ ID NO: 5739 - RNA, 4515 nt, synthetic construct
  misc_feature 1..4515: note = Cas9 variant
  source 1..4515: mol_type = other RNA
atgaaaaacatagttggactggatctaggaacaaatagcattggatgggctgtagtaaacggttcggtaaacgatgatggttcagaacagttagtcaagattcaagcatcaggcagtagaataatccccatggatgcggccatgataggggattttaataaaggaaattcgataagccaaacagcagaaagaactagactacgaggcgtcagacgcttatctgagcgatatttactaagacgggaacgattacatagaatattggacattctaggattcctcccttttcatttcgcacaagacttagatagacatggtaaaatagttaaaggtaaagaacctaaattagcttggagaaagaacgaagcaggtcaatttgaatttatatttcaagatagcttcaaagagatgttagaagacttcaaactaaattacccgaacctaataactgatgataaaaaggtcccatacgactggacgatttattacctacgtaaaaaagggttaactagtaaaatatcgaaagaggaactcgcatggatattattaaactttaatcaaaaacgtggatattaccaactaagaggagaagaagaagaggaaaacaaagataaattggtagaattttatgccctaaaagtagtcgccgtagaagacagtggagaaaaaaaaggcaaagatatttggtataacgtacacttagagaatggatgggtataccggagaacaagtaatatgtcactcgattgggtaggaaaaacaaaagaatttatagtaacgacagacctagagaaagatggaacaccgaaaaaagataaagagggaaacgtaaaaagatcatttagagctcccaaagaagatgattggtcattagttaaaaagaaaactgaggctgatatagatcaaacacacaaaacagttggagcttacatatatgatacacttctgggaaacccatcacaaaaaataagaggaagactcgtaagaacaatagaaagaaaatactacaaagaagaactgaaactaatcctggagaagcaaaaagaattccatctggagctccaggatcgcgccttatacgcggcttgcatagaagaactgtacccaattaatgaagcacatagaaacaacgtaggaaaccgagactttacttacctgtttctagaagatattctattctatcagaggccacttaagagtaaaaaaagtctcattgataactgtccgtatgaagaaaaccaaggccttgacaaagaaacaggagaaatcaaaagttttccagtaaaatgcatagcaaaaagccacccattattccaagaattcagactctggcaatttatcatcaatctaagaatatataggaaagacctagctcaagacgtagacgtaaccaacgaattactaaaaactgaagaagattatgtagcattattcgactggttaaatggaaaaaaagaaatagatcaaaaagccttcttgaaataccccgttttcggcctcaaaaaagagatcgaaaactataggtggaattacgtacaagacaaaccatatccttgtaacgaaacacggagcttaatgctagctcgattagaaaaatgtgacatctcaatagagtttttaactaaagaaaatgaagaagccttgtggcacatcctatatagtgtagaagataagaacgaaattgttaaagcattgcaaaaattcgctgataaacacgatctaaacgcctcttttgtggacgtattccaaaaattccctccttttaaaaaggagtatggaagttacagcgctaaagcaataaaaaagctcttaccactaatgaggatgggaaaatactggagtgaaaacagcatagacaaaggaaccagagaaagaatagacaaaattataacaggagaatatgatgaaaaaatagaaaacagagtacgagaaaaagcaattcatcttgccgatgtgagtgacttcaaaggtctaccactatggctcgtatgttacatagtctatggaagacatagtgaagcgaaagaaataatacaatggaaaagcccagcagatatagatagttacttacgtagcttcaaacaacactccttgcgaaatccaatagtcgaacaaattataatagaaactcttcgagtggttagggacatatggaaacaagtaggcaatattgacgaaatacacgtcgaactgggccgagaaatgaaaaatcctgcagataaacgaaaaaagatgacacaacaaatgtcagaaaatgagaatacaaacctaagaataaaatacctattaactgagtttttaaatcctgaatacgaagtcgaaaatgtaagaccatattccccatcacaacaagatatattacgaatatacgaagaaggagtattaaattccgttagtgatttacccgaagaaatatcagacatcctaaaaaagtttacggaaacagacctcaaaaaaagaccttctcggtcagaagttctaaggtacaagctatggctcgagcaaaaatacagaagtccatacactggcgaagttattccattaggaaaactctttacgccagcctatgaaatagaacacgtaataccacagagttattatttcgatgattcattttcaaacaaagtgatttgtgaagctgaagtgaataaattaaaaagtaatcttctaggacatgaatttatagtaaaacaccacggagaaatagtagaacttcctttcggaaaaaaagtgagaatattcacagtagatgaatacgaacaatttgtaaaagataattattcgcgaacaagatcaaaaatgaagaaattattgatggatgacatcccggaagaattcgtcaccaggcaactaaacgactcaagatatattagtaaagtagtcaaaagcctactctccaacatagttagggaaaaaggcgaagaagaagcaatatcaaaaaatgttatcccatgtacagggggagtgacagatagactaaaaaaggactggggcataaacgaagtttggaacaaaataatactgccacgttttcaacgattaaacgagttaacaggcactaataaatttacaacaaaaaatgtaggaatccaagaaatccctacaatgccactagagctgcaaaaaggattcaataagaaaaggattgaccaccgtcaccacgctatggatgccataatcatcgcctgtgctaatagaaatataataaactacttaaacaacaaatcagctacagctaaagcagaattgtcacgatacgatctacaaaaaatgttatgtgataaagcaaaaacagataacaatggtaattacaagtgggtaataagaaaaccatgggcgtcatttacacaagatacatacctcgcactagaaaacataatagtatcgtttaagcaaaacttacgtgtaataaataaagcaaccaatcgatttctacactacaacgaagaaggaaaaaaaatatttgtaaaacaaggcaaaggtgacaattgggcaatacgaaaatccatgcataaagacacagtatttggagaagtaaatctacgacggattaaaacggtcgctctaaacgaagcaatgaaaaatccacaaagtatcgtagtcaaagacttcaaacgaaaattactagaattatggaatctaggctttgatgctaaaagaattaaaaaatatttcgaggacaaccgcgaaacctggtcggacattaatctgagcaaaatagaagtatattatttctcaaaagataccaaagatcgcttttttgctacccgtaaacccttagacactagctttgaccgaaaaaaaatagagaataatatcactgacacgggaatacagaaaatattattacggcatctagaactgaaagataacaatccagatattgcattctcacctgatggaatagatgagatgaatagaaacatcatacaattgaacaacggaaaataccaccaaccaataattaaaattcgttggtacgagcaagccgataaatttgcagtaggacagacaggtaataaaagtagcaaatttgtcgaagccgcaaaggggactaatttattttttgctgtttatgagtccaatatactagacaaaaaaacaaacacaattataaaaaagagaaactatgcaacaattcccctaaacgtggcaatagaaagacaaaaacaaggcttaccggtagcgcccgaggacgaaaatggcaacgatccaatcttcgtattaagtcctaacgatttagtatatctaccaacggatgatgaattagcaaatggaatcatcgcccaacctctagataggggaagaatatataaaatggtaagcagttcgggcgaacaatgtttcttcataaaacatatagttgctaatgtactcgtcgataagtttgaattttccccgctaaataaaatggaaagagctctaacgggagaaatgataaagatgatttgtataccaatcaaagttgacagactcggcaatgttttagaatcctcatcgtcatacaaaaaatga

SEQ ID NO: 5740 - RNA, 4515 nt, synthetic construct
  misc_feature 1..4515: note = Cas9 variant
  source 1..4515: mol_type = other RNA
atgaaaaatatagtaggactagacctgggaaccaactcaattggatgggcagtggtaaatggtagcgtaaacgacgatggatcagaacaattagttaaaatccaagctagcggtagtagaataataccgatggacgcagcaatgataggagacttcaataaaggcaactcgattagccaaaccgcagaacgaactcgacttagaggcgtacgaagactatccgaaagatatcttttacgaagagaacgtctacaccgaatccttgatatacttggtttcttaccgttccattttgctcaagatcttgatcgccatggaaaaattgtcaaaggaaaagaaccgaaactagcctggagaaaaaatgaagcaggacaattcgaattcatattccaagattcttttaaagaaatgctagaagactttaaactcaatcaccctaacctcataaccgatgacaaaaaagtaccctatgactggacaatttattatttaagaaagaaagggttaacgtcaaaaatatcaaaggaagaattagcatggattttacttaatttcaaccaaaaaaggggttattatcaattaagaggagaagaagaagaagaaaataaaaacaaactagtggaattctacgcgctaaaagtagtagcagtagaagactcaggagaaaaaaaaggaaaagacatctggtacaacgtgcatcttgaaaatgggtgggtttataggcgcacatccaacatgcccttagactgggttgggaaaactaaggagtttatagtaactactgatttagaaaaggacggaacacctaaaaaagataaagaaggaaatgttaaaagatcattccgagccccaaaggaggatgattggagccttctaaaaaaaaaaacagaagcagacatagatcaaacacataaaaccgtaggagtctatatatatgacacattactcggaaatccctctcaaaaaatacgaggaaggctagtccgcacgatagaacgaaaatattacaaagaagagttaaagcaaattctggaaaaacaaaaagaatttcatctagaactgcaagacagagcactatatgcagcttgcatcgaagaattatatccaattaatgaagcacaccgcaacaatgtaggcaaccgtgactttacatatctgtttttagaagatatccttttttatcagcgaccactcaaatctaaaaaatcattaatcgataattgcccatatgaagaaaatcaaggtctagataaagaaaccggcgaaattaaatccttcccagtaaaatgcatagcgaaatcacatccattatttcaagaatttcgactatggcaattcatcgtcaatctacgaatatataggaaagatttagcacaagacgtagacgttaccaacgaattactaaagacagaagaagattacgtagcgttatttgattggctaaacggtaaaaaagagattgatcaaaaggcattcttaaaataccctgtttttggcttaaaaaaagaaatagaaaattaccgttggaactatgtacaagataaaccatatccctgcaatgaaactagaagtttaatgctggcacgactcgaaaaatgtgatatatcaatcgaatttcttacaaaagaaaacgaagaagcactatggcatatactgtactcagtagaagacaaaaatgagatcgtaaaagcattacaaaaattcgctgataaacacgatctgaacgcctcctttgtggacgtattccaaaaatttcctccatttaaaaaggaatacggtagctatagtgccaaagcaataaaaaagctgctaccgttaatgagaatgggtaaatattggtcagagaatagtattgataaaggaacacgtgaacgaatcgacaagatcataacaggagaatatgatgaaaaaatagaaaatagagttagagaaaaagcaatacatttggccgacgtctccgactttaaaggacttccactttggctcgtatgttacatcgtgtatggcagacactcagaagccaaagaaataacccaatggaaatccccagctgatatcgactcttatttaaggagttttaagcaacattcactgagaaaccccatcgtagaacagataattatagaaacactaagggtagtcagagatatatggaaacaggtaggcaacatcgacgagatacacgtcgaacttggaagagaaatgaaaaacccggcggataaaagaaaaaaaatgacccaacaaatgtcagaaaatgaaaatactaacctaagaattaaatacctcctcaccgagttcctgaatccagaatatgaagttgagaacgtaagaccatattcaccaagtcaacaggatatactaagaatatatgaagagggtgtgctaaactcggtatcagacctaccagaggaaataagcgacatcctaaaaaaattcactgaaacagacctgaaaaaaagaccaagtagatccgagatattacgctacaaactatggttagaacagaaataccgatcaccatacacaggcgaagtaatcccattaggaaagttattcacaccagcatatgaaatagaacacgttattccacaatcctgttatttcgacgactcattctcgaataaagtaatttgcgaagccgaagtcaataaactaaaaagtaacctattggggcacgaatttatcgttaaacatcacggcgaaatagtcgaacttccatttggcaaaaaagtaagaatattcactgttgacgaatatgaacaattcgtgaaagataactatagtcgaactagaagcaaaatgaaaaaattactaatggatgatataccagaagaattcgtgacgagacaactaaacgactcaagatatatatcaaaagtagtaaaaagcctactatcaaatattgtaagagaaaaaggagaagaagaagcaatatcaaaaaatgtaataccctgtaccggaggagtgacagatcgcttaaaaaaagactggggcataaacgaagtatggaacaaaataatactaccacgctttcaaaggctaaacgaattaactggtacgaataaatttacaacaaaaaacgtcgggatacaagaaattccgacaatgccactagaacttcaaaaaggcttcaacaaaaagcgaatagaccaccgacatcacgcaatggacgcgattattatagcctgcgccaatcgcaatataataaactatttaaacaatgagtcggcaacggcaaaagcagagctaagcagatatgatttgcagaagatgttatgtgataaggcaaagaccgataacaatgggaattacaaatgggtgataagaaaaccatgggcatcattcacacaagacacataccttgcattagaaaatatcattgtatcatttaaacaaaatcttagagtaataaacaaagcaacaaatagatttctacactataacgaggagggaaaaaaaatatttgtcaaacagggaaaaggagataattgggcaataagaaaaagtatgcacaaggatacagtattcggagaagtgaatcttagacgtatcaaaacagtcgcactgaacgaggccatgaaaaacccacaatctatagttgtgaaagacttcaaacgcaaactattggaattatggaacttaggatttgatgccaaaagaatcaaaaaatacttcgaagacaacagagaaacctggtcagatataaatcttagtaagattgaagtatactacttctcaaaggacacgaaagatagatttttcgcaaccagaaaacctctcgacactagtttcgacagaaaaaagatagaaaacaatataacagatacaggaatccagaaaatattacttagacatctagaattaaaggacaacaatccggacatcgcatttagcccagatggaattgatgaaatgaacagaaacattatacaactaaacaacggaaaataccaccagcctataataaaaatacgatggtatgaacaagcggataaatttgcagtaggacaaacaggtaacaaattttcgaaattcgtagaagccgcaaaaggaacaaatttattcttcgccgtttacgaatcaaacatactggataaaaaaacgaacacaattatcaaaaagagaaattacgcaactatcccactaaatgtagccatagaaagacaaaaacaaggacttccagtagcacctgaagatgaaaatggcaacgatccaatatttgtcctatcccccaatgatctagtatatcttccaacagacgacgaactcgccaacggtatcatagcacaaccattagatcgaggtagaatatacaaaatggtcagttgtacaggaaacgaaggacatttcatacctgcaagaatagccaacccgatactgcagactatagaactaggctccaataataaagcccaaaaagcatggactgacgaaatgataaaggaaatatgcatgcccattaaagtagaccgactaggtaacgtattagaatcaagttcatcgtacaagaaatga

SEQ ID NO: 5741 - RNA, 4521 nt, synthetic construct
  misc_feature 1..4521: note = Cas9 variant
  source 1..4521: mol_type = other RNA
atgaaaacaatattaggactagacttaggcccaaattcaattgggtgggcaaaagtggaagtcgacgatgaaggaaactacctcaggaacataaaacttggatcacggataataccgatgactcaagacatgctaggagattttgacaagggagtgaaggtgtcgcaaaccgccattagaacagattttagaggcaacagaagactcatagaaagacacctactcaggcgagaaaggcttcatcgagtcttacatgcattaaaattcctgcctaaacactacgaagatgccataggatgggacagaaacgaaccagcaacatatggcaagtttgtaaataactcagaaccaaaactggcttgggaaagacaggaagacggctcaatgaggttcttatttatggagtcattcaacgaaatggtcgcagattttgcccagaaccaaccgtcattagtctcagacgggaagaaaataccattggactggacgatttactatctaagaaagaaagcattaacacgcccaatcaagaaagaagaattagcatggatcttactaaatttcaatcaaaaacgggggtattatcaattaagaggtgaagaagaagaagacaacctaacaaaacgaaaagaatattataaactaaaagtagtaggagtagaagcagatggtgcaccgaaaggtgggaaaacctggtataatatccaccttgaaaatgggtggacagcacgctgccagtctaaaataccactagacgattgggtcggaaaagtaaaagaatatatagtaacaactgagtatgaagacgacggcaaaacacccaaatgtgacaaagaaggaaaggtcaaaagatccttcaagagcccggagaaagacgactggcagttaatcaaaacaagaacagaaaaatttatagatgatagtaacaaaacagtaggtgcattcatatatgactatctactcgaaaaaccgttcgataaaataagaggcaaatacataaggaccatcgaaaggaaatattacaaaaatgaactaagagaaatattaagagaacaaaccaaataccatgagggattacacagtctagaagcattaaaaatatgcgctgaagaattatataaaaataaccaacaacatcaagaatacttattaaagaaagacatgacatttttgttattaaatgacctaatattttaccaaagaccactaaaatccaagaaaagtttgatagcggactgtccttatgaagtttacaaatatgacgacaaattaacaggtaagaaaggacaaaagaaaataaaatgcatagcaaaatccaacccatattatcaagagttccgcttatggcaatttatcgccaatttaagactcttttcagtcacagatggcaaagaagtgacggcagaatatcttaaaacggaagaagattatgtaagactattttcctttttaaacgacagaaaagatattaaacaagagacctttttacgatcgtttctaaaactgaagaaagaatccataggatctgagaaaatatacccaataagatggaattacatagaagacgcaaacaaatcgtatccatgtaatgcaactcgccatgaactacttttggcatttgaccgggcagatattcctagagaattactagatgtcgaagaacgtgaatacaggctctggcacttattgtatagtatagaagctaaagaagaaactgaatcagcgctcaggaaactaaaagcaaataaagcatttggagatctgaacattgacgatgcgtttgtaaactccttcttaaaaataaaaccattcgaaaaagaatatggagcatattcggagaaagccataaagaaattgctagccgtaatgcgaagagggagcctctggaaagaggcagatatatgtgaagcaacaaaacaaaacatagcaaaaatactacaaaacgacattgatgaaaaattaaagaagaaaattgaggcagcagtctcctcttttaataaattaagcgactttcaaggactcccaacatggctagcatgctacgtcgtttacggtagacactcagaagcagcacaaatacaatgctggcaatccccagaagaccttaaaacctatataaataaatttaaacaacacagtctaagaaacccaattgtagaacaatgcttattagaaacgttaagaactgtttatgatatatggaaagatgccggtcaaattgatgaaatacacattgaattaggaagaaacatgaaatcaactgctgaacaaagagcgcgcaaaactaaagacatcctccgaaatgaaaatacaaatcttagaattaaaaacttattagtagaacttaaaaacgacgataaaatagaaaacgtacgaccatattctccgagtcaacaagaaatcttaagaatttacgaagaaggtgcgctgcaagaattatcaaaagaagatgaaatgtttgaagacattagtaaaatctccaaaatggcacaaccgtcacccacagaattatcgaggtataaactatggttagaacaaaaatatagatcaccatacacgggaagagtcataccactaagcaaactattcacaacagcgtaccaaatagaacacataataccacaatcgcgttatttcgatgatagctttaataataaagtcatatgcgaatcagaagtaaactcattaaaagataatatgcttggatacgagttcataaaagaatgtggaggacggatagtccactgtacattactaggagatgtgaagattttcacgaaagaagaatataaagatttcgtaaccaaacattacatagataatacatataaaagagacaaacttctactcgaagacataccacaagagttcagtgcccgacaattaaacgattctcgatatatctcgaaaatggtacaaacagtccttagcaatattgtacgagcagaaaacgaacaagaagcaacaagcaaattcgtagttagctgcaatggcgcaataacaaaccgacttaaaaaggattgggggttgaatgatgtttggtcatcaattgtgtgtcctcgatttaaacgtctaaacgaaataaccaagacgaatgcctttgggcattgggaagacaaagcaggaaaacatgtatttcaaacaacggttccactagaattacaaagaggttttagtaagaaaagaatagaccaccgacatcatgcaatggatgcactggtgatagcatgtgcatctcgaaatattgtaaattatctcaacaatgaatcagctaacagtccagaaaagagggaagatctaagaaagaaactatgtgacgaaaaacgaaaaatacgtaaaccatggaaaacatttacgcaagatgcaagagaagcgttaagcgatgtcgtcgttagctttaaaaattacgtacgcgttatcaataaagctacaaattattacgaacactatagctcatcgggtaataaagtcatgatctcccaaaaaggaaacgacatgtgggcgataagaaaaccactacacaaagaaagcgtttttggccgagtaaatctctgcagaaaagtaattgtatcactcaagaaagcactggagaatatccccgcaatatgcgataaaacactacgagattacatcaacgctttagtagaaaaacactttaacacaaggcagcttctggcccactttaaatcaataaactaccgattaaatagacaatgcgtagaaaaagtagaagtatggcaattctccgatgagaaaatagaaatggtagcaaggaggaaatctttagacacgtcatttgacgataaacaaatatcaagtatcacagacaccggcatacaaaagattttactaaattatcttcaaacaaaagacggcaatgcagaaattgcgtttacaccggaaggaatcgaagaaatgaacaaaaacatttccttgtacaatgatggcaaggctcatcaaccaatactgaaggtacgagtggcgaccccaaagggcatgaaatatccagttggccaaacaggcaataaagcgacaaaatttgttgttgctgaaaaaggtacgaatctatacttcgccatatatgaaaatgaactcggagtacgttcatatgatactatccccctaaacatagtcgttgaaagactcaaagaaggcttatcaccagtaccacaagccaatgaagctgatatacccctaaaattttatttaagtcccaatgatctggtatacgtaccaacaaaagaaaatgaagacgagctgtgccgtgatagaatatacaaattcgtagatagttcaggaacaactgccaatttcgttccccacaccagtgccaatactatatacaatgtagacaaagagtatgcagagaaatgctgcaacggtgctgtattcttaaacgagtacggattaggttcaccacaatccaaaaaccaaagagcattaactggagaaatgataaaagaaatctgctggaaattaaaagtagataggctcggaaacataataaaagtgataaaatga

SEQ ID NO: 5742 - RNA, 4530 nt, synthetic construct
  misc_feature 1..4530: note = Cas9 variant
  source 1..4530: mol_type = other RNA
atgaaaaatatagtaggactagatctgggtaccaatagcataggatgggcggtagttaatggtagtgttaatgatgacggtagcgaacaattagtaaaaatacaagcatcgggttcaaggattatccccatggacgcggcaatgataggagatttcaataagggaaactcaatatctcagacagccgaaagaaccagactgcgaggagtacgcagactgagtgaacgttatctcctaagacgagaaagactgcacagaatactcgacatactaggttttttaccattccacttcgcgcaagatcttgacagacatggaaaaatcgtaaaaggaaaagaacccaaacttgcgtggagaaaaaacgaagctggccaattcgaatttatattccaagactcgtttaaagagatgcttgaagatttcaaattaaatcaccccaacttaattacagacgataaaaaagtaccatatgattggacaatttattatttaagaaaaaaaggtctcaccagcaaaatatcaaaagaagaactagcatggatattattaaatttcaatcaaaaaagaggctattatcaactgagaggagaggaagaaaaaaaaaatgataacgtaatgatcattaattccaaggttatagatgtggtcaaagcagagaaagataagaaatatgaaaaatactggtacaacgttttactagagaacggcttattataccgagcagcattctataatgatatcagtttctggaaaggccataccaaagaattcgtactaaaaaccatcaagctaaaaagcggggggaccaaacaagaactaagtttcttaccaagttttgacgaaatagaaaagatggaaaaaaaacaaaaagacaagatgtactttaaaataaaattaaaaacagaagctgatatagaccaagctcacaaaacagtcggaacttacatatacgataccctactaggcaatccttcccaaaaaattagaggcagattagtccgaactatcgaaagaaaatattataaagaagagctaaagttaatattagataaacaaaaagaattccatccggaactccaagatagagcgctatatgcggcttgtatcgaagaactatatcctataaatgaagcccatcgaaataacgtcggcaaccgagatttcacgtatttattcttagaagatatcttattctaccaaagaccgttaaaaagtaagaaaagtctaatcgacaattgtccatacgaagaaaaccaaggcctagacaaagaaacaggagagataaaatcatttccggtaaaatgtatcgctaaatcccatccactgtttcaagaatttagattatggcaatttatagtaaacttacgcatatacagaaaagacctagcacaagatgtagatgtcacaaacgaattattaaaaaccgaggaagactatgttgcactattcgactggctgaacggtaaaaaagaaatagaccaaaaagctttcctcaaataccctgtctttggactaaaaaaagagatagagaactacaggtggaattatgtacaagacaaaccatacccatgtaatgaaacaagactcctaatgttggcccgtctagaaaaatgcgatataagtattgaatttttaacgaaagaaaacgaggaagctctatggcatatattatattccgtagaagataaaaatgaaatagtcaaagcactgcagaaattcgcggacaaacatgatttgaacgcatccttcgtcgatgtcttcagaaaatttccaccctttaaaaaagaatatggatcttactcagctaaggccataaaaaaattgctacccctaatgcgaatgggaaaatattggtcagaggactcaatagacaagggaacacgaaagcgcatggacaaaataattacaggggagtatgacgaaaaaatagaaaatagagtaagagaaaaagtgatacatctagccgacgtaagcgatttcagaggattaccactttggttagtctgctacattgtctacggacgccactccgaagcaaaagagataactcaatggaagtcccccgcggacatagattcatacttaaaatcatttaagcaacactcgttaagaaacccaatagtggaacaaataataatagagacattaagagtagtgagagatatatggaaacaagttgggaatatagatgaaattcatgtggaacttggaagagaaatgaaaaatcccgcagataaacggaaaaaaatgacacaacagatgtcagaaaacgaaaacacaaacttaagaatcaaatacttacttacagaatttttaaaccctgaatacgaagttgagaatgtacgaccttacagtccatcacaacaagacatattgcgtatctatgaagagggagttcttaactcagtgagtgatcttccagaagaaataagtgacatactcaaaaaattcaccgaaactgatctcaaaaagcgaccgtctcggagtgaaatattacgatacaaattatggctagagcaaaaatataggtcaccatacacgggggaagtaataccattgggaaaattattcacccccgcttatgaaatagagcacgttataccacaatcatgttatttcgacgacagtttcagtaacaaagtaatatgcgaggcagaagtaaacaaacttaaaagtaatctcctaggacacgaatttatcgttaaacatcacggcgaaatagtggaattaccatttggcaaaaaagtaagaatatttacggttgacgaatacgaacaatttgtcaaggacaactattcacggaccagaggaaagatgaaaaaactactaatggacgacattcctgaagaattcgtagccagacagttaaatgactccagatacatatcaaaagttgtaaaaagtctattgtcaaatattgtccgggaaaagggcgaagaagaagctatttcaaaaaacgtaataccttgcacgggaggtgtaacggatagattaaaaaaagactgggggattaacgaagtttggaacaaaataatacttcctcgttttcaaagactaaacgaactcacaggaacaaataaattcacaacaaagaacgtaggaatacaagaaatacccacaatgccattagaactacaaaagggttttaacaaaaaaagaatcgaccatcgacatcacgcaatggatgcgattataattgcttgtgccaatagaaacataatcaattatctaaacaacgaatcggcgacagcaaaagcagaactttcaagatacgacctacaaaagctcctatgcgacaaagctaaaacagataacaatggaaactacaaatgggtcataagaaaaccttgggcatcctttactcaagacacatacctagcactcgagaatataatcgttagcttcaaacaaaatctaagagttataaacaaggcaaccaatcgcttcctacactacaatgaagagggcaagaaaatattcgtaaagcaaggcaaaggggacaactgggcaataagaaaatcaatgcacaaagatacagtattcggagaggtaaacttaagaagaataaaaacagtagcattaaatgaagccatgaaaaacccacaaagcatagtagtaaaagacttcaaacgaaaactactagaattatggaacttaggattcgacgcgaaaagaataaagaaatatttcgaagataaccgagaaacttggagtgatattaacctcagcaaaatagaagtatattacttcagtaaagatacaaaagaccgatttttcgccactagaaaacctctcgatacatcgttcgacaggaaaaaaatagagaacaacatcacagataccggaatccaaaaaattttacttagacacctagaattaaaagacaacaacccagacatcgcattttcacccgacggcatagatgagatgaacagaaacatcattcaactcaataatggaaaatatcaccaaccaattataaagatacgttggtacgagcaagctgacaaattcgctgtcgggcaaacaggaaataaattttcaaagtttgttgaagcggcaaaaggtacgaatctcttcttcgcagtatatgaatcaaatatattagacaaaaaaacaaacacaatcataaaaaaacgtaactacgcaactattccattgaacgtagcaatagaaagacagaaacaaggattaccggttgcaccagaggacgagaatggaaatgacccgatattcgtgctaagtcctaatgatttagtttacctaccgaccgatgatgaactcgccaatggaataatagcgcaaccacttgacagaggaagaatttacaaaatggtttcttgcacagggaatgaaggtcacttcataccggcgagaatagcaaacccgatattacaaacaattgaattaggaagcaataacaaggcccaaaaagcatggacagacgaaatgataaaagaaatatgcatgccaattaaggtagacagattaggtaacgtactagaatcgtcttcgtcatacaaaaaatga

SEQ ID NO: 5743 - RNA, 4530 nt, synthetic construct
  misc_feature 1..4530: note = Cas9 variant
  source 1..4530: mol_type = other RNA
atgaaaagaatattaggactagacctcggaacaaattcgataggctggtcgctgatagaacatgactttaaaaataaacaaggacaaatagaaggcctaggtgttcgaatcataccgatgtcgcaagaaatattaggaaaatttgatgcaggacaaagtattagtcagactgcagaccggacgaaataccgtggcgtaaggcgactatatcaaagagataacctacgacgtgaacgattgcaccgagtacttaaaatcttagatttcctcccaaaacattacagtgaatcaatagacttccaagataaagttggacaatttaaaccaaaacaagaagtcaagctcaattacagaaaaaacgaaaaaaataaacacgagttcgtatttatgaacagctttatagaaatggttagcgagtttaagaatgcacaaccagaactattttacaataaaggaaacggggaagaaacaaaaataccgtatgattggacgctatattatctcagaaaaaaggcactaacccaacaaataacaaaagaagaattagcatggctaattcttaatttcaaccaaaaaagaggatactaccaactccgtggcgaagatatagacgaagataaaaacaaaaaatacatgcagctaaaagtaaacaacttaattgacagcggtgcaaaagtaaaaggcaaggtattatataacgtaatatttgacaatggatggaaatatgaaaagcaaatagtaaataaagacgagtgggaaggccgaacaaaggaattcataataacaactaagaccttaaaaaacggaaacattaaaagaacgtacaaagcagtagattcagaaatagattgggcagcaataaaagcgaaaactgaacaagatataaataaagcaaacaaaactgtaggagaatacatatatgaatcactgctcgataatccaagccaaaaaatccggggcaaattggtgaaaactatagaaagaaaattttacaaagaagaattcgaaaaactactttcaaaacaaatagaacttcaaccagaattatttaatgaaagcctctacaaagcatgcataaaagaactgtacccccgaaacgaaaaccatcaatctaacaataaaaaacaaggattcgaatacctttttacggaagacataatattctaccagaggccgctcaaatcacaaaaatctaatatcagtggctgtcaattcgaacataaaatatacaaacaaaagaataaaaaaactggcaaactagaattaataaaagaaccaataaaaaccatatctagatcacacccattatttcaagagttccgcatttggcaatggctacaaaatctaaaaatatataacaaagaaaaaattgaaaacggaaagctcgaagatgttacaacccaacttttaccaaacaatgaagcgtatgttacactatttgatttcctaaacacaaaaaaagaattagaacaaaaacaattcatagaatacttcgtaaagaaaaagctcatagacaaaaaagaaaaagaacatttccggtggaatttcgtagaagataaaaaatacccatttagcgaaacaagagcacagttcctatcaagacttgccaaagtaaaaggaatcaaaaacaccgaagattttctaaacaaaaatacacaagtaggtagcaaagaaaattcaccatttataaaaaggatagaacaattatggcatataatatacagcgtttcagatttaaaagagtatgaaaaagcactagaaaagttcgccgaaaaacataatttagagaaagacagctttctaaaaaatttcaagaaattcccgccatttgtttctgactacgcatcatactctaaaaaagcaataagcaaactattaccaataatgcggatgggaaaatactggtcagaatcggcagttcctacgcaagtcaaagaacgatctctttctataatggaaagagttaaagtcctgccgctaaaagaaggatacagcgacaaagatttagctgacctccttagccgggtaagtgatgacgacataccaaaacaactcatcaaatcatttataagctttaaagataaaaacccattgaaaggtctaaatacatatcaagccaactatctagtgtacggacgacattcagaaactggggatattcaacactggaaaacacccgaagatatagataggtatttaaataacttcaaacaacactccctacgcaacccaatagttgaacaagttgtaatggaaaccttaagagtagtacgtgacatatgggaacactacggcaataatgaaaaagacttcttcaaagaaatacacgtggagctaggaagagagatgaagagccctgcaggcaagagagagaaattatcacaaagaaacaccgaaaacgaaaatactaaccacagaattcgtgaagtactaaaagaactaatgaacgacgctagcgtggagggaggcgtacgagattattccccctcccaacaggaaatactcaagttatacgaagaaggcatttaccaaaaccccaatacaaactaccttaaagtcgatgaagatgaaatcctaaaaataagaaaaaaaaataacccaacccaaaaagaaatacaaagatacaagctatggttagaacaaggttacatcagcccgtacacaggtaaaataatcccactaacaaaactgtttacacacgaataccagatagaacatatcataccccaatcacgatactatgataatagtcttgggaacaaaattatatgtgaatcagaagtcaatgaagacaaagacaacaaaaccgcttatgagtacctaaaagtagaaaaaggaagtatagttttcggccacaaactactcaacctggatgagtatgaagcacacgtgaacaaatacttcaaaaaaaacaaaaccaagttgaaaaacctcctaagcgaagacataccggaaggattcatcaatagacaattaaacgattcccgctacataagcaaactcgttaaaggattattatcaaatatcgttcgagaaaacggtgaacaagaagcaacatccaaaaacttaataccagttacaggtgtagtaacctctaaactcaagcaagattggggcctcaatgacaaatggaatgaaataatagcgccaaggttcaaacgcttaaacaaactaactaactcaaacgactttggattttgggacaacgacataaatgcatttagaatccaagtacccgacagcttgataaaggggttttcaaaaaagcgaattgaccatagacatcatgcgttagatgcacttgtcgtagcatgcacatcaagaaaccacacacattacttaagcgcactcaatgcagaaaacaaaaattactcactccgggataaattagtcataaaaaacgagaacggtgactacactaaaacctttcaaataccatggcaaggattcacaatagaagccaagaacaacctcgaaaaaacagtggtgagcttcaaaaaaaatcttcgcgtaataaataaaacaaacaataaattttggagctacaaagacgaaaatggcaatctgaacctaggaaaagacggcaaacccaaaaaaaaacttagaaaacagaccaaaggctacaactgggcaatcagaaagcctttacacaaagaaacggtgtccggcatctacaatataaatgcaccaaaaaacaaaattgcaaccagtgtacgaacgttactcacagaaataaagaacgaaaaacacctcgcaaaaataactgacttaagaatacgcgaaactatcctcccaaatcacctgaaacattacctaaataacaaaggtgaagcaaattttagcgaagcattcagtcagggaggaatagaagatttaaacaaaaaaattaccacactaaatgaaggcaaaaagcatcaaccaatatacagagtgaaaatttttgaagtcggtagtaagttttcaatatcagaagacgagaacagcgcaaaatcaaaaaagtatgttgaagcagcaaaaggaacaaatctattctttgctatatatctagatgaagaaaacaaaaaaagaaattatgaaaccattccccttaacgaagtaataacccatcagaagcaagtcgccggatttcccaaatcagaacgcttatcagttcaacctgactcgcagaaaggtaccttcttgtttacattaagcccaaatgacctagtatatgttcctaataatgaagagctagaaaacagagatctcttcaacctaggtaaccttaacgtggaacaaatctcaagaatatacaaattcacagacagctcggataaaacatgtaattttataccatttcaagtctcaaaattaatattcaatttaaaaaaaaaagaacagaagaaactagacgtagattttataatacagaacgaattcggattaggatccccccagagtaaaaatcagaaaagtatagacgacgtaatgatcaaagaaaaatgcataaaactaaaaatagacagactgggtaatatatccaaagcctga

SEQ ID NO: 5744 - RNA, 4530 nt, synthetic construct
  misc_feature 1..4530: note = Cas9 variant
  source 1..4530: mol_type = other RNA
atgaaaacaatactaggactagacttaggtacaaatagtgtaggctgggctgtcattaactcagttataaaggaacaagcagaaagaatctggatcgaaatggctggatcacgaataataccgatggatgcagcagtcttaggagactttgataagggaaattctatatcacaaacttctgaaagaactcgactaagaggagttaggagactcagagaaagacaattgcttaggagagaacgtttacataaagtattaaatatactaggatttttaccaaaccactacctagagtacatagatttcgaaaagcatccaggaaaatttttaagcgatgctgaaccaaaattaccttgggtaaaggacgaacaaggaaaatacacatttctctttcaagctgcatttgacgaaatgctggcagattttgccatacaccaacccagtctggtaagtggtgataagaaaataccatatgactggacaatttactatcttcgcaagaaagcattaacagaaatgatttcaaaagaagaacttgcatggatactactcaactttaaccaaaagagaggttattaccaactaagaggagaagaagaagaagacaacgcaggaaaatcggtggagttctacgcacttaaagtacttacagttgaagccaccgacgaaaagaaaggtcgcgacgtatggtacaacgtgcatctcgaaaatggatggatatatagaaggtcaagtagcgtaccattagactgggaaggtcaaataaaagaatttatagtgactactgatctgaatcctgatagtacaccaaaattagacaaatatggtgaagtgaaacgttcatttagagcacccaaagaagacgattggatgttaatcaagaaacgaacagaagccgatatagctaacactcacaaaactgtaggcgcatatatttacgatacattacttcaaaaaccgcaacagaaaattataggaaaattggtaaaaacagttgagagaaaactgtatagagacgagctatctttaattctccaaaaacagtgtgcatttcatgcagaattgcaagaccgaacattgtacgctagatgtgttgaagcgctctatccaaacaatgaagttcaacgaagaaatattgcaaatcgagatttcgtatatctactaatggatgacgttctgttctaccaaagaccactaaaaactaagaaatctctgatagcaaattgtccatacgaagaaaatgaatatgtagatcgagaaaccggcgaaataaagaaagcgccattaaaatgcatagcaaaaagccacccattatttcaagaatttcgcttgtggaacttcttaagcaacattagaatttaccaaaaagagaaagagattaatgggactctacacttagatgtagatgtaacagccgaatttcttaaaacagaagatgattacgtagctctttttgactggctcaattcaagaaaagaaattgaacagaaaacatttctcaaatatccgaaattcggcctgaagaaagaaataagtaattatcgatggaactatgtagaagacaaacaatatccatgcaacgaaacaagacatgccatactatcaagattagaaaaagctaacgtatgcatcgattttctatcgaacgagaaagaggtggctttatggcatatcctttactctgtgtccgataaacaggagatagaaaaagcattgcgaaccttcgctgctaaaaatggactggatgaaagttttgtagaagcatttaagaaatttccaccattcaaaagtgagtatggtgcatactccgcaaaagcaatcaagaaattgctcccacttatgagatgtgggaaatattgggatgtatcatctatcgatgacacaactaaagaaaggataaagaaaattgttgcaggagagtatgatgaaagaatagctgtgaaagtaagagataaagtaatgaatcttagcgacataagttgttttaaacgtttgccattatggcttgcatgttacatcgtatataatcgccacagtgaagacaaagaagcagtaaaatgggaatctccagcagacatagatgcttacttagcatcattcaaacaacactctcttcgaaacccaatagtcgaacaagtaataactgagaccctaagagtcgtaagagacatatggaaacaagtaggacgtattgatgaaatacacatcgaacttggtcgcgaaatgaaaaatccagccgacaaaagaaaaaggatgaccgcccaaatactcgagaacgaaaatgcaaatctccgaattaaagcattactggcagagttcatgaatccagaatatgaaatagaaaatgtgaggccctattctccaagtcaacaagaaattctaagaatttatgaagacatggtgctccacgcagaagaccaactccccgaagaaattgacgccatactgaagaaattcaatagttctaaagtaccaacaaaatctgagtttcttcgttacaaactatggctcgaacaaaaatacagaagtccctatacgggagaactgataccattaggcaaactattcacggcagcttatgaaatcgaacacgtaatcccacaatcaagatattttgatgactccttttcaaataaagtcatttgtgagagtgctgttaacaaattaaaagataatcagttgggatatgaatttattaaaaatcaccacggacaaaaagtagaagtaggattcggaaaaagtgttgaaatattctccgtcgactcatacgaaaggtttgtcaaagagcaatatgcaaaaagcgcagtaaaaatgaagaaaatgttaatggacgatataccagagcaatttatagaaagacaactaaatgactctagatatataagcaaagttattaaaggtttacttagtaatatagtcagggagaaaaatgatagcggcgaatatgaaccggaagcagtaagtaaaaacatagttgtgtgtaccggaagcgtgactgataggctgaaaagagattggggaatgaatgatgtctggaacagtatagtttatccccggttcgagcgattaaatagcctgacagacacacagagcttcggtcattgggaaaacaaatctggcaagaaagtttttcaaacagagctacctctcgaatatcaaaaaggctttagcaaaaagagaatagatcacagacatcacgcaatggatgccatcgttatagcatgcgcaacacgcaatcacgtaaactacctcagcaacgaatcagcatcaaggaatgccaagataagccgatacgacctccaaagactattatgtgataaatcaaggaccgatgacaacggtaattataaatgggtcattaagaaaccatgggataccttcacacaagatgctagagaagtactctcgaaaattgtagtgagcttgaaacaaaacctaagaatcataaacaaaacaacaaacgtatatagacatttggatgccacaggaaacagagtttatgaaaaacagaaaactggtgatagctgggccataagaaaaccgatgcacaaagatacagtcttcggcgcagtcaacttaagaaaagtaaaagtagtaagattgagcgtagcactagatgcaccaacaatgattgtagataaacgagtcaaaaataaagtattcgaactattaagttataaatacgataagaaacgtattgaaaaatacttcaaagaaaatgctgttttatggaaagaactggacctagccagagtagcagtatattatttcactgaggcaactaccgaacctttggtagctgtccggaaaccactggacagcacatttaatgaaaagaaaatcaaagagagcgtaacagatacaggcatacagaaaatattactcaatcatctttgcacaaaagaaggaaaaccggaccttgcattttcagcagaagggattgaagaaatgaatagaaaccttcttcaacttaataatggaaaacgacaccaacccatctataaagtaagagtttatgaacccagaggtaataaattcagtgtaggggtattgggaaacaaaggaacaaaatgggtggaagcggctaaaggcacaaatttgttctttgcgatatacattacggaggacggaaaacgaacatatgaaacaatacctctaaacatggtaatagagagagagaaacaaggtctagcaccagtaccagataaaaatgaaaaaggagataaattacttttctggctaagcccgaacgatctagtctaccttccaacagaagaagaacttgagttcgggagaataaatgaaccaatagaccgaggaagaatctataaaatggtatcttcttcaggaaatcaatgcttctttataccacaaagcatatcaaacgcgataattccgacaaaagaactaggagctaacaataaagcagaaaggtcctgggacggagccatgatcaaaaatatatgtatacctgtcaaagtcgatagattaggacgaattatagaagtgaaatatcgaataaacgaatga

SEQ ID NO: 5745 - RNA, 4530 nt, synthetic construct
  misc_feature 1..4530: note = Cas9 variant
  source 1..4530: mol_type = other RNA
atgaaaactatattaggactagacttagggactaactcagtcgggtgggccgtcattaactccgtgataaaagaacaagcggaacgcatatggatagagatggcaggcagtagaattataccaatggatgcagcagtattgggagatttcgacaaagggaactccatatctcaaacgtcagaacggactagactgaggggtgcccgtcgcctacgagaaagacaactactaagacgagaaagattacacaaagttttaaacatacttggattcctaccaaaccattacctagaatatatagactttgaaaaacatcccggaaaattcctagcagatgcagaacctaaactagcttgggtaaaagatgaacaaggaaaatacaccttcttgttccaagcagcttttgatgaaatgttagcagactttgcaattcatcaacctagtttagtatcaggagataagaaaataccatacgattggacaatatactatttacgtaagaaagcattaaccgaaatgatctccaaagaggagttagcttggatcctactaaactttaatcaaaaacgtggatactatcaattgagaggtgaagaagaagaagataacgcgggaaaatcggtggaattttatgcactgaaagttttaaccgtagaggccaccgatgagaagaaagggcgcgacgtttggtataatgttcacctagagaacggatggatatatagacgttcatcaagtgtacccctggattgggaagggcaagttaaagagtttatcgtaaccacagatctgaacccagatggaaccccgaaactcgataaatacggagaagtcaaaagaagtttcagagctccaaaagaagatgattggatgttaatcaagaaacgaacagaagcagacatagcaaacacacacaaaacagtaggtgcatatatatatgacacattgttgcagaaaccacaacagaaaatcattggcaagttagttaaaacagttgaaagaaaattatatagggatgaactatcgttaatactccaaaaacaatgcgctttccatgctgaattacaagatagagctctgtacgcacgatgcgttgaagcattgtaccccagtaacgaagtaagaaggaaaaatatagcaaacagagattttgtatatctccttatggatgacattttattctatcaaagacccttaaaaacaaagaaaagtttaatagcaaactgcccatacgaagaaaatgaatacgtagacagagagacaggagaaatcaagaaaaccccattaaaatgtatagcaaaaagccaccccctattccaagaatttaggctatggaattttcttagcaacataagaatatatcaaaaagaaaaagaaatcaacggaacactgcacctagacgtcgacgtcacagcagaatttttgaaaacagaagatgattatgtagccttgttcgactggcttaattccagaaaagaaattgaacagaaaacattcctcaaataccctaaattcggactcaagaaagaaatctcaaattatcgttggaattacgtagaggataaacaatatccatgcaatgaaacacgacatgcgatactatcaagccttgaaaaagcaaacgtatgtatagacttcctatctaacgaaaaagaagtcgcactatggcacatactgtacagtgtcagcgacaaacaagaaatagaaaaagcacttcgaacatttgccgctaaaaacgggttagatgaatcgttcgttgaagcatttaagaaattccctccatttaaatcagaatatggggcatacagcgcaaaagcaatcaagaaaatgttgcctctaatgcgttgtggcaaatattgggacgtatcctctatcgatgataccacaaaagaaagaattaagaaaatagtaacgggagaatacgacgagaggatatcagtcaaagttcgagataaagtaatgaatctatctgacatcagttgtttccgaagattgccattatggctggcctgctatattgtgtataatcgacattcagaagataaagaagccgtaaaatgggaatctcctgccgatatagacgcatatttagcatcatttaaacaacactcactccgtaacccaatcgtagagcaagtcattaccgaaactctacgtgtagtgagagacatatggaaacaagtaggaagaatagatgagattcacatagaactaggcagagaaatgaaaaatcctgcagataaacgaaaaagaatgacagcacaaattctagaaaacgaaaatgcaaatcttagaatcaaagcattactagctgaatttatgaatccagagtacgaaattgagaatgtgagaccatattctccatcgcaacaagaaatactcagaatttacgaagacactgtattacacgcagaagatcaactgccggaagaaatagatgctattctaaagaaatttaatagctcaaaagtaccaaccaaatcagaatttctaagatacaaattatggctagaacaaaaatatagatccccatataccggagaactcattccattggggaaattgtttactgcggcatatgaaatcgaacacgtcattccgcaatcccgttattttgacgactcatttagtaataaagtaatatgtgaatcagcagtaaataaattaaaagacaaccaattgggatacgaatttatcaaaaaccatcatggacaaaaagttgaagtaggttttggtaaaagtgtagaaatatttagtgtcgattcatatgaaagattcgttaaagaacaatatgcaaaatcagccgtgaaaatgaagaaattactaatggatgacatacctgaacagttcatagaacgacaactaaacgacagtagatacattagtaaagtaatcaaaggactactcagtaatatagttagagagaaaaatgacagcggagaatatgaaccagaagctgtttcaaagaatatcgtcgtatgtacgggaagcgtcactgatagactaaaaagagattgggggatgaatgatgtttggaactcaattgtatacccaaggtttgagcgacttaattctctgacagatactcaatcatttggacattgggagaacaaatccggaaagaaagtatttcaaactgagttaccacttgaataccaaaaaggatttagcaagaaacgaatagaccacaggcatcacgcaatggacgcaatcgttatagcatgcgcaaccagaaatcatgtaaactatctatctaacgaatctgcaagtcgaaacgcaaaaataagcagatatgatctgcaaaggctactatgtgacaaaaaccgtacagatgacaatggaaactataaatgggttataaagaaaccatgggatacattcactcaagacgcaagagaggtattgtcaaaaatagtagtctctctgaaacaaaacttaagaatcattaacaaaacaacaaatgtatatagacaccttgatgcgactggaaacagagtgtatgaaaaacagaaaacaggggatagctgggctattcgaaaacccatgcataaagatacagtatttggggcagtaaacttacgaaaagtcaaagtagtaagactgtcagtagctttagacacgccagcgatgatagtagacaaaagagtcaaaaataaagttttcgaattattatcatataaatatgacaagaaaagaatcgaaaaatactttaaagaaaacgctttcttatggaaagaattagacttagcaaaagtagctgtatattactttactgaagcaacaactgagcctctagtagcagtaagaaaaccactagatagtacgtttaatgaaaagaaaatcaaagaaagtgtaacagatacagggatccagaaaatactcttaaaccatctttgcaccaaagaaggaaaaccggacttagcctttagcgcagaagggatagaagaaatgaacaggaatcttctgcaactaaataatggcaaaagtcatcaacccatatataaagtacgggtttatgagcctagaggaaataaattctctgttggtgtcttgggaaacaaagggactaaatgggttgaagctgccaaagggactaacctattctttgctatttatataacagaagacggaaaaaggacatacgagactataccattaaatgttgtaatagaacgagaaaaacaaggcctagtccccgtacccgaccgtaataagaaaggggataaactattattttggcttagcccaaacgatctagtatatttaccaacggaagaagaacgagaatttggaaggattaacgaaccgattgatcgaggacgaatatataaaatggtatcctgtaccggtaacgaaggacactttataccagccaatgtagctaatcccatcgttcctgtaattgaactaggcagtaacaataaagcacaacgagcatggacaaacgaaatgattaaagacatatgcataccgataaaagtcgatcgattaggacacattatagaagttaagtatagaatcgacgaatga

SEQ ID NO: 5746 - RNA, 4530 nt, synthetic construct
  misc_feature 1..4530: note = Cas9 variant
  source 1..4530: mol_type = other RNA
atgaaaaaaattttaggactagacctcggcacaaattcagtaggatgggcagttataaactcagtcgtaaacgacgaaggaaaagaacagttagttaacataagtagttgcggaagtagaattataccaatggacgccgcaacacttggtgactttgacaaaggcaactctaaatccccagtcgctgaaagaactaggctcagaggcgttcgaagactacttgaaagatctttactaagacgcgaaagactgcatagggtactaagtgtaatgggtttcctcccagaacattacgctgctcaattggaccgatatggaaaattccttccagaaacagaaccgaaattagcatggtacaaggacgaaactggcaagtatagatttttatttcaagattcatttaacgagatgcttgaagatttccacgagcatcatccagaattagtcgcagaaggaaaaaagatacactatgactggacaatttattatttacgaaaaaaagcgctaagtcaaaaaataactaaagaagaattagcgtggatactactaaatttcaatcaaaaaagagggtactaccagctacgaggggaagaagagcaagaggataacaaaaaaagtgtcgaatattatgcattaaaagtggtagcagtagaagactccggagatagaaaaggcaaagacatatggtataacgtaaaattggagaatggttgggtatacagacgggcttctggagtcccattagactgggttggaaaagttaaagaattcattgtaacaactgacctcgatgaaaagggcaatccaaaaaaagacaaagacggtaacgtaaagcgatcattcagggcaccaaaagaagatgattgggggctacttaaaacgagaacacaagcacaaatagacgaaagcggacaaacggtaggtacatacatatatgaaagcctattgaggatgccagaccaaaagattcgcggaaaattagtaaggaccatagagcggaaatattacaaagatgaactaagaaaaatattaataaaacaatcagaattccacactgcgttacaggatcacaatttattattagcttgcattgaagaactatacccaaataacgaagcacatagaaggctgttaagtacaagtgatttcacatattttttagtagaagatattttattctaccaaaggccactaaaatcccaaaaaggtcaaatagatgactgcccttacgaaagtcatgtatatagagacaagaaagatggatccttacaacacgtacccttaaagtgcgtatcaaaaagtcacccactctttcaggaattccgtttatggcattttctcagtttccttcgcatataccaaagggaaaggatgatcgatggctcactaaaattagatgtagatgtaacaaacgagtttctccaaaatgaagacgattatgtcaaactttttgactggttaaacgaaaggaaagaaatagatcaaaaaactattttagcctacaaaccctttggccttaaaaaaaatgaacaatcaaagtatagatggaattatgtagaagacaagtcatacccatgcaattctacacgggcagacatgatcttcagactaagcaaagccggagtaccagaggaattcttaacaagagaaaaagaagaggcactatggcatatcctctattctatcagcgacaaaaaagaactaaccaaagctttaggaacttttgctgaaaaaaatggcctcaacgagacattcgtcgaaatcttcagcaaaatgccccccttcgaaagcgattacgctgcatattccctaaaggcaatacgcaaattactcgcattgatgcgtatgggaaaatactgggacgaacaagctatagacgaacatacaaggagtaggatagaaaaaatattaaccggagaatacgacgaaacaataagaacgagggtccgagaaaaagcaatgcatctaacagacatttcttcattccggggtctaccgttatggctagcatgttatgttgtatacgatagacattcagaagctaaagaattagttaaatgggaaactccagacgatatcgatcacttcctgaggaaattcaaacaacatagcctgaggaacccaattgtagaacaaataattatggaaacattaagaacagtacgagatatttggaagcaagaaggaaaaattgacgaaatacatgttgagctaggacgtgaaatgaaaaaccctgcaaaggaaagagcgcgcataacagcacaggtattagaaaatgaaaacacgaacttaagaataaaagcattacttgccgaatttatgaatcccgaattcgaaatagaaaatgtcagaccatatagtccagcccaacaagagatactccgaatatatgaagaaggagtactgtcaggagtagcagaaaaagacctaccagatgatatagcatcaattttgaagaagtttagagaaaacgatgtaaaaaaaaggccaaccacatcagaagttctcaggtataaattatggttagaacaaagatatagaagcccatacacagggagaataataccactaggtaaactgtttacacccgcatacgaaatagaacacgtcatcccccaatcacgttacttcgatgactctttcaccaacaaagttatttgcgaatcagcagtaaacaaattaaaagataattgcctaggatacgaatttgtaaaaaaacactcaggcgaaaaagtagaacttggcaacggggagacagctacaattttctccgttgaagaatatgaaagattcgtaaaagactcatatttcaacaactcaaaaaaaataaagaaactactattagaagacattccagacaattttattgaacgccagcttaacgacagtaggtatatatcaaaagtcgttaaaagcttattatcaaacattgtatgtgaagaaggggaacaggaaggaatgagtaaaaacgtaatagtttgcacaggcggagtaacagacaggctcaaaaaagattggggagtacaagatgtatggaacagaataattttaccacgttttcttagactaaacaaaatgacagacagaacagacttcacggcagtatctaccaatggtcaccttctcccagcggtacctttgcatttacaaaaagggttcaataaaaaacgtatagaccatcgacatcatgcaatggacgcaatagtaatcgcttgtgcaggccgaaacatcgtaaattatcttaacaatgcgtcggcgagaaagggttctgaaatctcgcgttacgatctacaacatctcttatgtgataaagtaaagacagacgcaaatggcaattataaatggatattaagaaaaccctgggaaacttttacacaagacttatatgcagcactaacgaacattgtcgtatcctttaaacaaaacctgcgggtaataaatcgaacaacgaatcattaccaacattataacgaagatggagaaaaaaaaatgatcccgcaaacaaaaggagacagactcgcaatacgcaaaccaatgcataaggataccgtatatggagaagtaaatttgagaaaagaaaaaaccttaccactgaaagatgtagtgaaaaacccctcagcagttgtagacaaatccctaaaaaataaactatatgaattattaaaatcgcaatatgatctaaaggcaataactaaatacttcgaaacacatcaggatgtgtgggcagatgtaaacttaaaaaaaataaaagtttactacttcaccaaagaaactaacgaaagatttttcgcaacaagaaaatcattagatagtagtttctcacaaaaaaaaattgaagaagaagttacagatacaggaatacaaaaaattttgttacgacatctccagcaaaacgggaacaaccctgacatcgcattctctccagacggagtagaacgtatgaaccaaaacatgacaatactaaatgacggcaaatggcatcaaccaatatataaagtcagaacatatgaaaaggcagataaatttgccgtaggagagaaagggaataaagtgaaaaaatttgtagaggctgccaaaggaactaatctctttttcgcagtctacgaaagtatacaagaagatgaagcgacaggcaaacaagtaaggaaaagaacatttgcaacaatcccattaaacgaggtcatcaagagaaaaaaacaaggcttgcccgcagcgccggaggacagcaaaggtaatttaccaatatttgttctatctccaaatgatctggtgtacctaccgacagaggaagaaaggaattcgggaaaaataatccaaccattagacagagagcgaatatacaaaatggtatcttgcacagaaggcgagtgtcattgtatacctgaatacgtggcaaatccaatattacaaacaattgaacttggctctaataacaaggcacaaagagcttggtcaggtgagatgataaaagaaatatgtgtacccgttaaggtggaccgtcttggtaacgtatcactaataaaaatatga

SEQ ID NO: 5747 - RNA, 4530 nt, synthetic construct
  misc_feature 1..4530: note = Cas9 variant
  source 1..4530: mol_type = other RNA
atgaaaacaatactgggactagatctaggaacaaatagtgtcggttgggcagtcataaactctgtaatcaaagaacaagccgaacgaatatggattgaaacagcaggtagtcggattatacccatggatgcagcagtactgggggacttcgacaaaggaaatagcatatctcaaacatcagaacggaccagattaagaggagcaagacgccttagggagagacaattattaaggagggaaagactacacaaagtcttaaacatcctaggcttccttcccaatcattatctcgaatacatagacttcgaaaaacacccaggaaagtttttagcggatgcagaaccaaaactagcgtgggtaaaagacgaacaaggaaaatatacatttttatttcaagcggcgttcgacgaaatgctagccgactttgccatacaccaacccagcttagttagcggtgacaagaaaataccatacgattggactatttattaccttcgcaaaaaggccctaacagaaatgatatcaaaggaagaattagcatggatattactaaattttaaccaaaaacgaggctattaccaattacgaggtgaagaagaagaagacaacgcaggtaaatcagttgaattttatgctttaaaagttctaacagtcgaagcaaccgatgaaaagaaaggtagagatgtttggtataatgtccacttagaaaacggttggatatatcgacgaagctcgagtgtaccactggattgggagggccaagtcaaagaatttattgttacaacagatctcaatcctgacggcacaccaaaattagacaaatacggagaggtcaagcgatcattcagagcaccaaaagaagatgattggatgcttataaagaaaagaacagaagctgacattgccaacacacacaaaacagtaggtgcatacatatatgacacactactgcaaaaaccgcaacaaaagattattggtaaactcgtaaaaacagtagaaagaaaactatacagagatgaactcagtctcattctccaaaaacaatgcgcgtttcacgcagaactccaagatagagcactctacgcaagatgtgtggaagcactttacccatcaaatgaagtaagacgaaagaatatagccaacagagactttgtatacctattaatggacgacatactcttttatcaaagaccacttaaaacaaagaaaagcctcatagcaaattgcccgtatgaagaaaatgaatacgtcgatcgagagactggagaaataaagaaagcccctttaaaatgtatcgcaaaaagccaccctctctttcaagaatttagactttggaactttttaagtaatataagaatatatcaaaaagaaaaagaaataaatggaacgctacatttagatgtagacgttactgcagagttcttaaaaacagaagatgattacgtggcactatttgactggctaaacagccgcaaagaaattgaacagaaaacgtttctaaagtatcctaaatttggccttaagaaagaaatctcaaactatagatggaactatgttgaggacaaacaatacccatgtaatgaaacaagacatgctatattatcatcattagaaaaagcaaacgtttgtattgactttttgagtaatgagaaagaagttgcactctggcatatcctctattcagtttctgataaacaagagattgaaaaagcattacgtacattcgcagccaaaaacggactagatgaatcttttgtagaagcatttaagaaattcccaccatttaaaagcgagtacggggcatatagcgctaaagcaataaagaaaatgcttccattaatgagatgcggaaaatactgggatgtttcaagcatcgatgacacaactaaagagagaatcaagaaaatagttacaggagaatatgacgaaagaatagcagtcaaagtccgagacaaagtaatgaacttaagtgatatatcgtgctttagaagattacctttatggctagcttgctacatagtttataacagacactctgaagataaagaagctgtaaaatgggaatcccccgcggacatcgacgcatatctagcttcttttaaacaacattcgctgagaaacccaatcgtagaacaagtgatcactgaaactttacgagtagtacgggatatatggaaacaagtaggaagaattgatgaaatacatatagaattaggtagagaaatgaaaaatcccgccgataaaaggaaacgcatgacagcacaaatcctcgaaaacgagaatgcaaatttacgaataaaagccttactagcagagttcatgaatcctgaatatgaaatagaaaatgtaagaccctatagcccatctcaacaagaaattttaagaatatacgaagacacggtactacacgccgaagatcaattacctgaagaaatagacgcaatattaaagaaatttaatagttcaaaagtacctacaaaaagtgagtttctaagatataaactatggttagaacaaaaatatcgaagcccatatacgggagaacttatacctttaggcaaactttttactgcagcatacgaaatagagcacgtcataccacaatcgagatatttcgatgattcatttagtaataaagtaatatgcgagtctgcagtaaacaaactaaaagataatcaactagggtatgaatttatcaaaaaccaccacggacaaaaagttgaagtaggatttggaaaaagcgtcgaaatattttccgtggattcatatgaacgtttcgttaaagaacaatatgctaaatcagcagtcaaaatgaagaaattgcttatggatgacatccccgaacaatttatagaaagacaattaaacgattcaaggtatatttccaaagttattaaaggattactaagcaatatagtccgagagaaaaacgattccggagaatatgaaccagaagcggttagcaaaaacatcgttgtatgcaccggatctgtcactgacagattaaaaagagattggggaatgaacgatgtatggaatagtatagtctatccgagatttgaacgattaaattccctaacagatacacaatcctttggccattgggaaaataaatcaggaaagaaagtttttcaaacagaattacctttagaataccaaaaaggtttctccaagaaacgtatagatcatagacaccatgccatggatgcaatagtaatcgcatgcgcaacaaggaaccacgtcaattacttatctaatgagagtgcaagtagaaatgcaaaaatatctagatatgacttgcaaagattattgtgcgacaaaaaccgaaccgacgacaacggtaactataaatgggttataaagaaaccatgggatacttttacccaagacgctcgcgaagtgttatcaaaaatagtagtctcactgaaacaaaacctgcgaataattaataaaacaactaatgtctatcgccatttcgatgcaactgttaacagagtatatgaaaaacagaaaacaggagattcatgggcaataagaaaacccatgcacaaagacacagtgttcggcgcagtcaacctaagaaaagtcaaagtagtacgtctatctgtagcccttgacacaccagcaatgatagttgacaaaagagtgaaaaataaagtattcgaattattgtcatacaaatatgataagaaaaggatcgaaaaatattttaaagaaaatgcatttctctggaaagaactagatttagccaaagtagcagtatattattttacggaagccactacggaaccccttgtcgccgtcagaaaaccccttgacagtacgttcaacgaaaagaaaataaaagaatcagtcacagatactggcattcagaaaatattactaaatcacttatgtactaaagaaggaaaaccagatttagcattctctgcggagggaatcgaagaaatgaaccgaaatctcttacaactgaacaatggtaaaagccaccaaccaatttataaagtgagggtttacgaaccgcgaggaaacaaattttcagtcggcgtcttaggtaataaaggcacaaaatgggtagaagcagcaaaaggaacaaacttattcttcgctatatacataaccgaggatggaaaaagaacgtacgagaccattccactgaatgtagttatagaaagggaaaaacaaggcttagtaccagtaccagatagaaatgagaaaggggataaacttttattctggttatcacctaacgaccttgtctatctaccaacagaggaagaacgggaatttggaagaataaacgaacccatagatagaggaagaatatataaaatggtaagttgcaccggtaatgaaggacattttattcctgcaaatgtggcgaatccaatagtaccagtaatagagcttggttcaaacaacaaagcacaaagagcatggaccaatgagatgattaaggacatatgcatacccattaaagtagatcggttaggccacatcatagaagtgaagtatagaattgatgagtga

SEQ ID NO: 5748 - RNA, 4530 nt, synthetic construct
  misc_feature 1..4530: note = Cas9 variant
  source 1..4530: mol_type = other RNA
atgaaaaaaacactcggattagatttaggcacaaatagtatcggatgggcagtaataaatagcaacatagactcagaaggtaaggaaaagttagtaggaatatcaagttgcggtagtagaataatacctatggatgcaacaacactcggagatttcggaaagggcaatacaaaatcacccgtggcagaacgaacaagattaagaggaattaggcgacttttggaacggagcctcctcagacgggaacgcctacacagggttctatcagtgatgggatttctaccggaacactacgcgtctcaactagacaggtatggtaaatttttacctgagacagagcccaaactagcatggtataaagacgactcaggaaggtaccaattcctattccaaaaaagctttcacgagatgcttgaagacttccgtcaacatcaacccgagcttgtcgctggcgaaaaaaaaattccctatgattggacaatatattatcttagaaaaaaagctctgtcgcaagaaattactaaagaagaattggcttggattctattaaatttcaatcaaaaaagagggtactatcaattaaggggagaagaggaacaagaagaaaacaataaatcggtagagtaccatgcgttgaaagtggtatctgtagaagattcgggtgaacgaaaaggaaaagatatatggtataatgtaacattagaaaacggatgggtgtatagacgagctagtaacataccattagactggactgggaaggtaaaagaattcgtagtcaccacagaactggatgacgccgggaacccaaaaaaagataaagaaggaaacgtaaaaagatcatttagagctcctaaagaagacgactgggggctcttaaaaacacgaactcaagcgcaaatagatgaatctggaaaaacagtaggaacatatatatacgaaagcttattatgcatgccaaaccaaaaaataagaggaaaattagtacgcacaatcgaacggaaatactacaaagacgaacttaggcaaatattagtgaaacaatccgaatttcatgccgccctacaggatcacaacttattattatcatgtatagaagaactttatccaaacaacgaagctcatcgacgtctcttaagtgcaagctcttttatatatttcctgattgaagacatcttattctaccaacgcccacttaaatcccaaaaagggctaatcgacaattgcccatacgaaagccatatatacaaagacaaaaaagatggttcattacatcacgtaccactgaaatgtgtaagcaaaagccatcccctattccaagaatttagattatggcaatttctatcgaatttacgaatatatcaacgagagaggatgatggatggatcactaaaattagatgtcgacgtcacccgtgaattccttccatccgaggaagactatgtaaaactttttgattggcttaacgaacgtaaagaaatttcacaaaagttcttattagcatataaaccctttggactaaaaaaaaacgaacaagcaaactacaggtggaattacgtcgaagacaaatcctatccttgtaatgaaacgagagcggaaattaaaagtagactcagtaaagccggggtaccggaagaattcttaacagaagaaaaggaagaagccctatggcacatcttatattctatatcagataaaaaagaactaactaaagcactagggacatttgccgcaaaaaactgtcttaacgaatccttcgtagaagtttttgcaaaaatacctccatttgagtccaactacgcggcatatagtttaaaagcaataagaaaactgctcgcgttaatgagaatgggtaaatactggaacgagcaagcaatcgatcgacaaacaagagatagaatcgaaaaaatactaaccggagaatacgacgaaacgataagaagtagggttagagaaaaagcaatgctattgacagacatatctagcttcagaggattacctctatggttagcttgctacatagtatacgacaggcactcagaatccaaagaactagtaaaatgggaaaccccggcggatattgatcacttccttagtaagtttaaacaaaactcattaagaaacccaattgttgaacaagttataacagagtcgttgcgaactgtgagagacatatggaaacaagaagggaagatagacgaaatccacgtagaactcggaagagaaatgaagaatccagccaaagaacgtgcgcgaataacagcccaagtacaagaaaatgaaaatactaatcttcgtataaaggcactactagcagaattcatgaatccagaatttgaaatagaaaatgtccacccttatagccctggacaacaagaaatactaagaatatacgaagatggagtactctcgggaatcgctgagaaagacctgcccgatgacattacagcaattttaaaaaagttcagagagaatgatgtaaaaaaacgacccacaacttctgaagtacttcgctacaaactatggctagaacaaagatatcgtagtccatacacgggcagagtaataccgttgggtaaattatttactccagcatacgaaattgaacacgtaatcccccagtcccgctatttcgacgactctatttcgaacaaagttatatgcgaaagcgcagttaataaactgaaggataattgtttaggatatgagtttataaaaaaacatagtggagaaatggtggaactgggaaacggagagaccgttccggtattttcagtcgaagaatatgaaagattcgttaaagaaagctatttcggaaatagcaaaaaaatgaaaaaattactactagaagacatccctgattcattcatcgaaaggcaattgaatgatagtagatatatatcaagagtagtaacctcacttctatctaatttagtgtgtgaagaaggagaacaagatggactttccaaaaacgttattgtatgcactggcggaatcaccgatagactcaaaaaagactggggagtacaagaggtttggaacagaattatattaccacgattcctccgacttaatgaaattaccggaaggacagattttacaagtacaagtgtcaatggccatctactacctgctctcccactctaccttcaaaaaggttttaataaaaaaagaatagaccatagacatcatgccatggacgcgatcgtaattgcatgcgccaacaggaatatcgtcaattatttaaataacagtagcgcgaggaaaaactcagagatttcacgttatgatctacaacgattgttatgcgaaaaagtaaagactgacgcaaacggaaattacaaatggatcctaaggaaaccatgggaaacatttacacaagacgtatatgcagctcttacgaacatagtagtatcatttaaacaaaacttaagagtgataaatcgtacaaccaattactaccaacactacaatgaagcaggagaaaaacgtatgatacctcaaacaaaaggagacagatgggctatcagaaaaccaatgcacaaagatacagtctatggcgaagttaacctccgaaaggaaaagacactaccactacgagatgtagtaaaaaacccaagcatagtagtcgacaaaagtctaaagaacaaattatacgaactccttaaatcccaatatgacttgaaagccatcgccaaatatttcgagactcaccaagacgtatgggccgacgttaatcttaaaaaaataaaagtatactattttacaaaagaaacaaatgagagattctttgcaacgagaaaaagtttagaccccagtttcgatcaaaaaaaaatcgaagaagaggtgacagatactggcgtacaaaagatactactacatcacctacaacaaaataataatgaccccgacatggcattcagtccagatgggatcgatagaatgaatcaaaacatgacaatcctaaacgatggcaagtggcaccaacctatatacaaagtaaggacttacgaaaaagcagacaaattcgccgtcggtgaaagcggaaataaagcgaagaaatttgtagaagctgcaaaaggcaccaacttattttttgcagtatacgaatcagtacaagaagatgaagctattggtaaacaagtatgtaaacgtacattcgcaacaataccgttaaacgaagtaataaaacgtaagaaacagggattgcctgctgcccccgaagatttaaatggaaatctaccaaaatttgtattgtcaccgaacgacctagtttacctaccgacggaggaagaaagaaattcaagtaggatcatacaaccattagaccgagaaagaatttataaaatggtaagttctagtggctcgcaatgtttctttataaaagtattcgtagcaaactcaatctgggataaaaatgaatacagtagtttaaacaaaatggaaagagcaattacaaatgaaatgataaaagaaatttgcgttcctataaaaatagacaggttaggaaatgtctctctcattcaaatatga

SEQ ID NO: 5749 - RNA, 4533 nt, synthetic construct
  misc_feature 1..4533: note = Cas9 variant
  source 1..4533: mol_type = other RNA
atgaaaaggatactaggattggatttaggtacaaattcaatagggtgggcattagtagatagcgaagaacaaagaatattgggaatgggaagtagaataataccgatggaccaaggtgtgttagacacattcagtggaggtaacccagtcgagacacaaacagctgcccgaactgtatacagaggtacaagacggttacgcgaaagagcactactaaggcgtgaacgcctaattagggtactaaatatgatgaagttcttaccagaacactatgcatcccaaatagacttcgagaagagactcggacaattcttcgacgagaaagagccgaaattagcatggaaacagaacgacgaaggaagatttgaatttattttccagcaatcgttcaacgaaatgatagaagaatttaaaaacaaaggcgtagtgagagaagacaagaaaataccatacgactggactatctactatctcagaaagaaagcactaagtcaagaaatagaaaaagaagagttagcatggattttgctaaactttaaccagaaaagaggatattatcaactacgtggagaagaagaagaagaaaatcccaacaaactcgtcgaatattacagtcttaaaatagttgacgtaatagcagacgaaaagcctaatagtaaatccgatatatggtattcattgcaccttgaaaacggctggatttacaggaggtcgagcaaaatacccctctttggttggaaggataaaaccagagacttcatcgtaacaacggatttaaatgatgatggcacagtaaagaaagataaagaaggaatagaaaagcgctcgtttcgagcacccagcgaaaatgactgggttctattaaagaagaaaacggagtccgacatagaaaaatctcacaagaccgtaggggcatacgtatacgaaacactgttacaaaacccaatgcaaaaagttcgtgggaagctagtcaggacaatcgaaagaaaattttacaaagacgaactaaagcaaattttagaaaaacaacgtgaatttcacccagaactgcgagatgaagacttatacaatgactgtgtaagagaactttatagaagcaacgaaacgtatcaatttatattgtctaaaagagacttcgtacatctatttctagatgacattttattttatcaaagacccctgcggagtcagaaatcagcaataggagactgtatattagagttcaagacatataaagacaaagacgggaataacattaaagaatatttaaaagtcattagcaaatcaaacccattataccaggagttcagaatctggcaatggttgtataatctcaaaatatatagaaaagaagatgatgaagatgtgactctacaatttatagcaaatattgaagataaagaacaactatttgactttttatcaaatcggaaatcaatcgaacaaaaacctttgctagaatatctcataaaagccaagggcctgaaaaagcaagtaaaaactgaggcttatagatggaattatgtagaagataaaatatatccatgcagcgaaacaaaaactatgatatcaactcgattagctaaagtagaaaatatcccagataatttctttacaaaagaaatagaacaaaaactatggcatatcatatactcagttacagataaaaatgaatttgaaaaagcattacgtaccttcgctaagaaatatgatctagatattgccagcttcgtagacaactttaagaaaatcccaccctttaaaaacgaatacggaagtttctctgaaaaagccataaagaaattattacctcttatgagattaggcaaatactggaaatggaatgacattgataacaatacgcaaaatcgcataagcaaaataattaccggagaatatgatgaggaaatcaaagatatagtaagagagaaaagtatagctctaacaaacgaaaatgactttcaaggattacaattatggctagctcaatatctagtctatggtagacattcagaagcagatatcgcaggaaaatggcattcagtcgctgatcttgaaaaatatctaaacgaatttaaacaacattcactaaggaacccaatcgttgaacaaattataacagaaaccctacgagttgttagggacatatggaggaaatatggacaaggagctgaaaatttcttttccgaaatacacgttgaacttggaagagacatgaaaaatacagcagacgaacggaaaaagatcgtgaacgtcgtaacagaaaacgaaaacactaacttacgaataaaggctttactcatggaactgaaaaataactccgacgggaaattagaagttgaaaacgttagaccatattcccccacacaacaagatattttaaaaatatatgaagagtacgctatatcaactggattagataatgaaaaagacgaaaaagtaaaagaagacataaagaagatcagcagggttgcacaaccaactacaaccgagctacagcgatacaaattatggttagaacaaaaatattgctctccatatacagggaaagttataccccttggcaaactattcacagaagaatatcagatagaacatataataccgaaaagtagatactacgatgacagtttctcaaataaagtcatatgtgaagcagcagtcaataaactaaaagataaatgcttagggctcgaatttattaaaaattatcacggacaaatagtagaaacgggattcggacaaaaagtaactatatttgacgaagaagcataccaaaatttcgttaaacaacattatgcatataaccacagcaaacgaactaaattgctattagaagaaataccagagaaaatgatagaaagacaaatgaatgacactagatacataagcaaattcgtcttacccttacttagcaatttagtccgcgccaaagaaaatgataatggtgtcaatagtaaaaacgtgttaccagtaaacggaaaaataacgaccatgttaaagcaagactggggattaaacgacgtatggaacgacctaatattaccaagatttgtccgtatgaatgaactagctaaaacaatagcgtttacgtcatggaacgaacaacaccaaaaatacttgccaacagtacctctcgagcttagcaaaggcttccaaaagaaacgtatcgaccacagacatcatgcaatggacgcactggtcatcgcgtgtgcaacccgagatcacgtaaaccttctaaacaataaacatgcaaatacggacactataagatatgatttacagagaaaactcagattatttgagagggtaacatacatagatccacaaaccaaaaataatgtaaccaaagacatcccaaaagagtttaagaagccatgggacaattttaccgtagatgcacgcaacgaactagaaaagattatagtgagcttcaaacaaaacctgagaataataaataaggcaactaacatctacacaaaatacgagaatggaaagaaaataaaggtaggacaaaagggcctcaattgggcaatccgcaagccactacataaagaaacagtatttgccaaagtgagccttagaaaaagaaagacagttagattgagcgaagcattgaaagattggaaaaagatagtggataagaaacttaaacaagagataaaaagactcacttgccaatacggcaagtttgatgtagacacaatattaagatacttcaaggataggaaataccagtttggggaggtagacgtaagcaaggtaaaaatgtattattttgacgaagaaaatgccgctgtaagaaagaacgttgacacatcttttactgaaaaattcatacagggttcagtcacagacaccggtattcagaaaatcttactcaatcacctagaagcaaaaggaaacaaagtagaaatagcattctcacctgaaggaatagaagaaatgaataaaaatataatacaattgaacgaaggaaaattacatttaccgattttcaaggtacgagtttatgagaccataggtaacaaattctcagtaggggttaaaggaaataagaaagacaaatacgtagaagcagcaaaaggcacaaaccttttcttcgcaatctacgtagacgaaaacgggattcgatcatatgagacgatacctctaaacatcgttatagaacgccttaaacaaggacttagcgtagtaccagagaaaaacaggaaagaacactctttattattctacctgagtcccaatgacttagtatatgtacctattgaagacgaaagagaaaacatccatgctgtcaatttagatcaattaaacaatgaacaaagaaaacgaatatataaaatggttagctgcaccggaagtgaatgccattttgtcccatattacgtcgcgagccctatcgtcaacaaagtagaatacagtagcctaaataaaatcgggaggagtctgacaggagaaatgattaaagacgtctgcatcaagttaaaagtggataggctaggcaatattaagggaattagtggcctatga

SEQ ID NO: 5750 - RNA, 4533 nt, synthetic construct
  misc_feature 1..4533: note = Cas9 variant
  source 1..4533: mol_type = other RNA
atgaagagaatactagggttagacctgggcacaaactcaataggatgggcgctagtagattccgaagaacaaaggatacttggaatgggctcacgcataataccaatggaccaaggcgtgctagacacattttcaggtggcaaccctgtcgaaactcaaacagctgcacggaccgcatacagaggtactcggagattgagagaaagagctttattaagaagagaaagactaattcgagtccttaatatgatgaagttcctacctgaacactacgcatcgcaaattgacttcgaaaaacgtctaggacaattctttgacgaaaaggagcccaaactcgcatggaaacaaaatgatgaagggaggtttgagttcattttccaacagagctttaatgaaatgatagaagaatttaaaaataaaggcgtggtaagagaagataagaaaatcccttacgattggactatatattacttacgaaagaaagcccttagccaagaaatagagaaagaagaactcgcatggatattactaaattttaaccaaaaacgaggctactatcaacttagaggcgaagaagaagaagaaaatccaaataaattagtcgaatattatagcttaaaaatagtggatgttatagccgacgaaaaaccaaactcaaaaggagacatttggtacagtctccatttagaaaatggctggatttaccgtcgctcatcaaagatacctctgtttgggtggaaagataaaacaagggactttatagtaacaaccgacctcaatgatgatggaacggtgaaaaaggataaagagggcatagaaaaacgaagttttagagccccatccgaaaacgactgggtactacttaaaaagaaaaccgaatccgacatcgaaaaatcgcacaaaacagtgggagcatacgtctacgaaacgctattacaaaatcccatgcaaaaagttagaggcaaattagtaagaactatagaacgaaaattttataaagacgaattaaaacaaattctagaaaaacaaagagaatttcatccagaactacgggacgaggatctatacaacgattgcgtgcgggaactgtacagaagcaacgaaacttatcagttcatactttcaaaaagggacttcgtacacctatttttagatgacatactcttttaccaaagaccactaagatctcaaaaatccgcgattggagattgtatcctcgagttcaaaacatataaagacaaagacggcaacaatataaaagaatatttaaaagtaatatcaaaatcaaatccgctctaccaggagttccgtatttggcaatggctttacaatctaaagatttacagaaaggaagatgatgaagacgtaacactacaattcatcgcaaacatagaagataaagaacaattattcgatttcttatcaaatcgaaagtctattgaacaaaaacctctcttagaatacctcataaaagccaaaggattaaagaaacaagtcaaaacagaagcatacagatggaactacgtcgaagacaagatatacccatgttcagaaactaagacgatgataagcaccagattagctaaagtagaaaacataccagataatttctttacgaaagaaattgaacaaaaattatggcacataatatattccgtaaccgacaaaaatgaatttgaaaaagcattaagaacattcgcaaagaaatatgatctcgacatagccagttttgtagacaatttcaagaaaataccaccatttaaaaatgaatacggatccttttcagaaaaagcgatcaagaaattactacccctaatgcgtctaggaaaatactggaaatggaatgacattgataataatacccaaaacagaatatcaaaaataataacaggagaatatgatgaagaaataaaagacattgtacgagagaaaagtattgcgttaacaaacgaaaacgattttcaaggtttacaactatggcttgcacaatacctagtttatggtagacacagtgaagcagatattgcgggtaaatggcatagcgtagccgacctcgaaaaatacttaaatgagttcaaacagcatagcctgcgaaatcctatcgttgaacaaataatcacggaaacgttacgagttgtacgggatatatggagaaaatacggacaaggagcagaaaacttctttagtgaaatccacgtcgaacttggaagagatatgaaaaatacagcagatgaaagaaagaaaatcgtgaacgtagtgaccgagaatgagaacactaacttacgcatcaaagctctattaatggagcttaaaaacaatagcgacggaaaattagaagtggaaaatgtaaggccctattcaccgacacaacaagatatactaaaaatctacgaagaatatgccatttcgactggactagacaatgaaaaggacgagaaggtaaaagaagatattaagaaaatctccagagtagcgcaaccgacaacaacggaactccaaagatataaactatggttagaacaaaaatactgttcgccatacaccggaaaagtcatacctctgggaaaattatttacagaagaatatcaaattgaacatataataccaaaaagtcgctattacgacgattccttctcaaataaagtaatttgtgaagcggccgtaaacaaactaaaagataaatgtttaggactagagtttattaaaaattaccatggtcaaatagtagaaacaggattcggacagaaagtgaccatattcgacgaagaagcatatcaaaactttgttaaacaacactacgcatataatagaagtaaacgtaccaaattgctattagaagagataccggaaaagatgatagaaagacaaatgaacgataccagatatatatccaaattcgtactccctctactttcaaacttagtacgagccgaagagaatgataacggcgtaaatagcaaaaacgtcctaccagttaatggaaaaataaccactatgctaaaacaagattggggcctaaatgatgtgtggaacgatctaattcttcctcgctttgttaggatgaatgaactagcaaaaacaattgcgttcacatcatggaacgaacaacatcaaaaatacttaccaactgttccactagaactcagcaaagggttccaaaagaaaagaatagatcacagacaccacgcaatggatgcacttgtaatcgcctgtgctacaagggatcacgtcaacctactaaataacaaacacgcaaacaccgacacaatcagatacgacctacaacgcaaactcagactatttgaaagagtaacatatatagatccacaaacgaaaaacaatgtcaccaaagatatcccaaaagaatttaagaaaccgtgggataactttacagtcgacgctaggaacgaactagagaaaatcatagtctcgtttaaacaaaacctacgaatcatcaataaagcaacaaatatctacacaaaatacgaaaacggaaagaaaataaaagtgggacaaaaaggtctaaactgggcaatccgcaaaccccttcacaaggaaaccgtgttcgcaaaagttagcttgcgaaaaagaaaaacagtaaggttatcagaagccctgaaagactggaaaaagatagtagacaagaaactaaaacaagaaataaaaagattaacatgccaatatggaaaatttgatgtagataccatattaagatactttaaagatagaaaatatcagttcggagaagtagacgtatcaaaagttaaaatgtattacttcgatgaagagaacgcggctgttcggaaaaatgtggacactagcttcacagaaaaattcatacaaggtagtgttacggacaccggaatacaaaagattctattaaaccacttggaagcaaaaggaaacaaagtagaaatagcgttcagcccagagggcatagaagagatgaataaaaatataatacaacttaatgaaggtaaactacatcttcccatattcaaggtaagagtatacgaaacaataggaaacaaattctcggtaggagtaaaaggcaacaagaaagacaaatacgtagaagcagctaaagggacaaacctcttcttcgcaatatacgtcgacgaaaacggaatcagatcctatgagacaataccgctaaatatcgtcatagaaagactaaaacaaggattatcggtcgtacctgagaaaaaccgaaaagaacattctttgttattctacttatcacctaacgatttagtctacgttcctatcgaagatgaacgagaaaacatccacgcagtaaacttagaccaactaaataatgaacaaagaaaaaggatatataaaatggtatcttgcacaggatcagaatgccacttcgtcccgtactacgttgcatcccctatagtcaataaagtagaatactcctctctaaataaaataggacgttctctaactggagaaatgattaaagacgtctgtattaaactcaaggtcgacagactcggcaacgtgaaagggattagtggtttatga

SEQ ID NO: 5751 - RNA, 4536 nt, synthetic construct
  misc_feature 1..4536: note = Cas9 variant
  source 1..4536: mol_type = other RNA
atgaaaaaaatactgggactagatttaggcactaattccattgggtgggctgtcataaactcagtagcagatgaaagcgtagagaaaagaaacatagaactagctggaagtcgaataataccaatggatgcagcagttctcggaaattttgacaacggagtaacaaagagtcaaacagctgaaagaactagctacaggtcaataagacgcctccgtgaaagacaattattacgtagagaaaggctacacaaagtattacaaattttaggttttcttccggaacactatgtaaacgacatcgacttcgaaaatcacccaggaaaaataaaaaaaaacacagaacccaaattaccatggagaaaaaattccatgggacagtttgaattcatctttcaagcgtcctttgaggccatgttaacagattttgcaacacaccaaccggtctttgtatcagaaggaaaaaaagtacattatgactggaccctttactatttacgaaaaaaggctttgacagaagagatctcaaaagaggagttagcatggataatattgaatttcaatcaaaaacgaggctattaccaactacgtggagaagaagaagaagaacaatctaacaaactagtagaattttatgcattgagagtggtcaaagttgaagcaacagatgacaaaaaaggcaaagatacttggtacaatgtacacttagaaaatggctggatatatagaaggaccagcaacatcccattagactgggaaggaaaagtcaaagaatttattgtgacaactgatttgaacgaagacgggaccccaaaattagacaaatatggagaagtgaagagatctttcagagccccaaaagaggatgactggaccctaatcaaaaaaaaaaccgaatcagacatagccaattcacacaaaactctaggatgttatatatacgacgcgttacttcaaaaccctaatcaaaaaataaagggacgattagtacgtaccgtagaacgcaaattttacaaagaagaactccgattaattttagaaaaacaattatcattccatccagaacttcaagatcgtgacctatatagagcgtgtatcgatgcactttatgtatctaacgaagcccacaaaaacaacatctcaggcagagatttcgtatacctatttattgatgacataatcttttaccagagaccattaaaaacaaaaaaaagcctaattgataattgtccttatgaaaaaaatcagtatatggacagagagacgggagaagttaaacaagcaccaatcaaatgtatcgctaaatctcacccattatttcaagaatttcgattatggcaattcatttcaaacataagaatttaccagcgagagcgagtaatggatgatggaaaacttgaaaccgacgtcgacgtgacacccgatttcttaaaaacagaagacgattatactaccttattcgaatggctgaacgaccgaaaagaggtagatcaaaaagcatttctaaaaaatccacaatttggattaaaaaaaacctttaccgaataccgatggaactatgtagaagacaaaagttacccttgcaacgaaactcgtaatgctatattaaacggactacaaaaagctggggtatcagctgatttcttatcccgagaagtcgaagaagcgttatggcatatactatattcagtcgaagacaaaatagaaatagaaagtgcactaagaaaattcgcctcaaagcacgatctggatgacagatttgcagatgtattcaaaaaattaccaccatttcgcaaagaatacggagcttattcagcaaaagcgatcaaaaaattattaccattaatgagaatggggaaatattgggaactttcaaacatagacgataaaaccaaggaacgaatagacaaaattattacaggagaatgggatgaaaatatacataacagagtaagagaaaaagccatcaaattatcagacattacggacttcaaaggattaccattatggctaagctgttatgtagtatacaacagacattctgaagcacgtgcaattgctaagtgggaatcaccagaagacatagacagttatctcagattatttcgtcagcattcactgagaaatccagtcgtagaacaagtaataacagagacactacgaacagtcagagatatttggaaacgaatcggccaaatcgacgaaatccatgttgaactaggcagagagataaaaaatcccgcagacaaacgagcaaaaatgacggcacaaatagtcgagaacgaaaacacaaatcttagaataaaagcactactagcagaattcataaattctgagtatgagatagaaaacgtgcgcccttactcaccaggacaacaagaaatattaagaatatacgaagataccgtattaaactcagtcgaagaaataccagaagacatttcagctgtcttgaaaaaattccgagaatccgacctaaaaaaacgacccacaaaatccgaatttctaagatataaattatggttggaacaaaaatatagatcaccctacacaggtgacatcattccgttaggcaaattatttacatcagcctatgaaatagaacacataatcccacagtcacgatattttgatgatagcttctcaaacaaagtcatatgtgaggcagaagtcaataaattaaaaagtaacgaactcggatacgagtttataaaaaatcatcacggccaatatgtagaaatagggttcggaaaagtagtacaaatattctcaatagaagcatatgaaaaattcgttaaggcgaattacagtggaatcggaagtaagatgaaaagattactgatggacgacataccagaaacgttcatagaacgacaattaaatgatagcagatatatatccaaagtagtaaaatcactcctatctaacatagttagggaaaaagattcaaacggagagtacgaaccagaagccataagcaaaaacgtaatcgtctgtacaggatcggtcacagatagactaaaaagggactggggagttaatgacgtatggaatagcataatataccctagatttgaaagattaaatgaattaaccggatcccaacaatttggatgctgggaaaacaaagaaggaaaaagagtatttcaaactgcagtaccacttgaaatgcaaaaaggattcagcaaaaagagaattgaccacagacatcatgcaatggacgcaattgtaatagcatgtgcgataagaaatcacattaactatctttcaaatgaatcagcctcaaaaaaagcaaagataagccgaatcgacctacaaaggctcttatgtacaaaatgcagaactgacgacaacgggaattataaatggatcgtaaaaaaaccctggccagcatttacacaggatataaggaaagccctcgagaatattacagtttcattcaaacaaaatctaagagtaataaataaaactacaaactactatgtccatttcgacgaatccggcaaaaaagtgttggaaaaacaaataaatggcgattcatgggcaataagaaaaccaatgcacaaggacactgtgttcggaaaagtgaatctacaaaaagttaaagaagtaagactatcgcttgcattagacaccccaaaaatgatagttgataaaaaactaaaagaaaaagttttacaattatacagctataaatatgacaaaaaacgaatcgataagtattttaaagaaaacgcgtccctttggaaagatctgaacttaagcaaagttgccgtatactacttcacaaacgactcaacagaacccctagtcgcagtacgaaaaccgctagatacaagctttaacgcaaagaaaataaaagaatccgttaccgacacgggcattcaaaaaatactcctaaatcacctatccaataaccaagacaatccaaacttggcgttctcacccgacggcatagatgagatgaacagaaacctaacgactctaaatgatggtaaataccaccaaccaatttataaagtgcgagtttgcgagcctcaaggtaacaaattcagcgtaggaacatctggcaacaaaacaagtaaatatgtagaagcagccaaaggtacgaacttatttttcgcagtataccaaactgaggacggcaaaagaaactatgaaacaatacccctaaacgtagtgattgaacgtgaaaaactggaatgggctcccgtaccagaaaacaataataacggagacaaattattattctggcttagtcccaatgatttagtctatgtcccaaccgcagacgaattaaataatggaatgcggctcgataacatggataagggaagaatatataaaatgatcagctgttcaggtccccaatgcttttttatacctcagaacgtatcaaacccaatcataccagtcatcgaattaggggtcaataataaagcagaaaaatcttggaacaatgaaatgataaaagttgtttgtgtaccgattagagtagacagactaggatgcattactcaaattaacaatcaaaaatga

SEQ ID NO: 5752 - RNA, 4539 nt, synthetic construct
  misc_feature 1..4539: note = Cas9 variant
  source 1..4539: mol_type = other RNA
atgaagaaaatattaggactagacttgggcacaaattccataggatgggccttaatcgaaaactctttcactgaaaaagaaggcaaaataaacgacatgggcgtgagaataataccaatgtcagcagacatacttggaaaatttgatgcaggtcaatcccactctcaaacagccgaaagaacgggatacagaggcactagacgactgtaccaaagagacaacctacgaagagaaagactacacagagtactacatattctaggattcctaccaaaacactacgatgaacatatagactttgaaaaacgacttggacaattcaaagaaggcaaagaaataaaattaaattatagatgtaacgtagaaaacaaacacgagttcatcttcatctcatcattcaacgaaatgctgactgagttcaagaaagcacaaccagaactgttttatcttaaatcaaatggagaagaaacaaaaattccctacgactggacattatactaccttaggaagaaagcactatcccaaccattaaccaaacaagaattagcatggatcatccttaattttaaccagaaaagaggatattaccaattacgtggtgaagaaattgacgatgataaaaataaacaatttgttaaactaaaagtaaaagaagtaatcaactctggcgaagccgttaaaggtaaacccctattcgatgttatcttcgaaaacggctggaaatatgacaaacaagtagtaaaaaccgaagactggatagatagaacaaaagagttcatcgttaccactaaagtcctcaaaaatggagacctaaaaagatcatataaaacagtagactcagaaaaagattgggcagcaataaaagctaaaacagaacaagacatagaaagaagcaacaaaactgtaggcgaatttatctatgaaacactgctagaaaatccaacacagaaaatccgaggaaaattggtaaaaacaatagaacgaaaattctacaaagaagaactcaaaaatatactaataaaacaaattgaactccaaccaacgctatttagcgaagaactatataaagcatgcatagaagaactctacccaagaaatgaagctcaccaaaacgcgattaaaaaccgagacttcatataccttcttatggatgacataatattctaccaacgtcctctaaaatctcaaaaatcaaatataagtggctgtcaattagaacaaagagtttattataaagccaataaagacagtggagagaatgaagaagtcaaacaagccgtcaaagcaataccaaaaagccatccactattccaagaatttcgaaactggcaatggctccaaaacttaaaaatatataataaagtagataccgaaaaaggtgaattgaccgatgtaactaaacaattactgccatcagaagacagctgggtaaacctatttaacttcttgcaatgcaagaaagaattagaacaaaaacaatttataaaatattttatcgacaagaaattaatcaacaaaactgaaaaagaccattaccgatggaattatgtagaagataagaaataccctttcacagaaacacgagcacaatttatatccaggttaactaaagtagaaggtatagaagaaatcaatacatttttagacaagaaaacccaaatcggcactaaagataattcaccattcgtaagccgaattgagcaactatggcatataatctatagtgtatctgacatcaaagagtatgaaagcgctctagaaaaattcgccataaaacaccacttaaatgaagagtcctttgtagcaaacttcattaaattccctccatttaaaagcgattacggaagttacagcaagaaagcccttaacaaactactaccactaatgcgtagaggtaactactggaccgaaaacgatatctcagaaaaagtcaaattaagggtatctgaaatcatggagagagttaacgctctaaatttaaaagaagactatagtagcaaagagctagcagaaacattagtaaacgtatcagatgatgatgtcaagaaacaacttataaaatcattcgtaagtttcaaagacagaaatccacttatgggcttgaacactttccaagcaacataccttgtttatggaaggcactcagaggtaggagacatacaaaattggaaaaccccagatgacatagacacatacctgaaaaacttcaagcaacattccctgcgaaatcctatcgtagaacaagtagtcacagaaacactaagagtagtcagagacatatggaaacaccatggaaaatcacaaaccaacttcttcaacgagatccatgtagaactaggcagagaaatgaaaaatccagcagacaaaaggaaaagaatttctgaaagaaacactgaaaacgaaaatacaaacaatcgaatacgcgaaatcctgaaagacctcatgaacgatgcatccatccaaggagacgtaagagattatagtccatctcaacaaggtatcctcaaaatatacgaagaaggagtctaccaaaatccaaaggtagattattcaaaggtaagcgaagatgaaataactaaaatacgcaggtctaacaaccccacacaaaaagaaatacaacgctatcgattatggcttgaacaaggatacatttcgccctacacctgtaaaccaatcccgctgtccaaactctttacccaccattaccaaatagaacacattatccctcaatcgagatactttgataatagctcatcaaacaagatcatctgcgaatcagaagtaaacgaagataaagacaacaaaactgcttttgaatatctcaaggataaaggcgaaaacgttataaacggtcataaattgctatccttggcagcctatgaagcacacgtgaataaatacttcaaaaacaaccgacaaaaactcaaaaatttactcagtgaagatatacccgaagggttcataaacagacaaatgaatgattcacgatatatatctaagctagtaaaaggtctattaagcaatatagtacgtgaagaaggtgagcaggaagtgaccagcaaaaacctaatacccgtcacgggctctgtaacaagcaaacttaaaaatgactggggactaaacgacaaatggaatgaactaatactacctcgttttaaaagacttaaccaactaacacaaaccaatgattttacaaccgcaaatacgaatggaaatacaatacccacagtgccagacgaattacttaaagggtttagcaagaaacgaatagaccatcgacaccacgctctagacgcactcgtagtagcatgttgcacccgaaatcactcaaactacctgtcagcattaaatacagaaaataaaaactatggattaagagacaaattactaattaaaaatgacaacgaccactacacaaaaagtttccaaatgccatggcacgggtttaccaccgaagctaaaaaccaactcgaagagaccgtaattagctttaaacaaaacctacgagtaatcaacaaagccaataacaaattctggagctacaaagacgaaaatggaaaactaaacttagacaaaaacggaaagccaatcaagaaattaaggaaacaaacaaaaggagataattgggcagtgcgccaacccctgcacgaggaaactatctccggaatagttaacctaccatgggtcaaagccgaaaaagaaaaattcacatacgcgacaagaaaatccctggacaaatcattcgacctcaagaaaatagagaaaataactgacacgggaatacagaaaatattgcggaactacctgatgcaagagaagttcaaagaattggataagaaagacaaagaagtctacaatagtgagctcgctttctcacaagagggactagaagacttaaactccaacattgagcaatttaatgatcaaaagccacacaaacccatatacaaggtgagactattcgaaaaaggcagtggaagatttgccttaggttttaaaggtatcaatgctaagaaatacgctcagggctcacccaatttatacttcaacatttacagaaacgaagatggccaatattatgaaacagtaccacttaataaagtaataattcatcagaaaaacgcagcaaacatgcccaagaaaaatagaacaccggtaccaatttcaaacacagcaatcaatagaagcaaagaagttctagtcgactataaaatgacactcagtcccctcgacctagtctatatacctaccgaagaagagttaaacaacatcaactcattagattttaataacctgtcaaaaagccaaagaaaacgcctctataacgtaaatgatttcagcggttacactatctacttctcaccaaatactttagcaaaaagcatatgccctaaagaagtagatatgaaattcgacgagaaaaagcaaaaacccactggtagctttgattcaaagacagcttcgctagacggtatgtcgataaaagaacgatgcatcaaattaatcatagatagactcggcaacataagtaaagcatga

SEQ ID NO: 5753 - RNA, 4539 nt, synthetic construct
  misc_feature 1..4539: note = Cas9 variant
  source 1..4539: mol_type = other RNA
atgaaaaaaattttaggacttgatctaggcacgaattcgattggatgggcagttgtcaatgcagacgaaataactagagacgatggatcacgctatttaaaaccaaacggaatatcagcggcaggatcaagaataattccaatgtccgcagacatccttggtgatttcgaaaagggtaattcaatatcgcagactgcagaaagaacgagaatgcgaatggcccgacgactccatgaacgcgcactcctacgaagagaacgacttttaagggtattaaacctattagactttttaccaaaacatttcgcagacaaaattgaccgatatggaaaatttaccgatgacagcgagccaaaactagcatggagaaaaaatactgaaggcaaatacgaatttatttttcaagacgcattcaacgaaatgctggccgaattcaaagataagcaaccagagatagttgaagaaggcaaaaagataccatatgactggactatttattatctaagaaagaaagcacttgaaaaagctctcagcaaagaagaactatcatggatactcctacaattcaatcaaaaacgaggatattaccaattaagaggagaagaagaagaaattccacaagacaaaaaaatcgaatacttagctcaaaaagttgtcaaagtagaagcaactgaccaaaaaaaaggagacgatgtgtggtacaacgtctacctcgagaatggaatgatctatcgacgtacttcaaaagcgcccctcgattgggaaggtaaagtaaaagaatttatagtaacaaccgaagtagaaaacgacggagaaacgccaaaaaaagacaaagaagggaacataaaaagatcattcagggcacctaaagaggacgactggaccttactaaaaaaaaaaacggaagctgacatcgaaaatagtcataaaacagtagggtgctatatctatgactcattactaaataacccaaaacagaaaataataggcaaactagtaagaacagttgaaaggaaattctacaaagaagaactaacacaaatcttaaaaaaacaagtagaactcatccctgaacttagggacgacaacctttacaaacaatgtatcgaagaattataccccatcaatgaagcacacagaaatactatagccaagacagactttgctaatctctttataaacgatattttattctatcagcgtccactaaaatcaaaaaagtcgcaaatagataactgtccctatgaagaaagaatattcatcgattctaaaacaggagaaaaaaaaaaagtacccgtaaaatgcattgctaagagcaatcccctattccaagaattccgtttatggcaatttatacaaaacttacgaatctatcaaagagaaaaagaaattgatggcaaactattgactgacatagacatcacaagtgaatgtttaaagtcggaggaagactacgtgcgactgttcgattggctaaatgacagggaaacaatagaacaagaagatctactcaaacatctttttaacactaagaaaagtaaaaacaaagaaaatccttatagatggaactacgtcgaagacaaagtctatccatgtaacgaaacacgagcaacaatactaaaaggatttagcaaatgtggaataaacgcctcagttctctctccagaactcgaaatggcactctggcatatactctacagcgtagaagacaaaaaagaaattgaaaccgcgctaacacatttcgcacagaaacaaggatggaatgacgatttcgctaaagtattttcaaaggcgaaaccatttaagaaagattacggttcatactcggaaaaagctatcaaaaaacttttaagcctaatgaggatgggaaaatattggaaccaggacaatatagataaaaatacacttgacagaatagataaaataatcaatggggaatacgacgagaaaataagtaacagagtaagggacaatgccatcaacttaaaggacatctctgacttcagagggttgcctgtatggcttgcttgttacatcgtctatgataggcacagcgaagcaaaagactgtaccaaatggaattcccctgaagagatcgatagctacctcaaaaaattcaaacaacactccctaagaaaccccattgtagaacaagtagtaacagaaaccctgaggacggtgcgagatatatggatccaggaagaacaaatagatgagattcatctagaattaggtcgagacctaaagaaccccgcagataagcgtaaaaagatgtcggaaaatatactgaaaaatgaaaataccaacctgaggataaaagcaatgttaatggaatttatgaacccatcaatgggtattgagaacgtaaggccgtattcgccatcccaacaggacattctccgaatttacgaagagaatgcactggacaacttaacgaaagacgataaagacttcgatttcatatccaaaatcagtaaacaagcccaaccatctaaaactgatataattcgttacaagtgctggttagaacaaaaatatcgaagcccatacacaggtaaaaccatttcattatcaaaattgtttacaccagcatacgaaatcgaacatgttataccacaaagcttatacttcgacgacagttttagcaacaaagtaatctgtgaagcagaggtaaacaaattaaaggatagacaactcggatataaattcatcgcagaacatcatggagaaaaagtccaactctcacaaggagaagtcgttgaaatcttatcagtagatgcatatgaaaaattcgtcaaagaaaactacgcaaacaacaggattaagatgaaaaaactgctaatggaatctataccagacgaattcatagaaagacaattaaatgatagccgatacatatcaaaagtagtaaaagggctactctcaaacattgttagagaaaaaatcgatgatgaaaattacgaacccgaagcagtttcaaagaatctcatcagctgcaacggagctattacagataggctaaaaaaagactgggggatgaatgacgtatggaactccataatacttccaagattcattagaatgaaccaaattacaggcaaagactgcttcacgacaaccaatgcagaaggccacctaatacctcaaatgcctctcgaactacaaaaaggatttaacaaaaaaagaatagaccaccgccaccatgctatggacgcaatagtaattgcatgcacaaccagggaccacgttaacttattgaataatgaggctgctcacagtaaatttaacgcaactcgttatcaactccaaagaaaattacgacgattcgaaaaagccgtaatagacggtaaggaacgagaagtagcaaaagaatttctaaaaccctgggattcattctctagcgatagtaaaaacatattagaaaatataatagtctcatttaaacaaaatcagagggtcattaataagacaactaacgcatttttacacttcgacgaaaatggaaagaaaaccttcataaaacaaggcaaaggagactcatgggccatcagaaagagcatgcacaaagacacagtcttcggggaaataaacctacgcaaagtaagatccgtaagtctaaatgaagccatcaaggtacctgaaagagtactaaacaaaaaaataaaggaaaaaatattagaactaaagaacaacaagatagatgcaaaaaacataaaaaaatatatcgaagaaaatcacacaggtggatacggaatagactcaagtaaaattgatgtcttttattttaccaaagaaacaaaagaacgattcttcgcaacaagaaaaacattggatacctcattcaatcaagccaaaataaaagactcaattgcagattcaggtatacaaaagatactcctagcacatctaaaaagcaaaaatggagatgcagaacaagcattttcacctgatggaatagatgaaatgaataaaaacattgtagaattaaataatggaaaatttcaccaaccgatactaaaagtaagggtatacgaaaaagccgacaaattcgcagttggacaaaaaggaaacaaaaaagtaaaatttgtagaagccgccaagggtactaacttatttttcgcgatctttgagaaagatggaaaaagaagttacctcaccataccattaaatgtaatgatcgattgtcagaaacaatacggaaatcaatggaaaaacaatatagaggcttacctgaaagagaaggaactagtggaaaaagatgtaaaactacaatttatattaagcccaaatgacttagtctacctacctaccgaaggcagcatagacaaaaaaagaatttataaagtagtctcattcacaaataatagactatatgccataccttacgcgatagcaaaatcaatcgtagataaaaatgaatttacacagctaaacaaaatagaatttacagacaataaggaatccataaaagacgcctgcgtcccagtaataatagatcgtctagggaacgttatagaatttaacggaaaaagactctga

SEQ ID NO: 5754 - RNA, 4539 nt, synthetic construct
  misc_feature 1..4539: note = Cas9 variant
  source 1..4539: mol_type = other RNA
atgaaaaacatccttggacttgacttgggaacaaactccattggatgggcagtcataaattctgaggaagacggaccaattgtgaagaaacgaatagagttagcgggttcacgaataattccaatggacgcggctgtactaggtaacttcgactccggtgttacaaaatcacagacagcggaaaggacctcatttagatcaatccgaagactacgggaaagacaactactaagacgagaacgacttcacaaagtattacaaattctaggatttcttccagaacattacgtaaatgatatagattttgaaaatcacccgggcaaaataaaaagaaacacggaaccaaaacttccatggcgcaaaaattcgatgggccaatttgagttcatctttcaagatagctttgaagcaatgctaacagatttcgcaacacaccaaccagtctttgtatcagaaggcaagaaagtaccatatgactggacactctattatttacgaaagaaagcgttaacagagggaatttctaaagaagaattggcgtggctaatactaaattttaatcaaaaacgaggatattatcaattaagaggagaagaagaagaagaacaatccaacaaattagtcgagttctacgctttgagggttgtcaaagttgaagcaacggacgataagaaaggtaaagatacatggtacaacgtgcatttagaaaacggatggatatatcgtcgaacatctaatatccctttggactgggaaggtaaagttaaagaatttatagtaacaacagacctaaatgaagatggaacacctaaactagacaaatatggagaagtaaaacgatccttcagagcaccaaaagaagatgactggacgctcattaaaaagaaaacagaatctgatatagcgaacagccacaagacggtaggatgttatatttacgatgcacttctacaaaatccccatcagaaaataaaaggtcgcttagtgagaacggtcgaaagaaaattttataaggaagaattaagactcattctagaaaaacaactcagctttcacccagaactacaagatcgcgatctataccgagcgtgcattgacgcgctctatgtatctaatgaagcacacaaaaataacatcagcggaagagactttgtatacctattcatagatgacataattttctatcaacgaccactaaaaactaagaaaagcctaatcgataattgtccctacgaagaaaatcaatacatggacagagaaaccggagaagtaaaacaggcgcccatcaaatgtatcgcaaaatcacatccattatttcaggaatttagattatggcaatttatatcaaacataagaatataccagagagagcgtgttctagatgatggcaaactggaaacagacgtagatgtaactcccgattttctaaaaacagaagacgactacacaacactatttgagtggtttaacgatcgaaaggaagtcgaccaaaaagcatttctgaaaaatccacaattcggattaaagaaaacatttactgagtacagatggaattatgtcgaagacaaatcgtatccctgtaacgagactcgcaatgcaatattaaatggactacagaaagctggtgtgagcgcagacttcttgtccagagaagtagaagaagccttatggcatattctttatagtgtagaagataaaatagaaatagaaagcgcactacgaaaattcgcaagcaaacatgaccttgacgatagatttgcagacgttttcaagaaactcccacctttcaagaaagaatatggggcatatagcgcaaaagctataaagaaactattaccactcatgaggataggaaaatattgggaactttcaaacatagacgataaaacaaaagaacgaattgataaaattatcactggcgaatgggatgaaaatatacacgatcgagtaagagaaaaagctataaagctaagtgatattacagattttaaaggattacctctttggctaagttgctatgtagtatataatcgacacagtgaagcccgagccatagccaaatgggagagccctgaagacattgatagttacttaaggctattcagacaacacagtttaagaaacccaatagttgaacaagtaataacggaaacattacgaacggtaagggatatatggaaaagagtaggacaaatcgacgaaatacacgtcgaattaggcagagaaattaaaaacccagcagataaacgtgcaaaaatgaccgcacaaattgttgaaaacgaaaacacaaatctgcgaatcaaagcactattagcggaatttatcaactcagaatatgaaatagagaatgtacgaccttacagcagcaaccaacaagaaaaattgaaaatatatgaagatactgtactaaatggcgtaaaagaaattccagaggacattaatacgattctgaaaaagttcagagaatccgacttaaagaaaagacccacaaaaagcgactttttacactataaattgtggcttgaacaaaaatattgttcaccatacaccgggagaataattccgttgggtaaattgtttacaagtgcatatgaaatagagcatataataccacaagctcactacttcgacgactcatttagtaataaggtaatatgtgaagcagaggttaacggattaaaagacaaaaagctaggatacgagttcatcaagcataatccaggcaaaatggtagaaattggattcggcaaaccaccagtacgtatattttcagtagaagaatatgaaaggtttgtaaaggaaaactacagcggaatcaaaaacaaaatgaataaattattaatggatgacatacctgaaactttcatcgaaagacagcttaatgattctcgatacataagcaaagtagtcaaatctttacttagtaatatagtacgagaaaaagactctaatggtgaatatgagccagaagccatcagcaaaaatgtaatagtatgtactggctctgtaacagacagattaaaacgagattggggtgtaaacgacgtatggaatagcattatatatccaagatttgaaagactcaatgaattgacaggtagtcaacaattcggatgttgggagaacaaggaaggaaaaagagtttttcaaacagcagtcccattggaaatgcaaaaaggattctctaaaaagagaattgaccacagacaccatgcaatggatgccatagtcattgcatgtgcaacaagaaaccatataaattacctttctaatgaaagcgcatctaagaaagcaaaaatctcccggactgatctacaaagactactttgtaccaaatgcagaacggatgataatggaaattataaatggatagtaaagaaaccttggcccgcctttactcaagacataagaaaggccctggagaatataaccgtatcctttaaacaaaacttaagagtgataaataaaacaacaaactattatgttcatttcgacgagtcgggaaagaaagtacttgaaaaacaaatcaatggcgattcatgggccataaggaaaccaatgcataaagacacagtcttcggaaaagtcaacttacagaaagtgaaagaggtaagactctcactagcattagatacaccaaaaatgattgtagataagaaattaaaagaaaaagtcctacagttatactcctacaaatatgacaagaaaagaattgataaatatttcaaagaaaacgccagcttatggaaagacttaaacctatcaaaagtagcagtttactactttacaaacgatagtactgaacccttagtagcagtgcgtaaaccactcgatacatcatttaatgcaaagaaaatcaaagaatctgttacagacaccggaatacagaaaatactcctgaaccacttatctaataatcaagacgatccaaacctcgcattttcgcccgatggaatagataaaatgaacaaaaacctaacggcactaaatgatggcaaataccatcaacctatatataaagtaagagtctgcgaaccgcaaggaaataaattttccgtaggtactagcggaaataaaacatcaaaatacgtcgaagcagcaaaaggaacaaatcttttctttgcggtctatcaaaccgaagatggcaaaagaagttatgaaacgattcccctaaacgttgtcatcgaaagagaaaaacttgggtggactccagtaccagaaaacaataacaatggcgataaattattattctggttatcgccaaatgacttagtatatgttccaacggccgatgaattaaataacggaatgcgactagataatatggacaaagggagaatatacaaaatgatcagctgttctggaccacaatgtttcttcattccacaaaacgttagtaacgcaatcatacctgtcatagagctgggagcaaacaataaagcagagaaaagctggaataacgaaatgatcaaagtagtctgtgtacccatacgagtggatagactgggttgcataacccaaataaacaatcagaaatga

SEQ ID NO: 5755 - RNA, 4551 nt, synthetic construct
  misc_feature 1..4551: note = Cas9 variant
  source 1..4551: mol_type = other RNA
atgaaaaatattttaggattagatctaggaacgaatagtataggatggagcgtaatccaagaaaaacacaatgaaaacaacgaatgtcaaaaactaatattaggtgctggatccagaataattcctatggacgctgcagtactaggggattttgcaaaagggaatacaatatcccaaactaaagatcgtacacaataccgtggagtaagaagactaagggaaagatgtctattgcgacgcgaacgattgtttcgagttctagacataatgggatttctacctcaacacttctccaatgcactaacgaggtacggaaaatttaaagatgctgacgaagaaccgaaaatagcttggagaaaagatgacgaaggaaaaatgcatttcctgtttgctgatagctttaacgaaatgatcgaagaatttcgatctgtccaacctgaattattgaaacgcggaatgaaagtaccatatgattggacactatactatctaagaaagaaagcaatgagagaagcagtaactccattcgaacttgcatggctaatacttagctttaatcaaaaacgtggctactatcaactaagaggagaagaagaaggtgaagctgacaattcaaaatccgaagaatacttggcacaaagagtcgtagatgttatagacacaggagagaagaaaggaaaatcgacatggtttgacattgtactggaaaacggaatggtttatcaccgcccagctgaaatcaaaccggactggatcggaaaaactaaagaatttatagttactacgcaatttgataaagatggcaaccccaagaaagacaaagagggaaacgtcaaaatgagctttaggatgccaaatgaaaacgactggaatttacagaaaaagaaagcagaaaaagatatcgatgaatctggcatgacagtaggagagtatatttacaatgctttattacataatcctaaacagaaaataaaaggtaaattagtcagagtagtcgaacgcaaatactataaaaatgaactccagaaaatacttgagtcacagaaaagatttataccgcaactgtcggacagtgcactatacgagaaatgtataaaagagctatatcaatcaaacgaggcatatagaaactcaatcagtaccagaaacgatttcacttatctgtttgtagataacataatattttaccaaagacctttaaaatccaagaaatccctaatcgacaactgtccgtatgaaagcctagcttacacaaaagatggcgaagaacataaagcacccgtgaaatgtatagcaaaatcgcaccccctctatcaagaatttagattatggcaatttatatcaaacttacgcatatatcaacgacaaaaacaagttggagataaagttaaattagatgtagatgtaacagacgagttcctccccacagatgatcggagagagtctttattcgattatcttaacgacaaaacagaaattaaacaagacgtattattaaaagagttctttagtatgaagaaacccaaaggtaaagacagcgtctacccatacagatggaactacgttgaagacaaatcatatccatgtaacgtaacaagaggaaaaatcttagcaaaacttaacagagctggaatatcagccgacttcttaagctcaaacggaaatgaagaatcactatggcacattctatacagtgtggaagataaaggagaattacgtaaagcattagcacgatttgcagccaaaaacggattagacgatgcatttacagaagcactagctgatatagaaccctataagaaagaatacggagcttattcagcaaaagcgctaaagaaattactaccattgatgagactaggtaaatattggaactacgataatatagccccagctacaaaagcaagaatttcaaaaataatagatggagaatacgacgaaaatataagaaacagggtacgagaaaaagcgatgtctttgaatagtgcgagccaatttcaaggtttacctctatggctggcatgttatatagtttacgacagacactcagaaagagcagactctgggagatggagttctccagaagacatcgacaaatatctgtcagacttcaaacaacattcactacgtaaccccatcgtagaacaggtagtgactgaaacactaagaacagttagagacatctggaaaagatacggtgaaatatcagaaatacatgtagaattaggaagagaaatgaaaaatccagcagacaaaagatcaaaaatgaacagacgaatgctagaaaatgaaaacgcaaatatgagagccaaactattactaacagagttcatgaatcctgaatttggcatagaaaacgtgaggtcctatagccccagtcaacaagaattattgagaatctacgaagacggggcaatcagcaatgcaggaagcgaaatcgacgacgaaataagtgacataatgagtcgattgagtcaagtggacgtcaagaaacaaccaacagccagcgaggtgaaacggtatatactttggcttgaacaaaactatagaagtccatatacaggacaaatgataccattggcaaaattattcactcctgcctatgaaatagaacacgttatacctcaaagcagatatttcgatgactcattctcaaataaagtaatatgtgaagccgaagtaaataaacttaaagatcgaatgctaggctacgagtttattaaacagcataaaggagaaaaagtatcgttatcgatgggaggcacagtagaaatattatcaccggaagaatatgtaagacacgtagagagtcaatacaaaaataataaagctaaaatgagaaaactactaatggacgacatacctgacgaatttattaatagacaattaaacgactcacgatatatttccaaactaatcattagtttacttagcaatatagtacgagaagagggcgaagaagaagctacgagtaaaaatgtaataagttgtaacggttcgataacagatagactcaagaaagactggggaataaacgatgtttggaatcatattatactgccaagatttagaaggttaaatgaattaactgggacagataaattcaccacatcaaataaagagggtcatgaagtcccagaaatgccactagagctacaaaaaggctttaataagaaacgaatcgaccataggcaccacgctatggacgcaatagttattgcatgcataacaagggaccatgtaaatcttttaaacaatgaagctgctatgtctaaaaataatgcaaatcgaatccaactctccaagaaattaagacgttatgaaagtgtagagatagaaaaagatggaattagaaaacagataagtatggctaaagagttcaagaaaccatgggagggttttacagcggatgtggaaaggacactaagagacatagtggtatcattcaaacagaacctcagagtaataaataaaacaacgaactactatcaacacttcaaagatggcaagaaaatttatagtccacaaagtaaaggtgactcatgggctatacgcaagagcatgcataaggaaactgtatttggagaaataaacataagaaggataaaggaagtatctctgaaagaagcaatgaagagaataaaagatatagcggataaagaattaagaagcaaaatagttgaactcatggcactacaatataatgagaagaaaattaaacaatatttttcagataacaaagacgaatggagcgatgtaaaccccaagaaaatcaaaatacactattttactaaagaaacaaacgaaagattctttgctactcgaaagccactagacaccagtttcgacaagaagaaaataaaaactcaagttgccgacacggcgatccagaaaatattactcaaccacctatcagctcatggtgataaagccgaaactgccttctcgccagatggaatagatgaaatgaatagaaatataatagaattaaatgatggaaaattccaccagccaatattgaaagtaaggatatacgaaaaagcagacaaatatgcagtcgggcaacaaggaaacaaaaagaagaaatacgtggaagcggcaaaaggaacgaatctattctttgcaatttacgctgaagagaaaatagatgagaaaacaggtgacacagtgattacgcgcacatatgactctattccattgaatgtggtcattgacagagagaaaagaggattaagcccagtacccgaaaatgaaaacggtgccaaaccaaaatacgtactatcaccaaacgacttagtatacgtcccaaacgaagaagaacgagaaaccggaagaatctgtgagccgctagataaagagagaatatataagatggtatcaagtaataagaaacaggctttctttatcaaatccgaagttgcatcaacaatagttgacaaatttgagttctcagcattaaacaaacaagaacgagcattaagtggggagatgataaaagagatatgtatccctatctcgataaacaggatcggagaaatcacattgaggtga

SEQ ID NO: 5756 - RNA, 4554 nt, synthetic construct
  misc_feature 1..4554: note = Cas9 variant
  source 1..4554: mol_type = other RNA
atgaagaaaatagtaggactagacctaggcactaacagtataggatgggccttaataaatgcttatatcaacaaagaacacttatatggaatagaagcatgcggttctagaatcataccaatggacgcagcaatactaggaaattttgataaagggaactcaataagtcaaacagcagaccgtacatcctaccgtggaataagacgacttagagagagacacttgttacgaagagagagactgcatcgaatattggacctgctaggattcctgcctaaacactattcagacagccttaaccgatatgggaaattcctaaacgatatcgaatgtaaactaccatgggtaaaagatgagacaggatcctacaaatttattttccaggagtcattcaaagaaatgttagcgaatttcactgaacatcacccaatattaattgccaataataagaaagtcccatatgattggacgatctactatctaaggaagaaagcattaacacagaaaatttcaaaagaggaactagcatggatcctcctaaatttcaaccaaaaacggggatattaccaattgagaggagaagaggaagaaacgccaaacaaacttgtagagtattactcattgaaagtcgaaaaagtagaggactcgggagaaagaaaaggaaaagacacatggtataatgtacatttagaaaacggaatgatctatagacgcacatcaaatattccactggactgggaaggaaaaacaaaagaatttattgtaaccactgatcttgaggccgatggttcccctaagaaagataaagaaggaaacattaaaagaagtttccgcgcccctaaagatgatgactggaccctcatcaagaagaaaacagaagcagacatcgacaaaattaaaatgacggtgggagcatacatatatgatacattactccaaaaaccagatcagaaaataaggggtaaattagtgaggactattgagcgcaaatactacaaaaacgaattatatcaaatcttaaaaacacaatccgagtttcatgaagaattaagagacaaacaactctatattgcttgcctgaacgaattatatcccaacaatgaaccccgaagaaacagtatatcaacaagagatttctgccatttattcatagaagatatcatattttatcaaaggcctctgaaatccaaaaagagcttaatagacaattgtccttatgaagaaaaccggtacatagacaaagaatcaggcgaaattaaacacgcatcaatcaaatgtatcgcaaaatcgcatcccttatatcaagaatttagattatggcaattcatagtgaatctacgtatatatcgaaaggaaaccgacgttgatgtaacacaagaactgttaccaacggaggcagattatgtaaccctatttgaatggttaaacgaaaagaaagaaatagatcaaaaagccttcttcaagtacccacctttcggctttaagaaaacaacttcgaattatcgatggaattatgtggaagacaaaccctacccatgtaacgaaacacatgcacaaataatagctagactaggtaaagcacacatcccgaaagcctttttaagtaaagaaaaagaagaaaccttgtggcacattctctacagcatagaagacaaacaagaaatcgagaaagcattacacagcttcgcaaataaaaacaacctaagcgaggaatttattgaacaatttaaaaattttccaccctttaagaaagaatatggatcgtacagtgctaaagctataaagaaactcctgccacttatgagaatgggcaaatactggagtatagaaaatattgacaatggaacgcgaataagaataaacaaaataattgatggagaatacgacgaaaatataagagaacgcgtcagacaaaaagccataaatctaacggatataactcactttagagctctcccactatggttagcatgctatttagtttacgatcgacacagtgaagttaaagacatcgtaaaatggaaaacacccaaagatattgatttatacttaaaatcatttaaacaacactcactaagaaatcccatagttgaacaagtaataaccgaaaccctgagaaccgtaagagacatatggcaacaagtcggacacatagacgaaatccacatagaattagggagagaaatgaaaaatcccgcagacaaacgcgcgcgtatgtcacaacaaatgatcaaaaatgaaaatacgaacctcaggataaaagccctacttaccgaatttctaaaccctgagtttggaatagaaaacgtaagaccttattccccatcacaacaggatttgctacgcatctacgaagaaggagtactaaattcaattctagaactcccagaagatatcggtatcatactaggcaaattcaaccaaacagataccttaaaaagacctactcgaagtgaaatattaagatacaaactttggctggaacaaaaatatagaagtccgtatacaggtgaaatgataccgctgtcgaaactcttcactccagcatatgaaatcgaacacattataccacaatcccgatattttgatgactcactgagcaacaaagtaatatgtgaatcagaaataaataaactcaaagataggtcacttggatatgaatttatcaaaaatcaccacggagaaaaagttgagctcgcattcgataaaccagtagaggtactaagcgtagaagcctacgagaaactggtccatgaaagctatagccataacagaagtaaaatgaagaaactattaatggaagatattcctgatcaattcatcgaacgacaactgaacgacagcagatacatatcgaaagtagtaaaaagtctactaagtaacatcgttagagaagaaaacgaacaagaagcgatttcgaaaaacgtaatcccctgtactggaggaatcacagatagactaaagaaagattggggtataaacgatgtatggaataaaatagtattgcctcgattcataagattaaatgaactaaccgagtcaactagattcactagcataaacactaacaacactatgattccaagtatgccactagaattacaaaaaggatttaataaaaagagaatcgatcacagacaccacgctatggacgccataataatagcttgcgctaacagaaatatagtaaactacctgaataacgtctcagcaagcaaaaacactaaaataactcggagagatttgcagaccctgctatgccataaagacaaaaccgataataatggaaactacaaatgggtcatagataaaccatgggaaaccttcacgcaagacacccttacagctctccagaaaataactgtcagcttcaaacaaaatttaagagttataaataaaactacaaatcactatcaacattacgaaaatggtaagaaaatcgtatcaaaccaatcaaaaggagactcatgggctatacgaaaatcaatgcacaaagaaacagtacatggtgaagtaaatcttcgaatgataaagacagtatcattcaacgaagcattaaagaaaccacaagctatagttgaaatggacctcaaaaagaaaatactggccatgctagaactcggctatgatacaaaacgcatcaaaaactattttgaggaaaataaagatacttggcaagatataaacccaagtaaaataaaagtatattattttacaaaagagacaaaagacagatatttcgcagtaaggaaacccatagatacatcattcgacaagaagaaaataaaggagagtataaccgacaccggaatccaacaaatcatgcttagacacctagaaacaaaagacaacgaccccactctagcattttccccagatggcatagacgaaatgaacaggaatatcctaatacttaataaaggcaagaaacatcaaccaatttataaggtcagagtctatgaaaaagcggaaaaattcacagtaggacagaaagggaataaaagaaccaaatttgtagaagctgccaaaggaaccaacttattctttgcaatttacgaaactgaagaaatagacaaagacaccaagaaagtaattaggaaaagatcttactccaccatacctctaaatgtagtgatcgaaagacaaaaacaaggtctaagttccgcaccagaagacgaaaacggaaacctccctaaatacatactctcgcctaacgacctagtctacgtacccactcaggaagaaattaataaaggagaagtagtcatgcccatcgatagagatcgcatttacaaaatggtcgacagttccggaatcacagcaaatttcatacccgcaagtacagccaatttaatattcgcgctacccaaggcgacagctgaaatctattgtaacggagaaaattgtatacaaaatgaatatggcattggatcccctcaaagcaaaaaccaaaaagcaataaccggtgaaatggttaaagaaatatgtttcccaattaaagtcgatcgtttaggcaacattatacaagtaggatcatgtatattgacaaattga

SEQ ID NO: 5757 - RNA, 4563 nt, synthetic construct
  misc_feature 1..4563: note = Cas9 variant
  source 1..4563: mol_type = other RNA
atgaagaaaatagtgggtctggacctcggaacaaattcaatagggtgggccctcataaacgcatatatagatgaatataacaaagaacacttatacggaatagaagcatgtgggagtagaatcattccaatggatgcagcaatcttagggaactttgataaaggaaacagtatcagtcaaacagccgaccggacatcttatagaggaataaggagactaagagaaagacacctactacgaagggaacgactacatcgaattttagacctcttaggattcttacctaaacattattcagactcactaaaccggtacggaaaattcttaaacgacatcgaatgcaaattaccatgggtaaaagatgaaacagggtcatacaaattcatattccaagagagcttcaaagaaatgctagccaacttcacggaacatcacccaatattgatagccaataacaagaaagtaccctacgattggacaatttattatctaaggaagaaagcattaacgcagaaaatatcaaaagaagaactagcatggattttattgaacttcaaccaaaaacgaggatactatcaactaagaggtgaggaagaagagacacccaataagctagtagagtactatagcctaaaagttgaaaaagtagaagactcaggtgaaagaaaaggaaaagacacttggtataacgtacaccttgaaaatggaatgatatacagaagaacatctaacatcccactagactgggaaggaaaaactaaagagttcatagtcactaccgacttagaagcagatggctcccccaagaaagacaaagaaggaaacattaaaaggagttttcgtgccccgaaagacgatgactggactttaatcaaaaagaaaactgaagctgatattgataaaataaaaatgacagtaggagcttacatatacgacacactattacaaaaaccagaccagaaaatacgtggcaaattagtaagaaccatagaaaggaaatactataaaaatgaactataccaaatattaaaaacccaatctgaatttcatgaagaattacgagacaaacaactgtacatagcgtgcttaaacgagctatatcccaacaatgaaccccgcagaaattcaatctcgacaagagacttttgtcatttatttattgaagacataatattttatcaacgacccttaaaatctaagaaatcgctcatagacaattgcccgtatgaagaaaatcgatatatagataaagaaagtggagaaataaaacacgcctcaataaaatgcatagctaaatctcatccactataccaagaatttcgcctatggcaatttatagttaatttacgcatatatagaaaagaaacggatgtcgacgtaacacaagaattattacctacagaggcggattatgtcacactctttgaatggctaaatgagaagaaagaaatcgaccaaaaagccttcttcaaatatccacctttcggctttaagaaaactacatcaaattaccgttggaactatgtagaagataaaccatacccgtgtaacgaaactcacgctcaaataatagcacgattaggaaaagcacatattccgaaagcattcttatccaaagaaaaagaagaaacactatggcacatactatactccatcgaagacaaacaagaaatcgaaaaagctctacatagttttgctaacaaaaacaacctatcagaggagttcatagaacaattcaaaaactttccaccattcaagaaagaatacggctcatactcagcaaaagcaatcaagaaactactacccttaatgcgaatgggtaaatattggtcaattgaaaacatcgacaacggcacacgaattagaattaacaaaattatcgacggtgaatatgacgaaaatataagagaacgagtaagacaaaaagccataaacttaacagatataacacacttcagagcgctccctttatggttagcgtgctacttagtatacgaccgtcactcagaagtcaaagacattgtcaaatggaaaatcccaaaagatatagacttataccttaagagcttcaaacaacacagtttgagaaatcccatagtagaacaagtcataaccgaaacactacggactgttcgagacatatggcaacaagtaggacacatagatgaaatacatatagaattaggtagagaaatgaaaaacccagcggataaacgtgcgaggatgagtcaacagatgatcaaaaatgaaaatacaaatctgagaattaaagctctcttaacagaatttttgaatccagagttcggaattgaaaacgtgcgcccatattctccgagccaacaggatctactacgtatatacgaagagggagtcctaaactcaattttagaactgccagaagacataggaataatactaggaaaattcaatcaaactgacaccctaaaacgaccaacaagatctgaaatattaagatacaaattatggttagaacagaaatatagaagtccttatacgggggaaatgattcctttatcaaaactattcacacccgcatacgaaatcgaacacataataccgcaatcacggtattttgatgacagtctaagcaacaaagtaatatgcgagagcgaaatcaataaactaaaagaccgctcacttggatatgagttcatcaaaaaccaccacggcgaaaaagttgaactagcgtttgataaacctgtcgaagtactatcagtggaggcatacgaaaaacttgtccacgaatcttacagccacaacaggtcaaaaatgaagaaactattaatggaagacatccctgatcaatttatagaaagacaactaaacgacagtagatacataagcaaagtcgtaaaaagtctactaagcaatatagtacgggaagagaatgaacaagaagcgatttccaaaaacgtgatcccgtgtaccgggggaataaccgacagactaaagaaagattggggaataaatgatgtatggaataaaatcgtgttacctagatttatacgtctaaacgaacttacagaatcaacacgattcacaagcataaacaccaataacacaatgataccatcaatgcctttagaattacaaaaaggatttaacaagaaaagaatagaccacagacaccacgcgatggatgcaataataatcgcgtgtgctaaccgaaacatcgtaaattacttgaataacgtctcagcatctaaaaacacaaaaattactagaagagatttacaaactctgttgtgccacaaagataaaaccgacaataatggcaactataaatgggtcatagacaaaccttgggaaacattcactcaagacacacttacagctctccagaaaataacagttagctttaaacaaaatttacgggtaattaacaaaacaacaaaccactaccaacattacgaaaatggcaagaaaatagtatcaaatcaaagtaaaggcgacagttgggctattagaaaaagcatgcataaagaaactgtacacggagaagtcaacctaagaatgattaaaacagtatcattcaacgaggcgctgaagaaaccacacgctatagtcgagatggaccttaaaaagaaaatactcgcgatgctcgaattaggttacgacacaaaaagaattaaaaattactttgaagaaaataaagacacatggcaagacataaatccgtcaaaaataaaagtctactacttcacaaaagagacaaaagatagatactttgcagtacgaaaaccaatagacacatcctttgataaaaagaaaataaaagaaagtataacagacacaggcattcaacaaataatgttacgacatctagaaaccaaagataacgatcctacactagctttctcacctgatggaattgatgagatgaataggaatatactaatcttaaacaaaggtaagaaacaccaaccaatatataaggtcagagtttacgagaaggccgaaaaattcacagtgggacaaaaaggtaacaaaagaacaaaattcgtagaagcagctaaaggaactaacctctttttcgcaatctacgagactgaagaaatagataaagacaccaagaaagttatccgcaaaagatcctactccactatacccttgaatgtcgttattgaaagacaaaaacaagggttatcatctgctccagaagatgaaaacggaaatctaccaaagtacatattatcacctaatgacctcgtgtatgtaccaactcaagaagaaatcaataaaggagaagttgtaatgcctatcgatcgagatcgaatatacaaaatggtagatagctcagggattacagctaattttataccagcatcaacagcaaatttaatattcgcactgccaaaagctaccgccgagatatattgcaatggagaaaattgcatacaaaacgagtatggcataggaagtcctcagagcaaaaatcagaaagcaatcaccggagaaatggtaaaagaaatatgcttcccaataaaagtcgacagactcggaaacataatacaggtaggaagttgtatactaaccaattga

SEQ ID NO: 5758 - RNA, 4563 nt, synthetic construct
  misc_feature 1..4563: note = Cas9 variant
  source 1..4563: mol_type = other RNA
atgaaaaagattgtcggcttagatctcggcacaaattctattggatgggccctcataaacgcatatatagacgaatacaataaagaacacctatatggaatagaagcctgcggtagcagaattataccgatggatgctgctatcttaggtaacttcgacaagggaaattcgatttcacaaacagcagatagaacgagttacagaggaatcaggcgactaagagaacgacatctcttaagaagagagagattgcacaggatattagacttactagggttcctaccaaaacactactcagattcactaaatcgatacggtaaatttttaaatgacatcgaatgtaagctcccatgggtaaaagacgagacaggatcttacaaattcatctttcaagaatcatttaaagaaatgctagctaatttcactgaacatcatccaatattaatagcaaacaacaagaaagtaccatacgattggacaatatactatttaagaaaaaaagcgctaacccaaaagatatcaaaagaggaattagcatggatactactaaattttaaccaaaaaagaggatattaccaattaagaggagaggaggaagaaacaccaaacaaattagtagagtattactcactgaaagtagaaaaggttgaagacagcggcgaaaagaagggaaaagatacttggtacaacgtacatttagaaaacggaatgatatatcgtcgcacctccaacatacctttagactgggagggaaaaacaaaagaatttatagtaactaccgacctggaggcagacggatcccccaagaaagacaaagaaggtaatataaaaagatcatttcgagccccaaaagacgatgactggacactaataaaaaaaaaaacagaagctgatatagataaaattaaaatgacagtaggggcatatatatatgacacacttttgcaaaaaccagatcaaaaaattcgcggaaaattagtaagaactatcgaacgtaaatattataaaaatgaattataccagatattaaaaacacagagtgagtttcatgaagaactacgtgacaaacaactatacatcgcttgcctgaacgaactatatccgaacaatgaaccacgacgtaattcaatatcaaccagagatttttgccatctattcatagaagacattattttctatcaaagacctctaaaatcgaaaaaaagtctgattgataactgtccatatgaagagaatagatacatagataaagaatctggtgagatcaaacatgcctccattaagtgtatcgcaaaatcccacccattataccaagaattcaggctgtggcaatttattgtaaacttacggatatatagaaaggagaccgatgtagatgtaacccaagaattattgccaactgaagctgactacgtaaccctattcgaatggctaaacgaaaaaaaagaaatagaccaaaaagcctttttcaaatatccaccatttggattcaaaaaaaccacaagcaattacaggtggaattatgttgaggacaaaccatacccatgtaacgaaacccacgcacaaatcataaccagattgggaaaggctcatataccaaaagcttttctatccaaggaaaaggaggaaaccttatggcacatcctctacagtatagaagacaaacaagaaatagagaaagccttacacagcttcgcaaataaaaataatctctcggaagagttcatagaacaattcaaaaacttccctccttttaaaaaagaatacggatcctatagcgcaaaagcaataaagaaactactccctctaatgagaatgggaaaatattggagcataaaaaacatagacaatggtacacgaattcgaataaacaaaataatcgacggagaatatgacgagaacattcgagaacgggtccgacaaaaagccataaacctaacagatataacacacttcagagctctaccactatggttagcatgctacctagtatacgacagacactctgaagtaaaagacatagtcaaatggaaaacacccaaagacatagatctctatctcaaatcattcaaacaacactctcttagaaatccaatagtcgaacaagtcattacagagacactacgaaccgtaagggatatatggcaacaagtaggtcatattgatgaaatccacatagaattaggtagagaaatgaaaagcccagccgacaaaagagcacgcatgtcacaacaaatgataaaaaatgaaaatacaaacctcaggataaaagctctactgacagaattccttaatccagaatttggcattgaaaatgttcgtccttattccccttcacaacaagacctattaagaatctacgaagaaggtgtcttaaattccatacttgaactacctgaagatattggaattatactaggtaaattcaaccaaacagacacattgaaaagaccaacaagatccgaaatactcagatataaactctggctcgaacagaaatatcgctccccttacactggcgaaatgataccgttaagcaaactctttactccagcttacgagatagagcatatcataccccagtcaagatactttgatgatagcctatcaaataaagtgatatgcgaatcggaaataaacaaactaaaagacaggagtcttggttatgagtttatcaaaaatcatcacggagaaaaggtagaactagcattcgataaacccgtcgaggtcctaagtgtcgaagcttacgaaaaactcgtccacgaatcttacagccacaaccgtagtaaaatgaaaaaactattaatggaagacataccagatcagtttatagaacgacagttaaacgacagcagatacatttccaaagtggtaaaatcgcttctcagtaatatcgtccgagaagaaaacgaacaagaagcaatctcaaagaatgtaataccttgcacagggggaatcaccgaccggctaaagaaagattggggaataaacgatgtttggaataaaatcgtgctcccaaggtttataaggttaaacgaactcacggaaagcacccgatttacatccattaataccaataacactatgattccaagcatgccactagagttacaaaaaggattcaataaaaaacgtatagaccacagacatcatgccatggacgcaataatcattgcctgtgcaaatcgcaacattgtaaactatctcaacaacgtcagcgccagtaagaacaccaaaattacacgacgcgatctacaaaccttactatgtcacaaagacaaaaccgacaacaatggtaattataaatgggtaatagataaaccttgggagactttcactcaggatacattaacagcactacaaaaaatcacagttagttttaagcaaaatttaagagtaatcaacaaaacaactaatcactaccaacactatgaaaacggtaaaaaaatcgtaagcaatcaatccaaaggagactcatgggccatccgaaaatcaatgcataaagagacagtccatggagaagtaaacctaagaatgatcaaaacagtctctttaaacgaagcactcaagaaaccacaagcaatagtcgaaatggaccttaagaaaaaaatattagctatgttagagctcggctacgatacgaaaagaataaaaaattacttcgaggaaaataaagacacatggcaagacataaatccgtcaaaaataaaagtctactactttacaaaagaaacaaaagatagatacttcgcagtcagaaaaccaatagacacatcctttgataaaaaaaaaataaaagaaagtataactgatacagggatacaacaaattatgctgagacatctagaaactaaagataacgacccaaccctagccttttcacctgatggaattgatgaaatgaaccgcaacatccttatattaaataaaggaaaaaaacaccagccgatatacaaagtccgcgtttacgaaaaggcagaaaaatttactgtcggtcagaaaggcaacaaacgcacgaaattcgtagaagccgcaaagggcacaaacctattcttcgcgatatacgaaacagaagagattgataaagatacaaaaaaagtcataaggaaaagatcttattcaacaataccccttaacgtagtaatagaaaggcagaaacaaggtttatcttcagccccagaagatgaaaatggaaatttgccaaaatacatccttagcccaaacgatttagtatacgtaccgacacaagaggaaatcaataaaggagaagtagtcatgccaatagacagagatcgaatttataaaatggtagattctagcgggataacggcgaatttcataccggcaagcacagccaacctcatcttcgcactaccaaaagcaactgcagaaatctactgtaacggagaaaattgcatacaaaatgagtatggaattggtagtccacagagcaaaaaccagaaagcaattaccggagaaatggtaaaagagatatgctttcctatcaaagtcgaccggcttgggaatataatacaggtaggctcatgcatcctcactaattga

SEQ ID NO: 5759 - RNA, 4575 nt, synthetic construct
  misc_feature 1..4575: note = Cas9 variant
  source 1..4575: mol_type = other RNA
atgaacaaaatcctagggttagatctagggacaaacagtataggatgggcaatagtacaaaaagacgaacaaggattctatgagaaaataataaacgccggaagtagaataattcctatggacgcagaaacaatgaataatttcaacaaaggaatcacgaaaagtccagcaagcgaacgaactcgatttagaggagccagaagactcatagaacgatccctgttgagacgcgagagaatacatagattattaaacacaatgaactacttgcctccacattacgctgaaaagatagattttgtcaaccgattaggaaaattcatcggcgaagaagaacctaaatacgcgtataaagtagatgaacacggaaaattccaatttatcttcaaagagagctttaacgaaatgcttaaagattttcaagataaacaaccagaattagtattaaacaataagaaagtcccatatgattggacgatatattacttaaggaagaaagcactaaatcgagcaatctcaaaagaagaactaggttggataatactacaattcaacaacaaaagaggttattatcaactacgaggagaagaagacgaaacattaacggaaggacaaaagaaagaatactttgctttgaaagtaataagagtggaagctgactcaagcagcgctggcaagaaaggagaagtatggtataacgtccagttagaaaatggctggatatatagatgtaaatccgaaataccattagactgggaaggaaaaataaaagaatttatcgtaacaacagaagtagatgaaaacgacaatgtgttaaaagacaaagaaggaaaagagaaaagaaaactaaaaataccagaagcaggcgactggacactcctgaaaaagaaaacagaatccgacctagacaaaagcgggaaaactgtaggagcatatatttatgacacgctcttatcaaacccagaccagaaaatcaaaggtggactaatacggacaattgaaagggaactatacagatccgaactggaacaaatactggataaacagaaagaatttcacccagaattaaaagatggcacactatacaataaatgcgtagaagaattgtacagatcgaatgaaagtcgtcgaatatccctaagtaattatgattttaccagatttataacagaagacgttatcttttatcagagacctttaaaaagcaagaaaagtttgatcgacaactgcagctttgaaagacgcaattatctaaatccaataacgaaagaactagcatatgcacccataaaatgtatagctaaaagccatcccctattccaagaatttcgcctttggcaattcatcaaaaatctacgaatcattgaaagagagaaaatagttggtgataaattaatgtttgaccaagatgtgacaactgagttccttccaacacaaaatgattacgtgatattgttcgattggttaaacgagcacaaagaaatagatcaaaaagcactcctcaaatatcccgcatttaacttaaagaaaaatatagacaaatacagatggaactatgtagagaataaatcgtacccatgcaacgaaacaagagctctactaaaagcgaaattaaataaagctgggaacataccaagcgacttcctggacaatgatacgttagaatccctttggcacatactatattccgtagaagacaaatttgaaatcgaaaaagcactaaaatcatttgctaccaagaaagaattgagagaagaacaaacagtagctttcgtaaaacaatttataaacataccaccattcaagaaagaatacggttcgtatagtgctaaagccatcaagaaactattacaattaatgaggatgggcagccgatggagtgagaacgagatatccgactcaacaaaagatcgtatccagaaactaatagacggtgagtgggacgaatcaataaaaaccaggaccagggataaagccattaaactaaatgaaataaacgacttccaaggactacctctatggcttgcgtcatacatagtctacgatagacacagcgaaagtggagacgtaatgaaatgggaaacaccagaagatatagattattatttgaagcacgtctttaagcagcatggcttaaggaaccctatcgtagaagtagtagttgttgaaaccctcaaagtcgtaaaagatctctggaaaacctatggatacttcaacgaaatacatatagaactcggacgagaaatgaagaaccccgctgataagagaagaagtatgacgaacaaaaatatagaaaatgaaaacactaatttaagaatcaaagcactgctcgcagaactagccaatcataaagatgtagaaggagttcgcccgtacagcccctctcaacaagaaatactgaaaatatatgaagaaggggtactagacatgttaaccaaagaagacccagattacgaatcaatcagcaaaatctcgaaaatggctttgcctagcagttcagaattaataagatacaaatgctggctagaacaaaaatacagaagcccctatacaggccaagtaataccgctggcaagacttttcactagcgaatacgagatcgaacatataataccccaatcaagatattttgatgatagttttagtaacaaagttatatgcgagtccgcagtgaacaaggacaaagacaatttactcgcatacgaatatattaaacaaaatgaaggcaaaataatagaaataggtctaggcaagaaagtaaaactatttaccgcagacagttatacagaatttgtacaatccaattacgtcgggagtgtagccaagaagaagaaattattaatggacactataccagattcatttatcaaaagacaactaaacgactcaaggtacatatctagagaaataatgaaactattatcaagtgtggtgagagagaaagaagaagaagaagaagaagaagaagaagaagcaatatcgaaaaatgtaatagtatgcactggggcaataacagacaaattgaaacgcgaatggggtttaaatgatgtctggaatactattatataccctcgctttgaaagactaaatcagttgacgaacagcgataaatttggacaatgggaaaacaagcaaggtaagaaagtgtttcaaatagaaatgcccttaaaactccaaaaaggatttaataagaaaagaatagatcaccgtcatcacgcaatggatgcaatagttatcgcatgtgcaacccaatctcatgtcaactacttaaacaatgaaagtgcacactcaaattcaaaagagaaaagatattacttaagaagaaagctccggagaattgaaatactcgaaaaacaagaactaaaagacggggtcacaataaccaagaaaatcgaagtagccaaagagttcaacaaaccctggccaacttttacacaagatgcacatgaagtgttacaatcaataatagttagtttcaaacaaaatttaagagttgtgaataaagccacaaacagatacgcttgctttgttaatggaaagaaggaaatagtaaaacaatcaaaaggagaaagttgggccattcgaaaacccatgcataaggacactgtatcagccgcagtttctctacgaaaaatcaagacagtatcattaagccaggcaatagacgattggacaaatattgtagacaaaagcctaagaaaagaaatcggcttattgtacagcaaatatggtcagaatggatcgaaaaatattataaaatactttaaggacagagacaacaagcataacggcctagacgtaagcaaagtcaatgtccactacttcgacaacgactacgcagcatctagagttgcattggaccacaaattcaattcagcaaaaataaaaagcattacagacacggggatccaaacaatattgttaaaacatttagaatcatataacgaaataaacggcgataaaataatagaacatcccgaattagcatttagcgctgacgggttagacatactaaacgctaatataaccaaactaaacaatggtaaattccacaagccaataaagaaagttcgaaaaaccgaaacacttggtttaaagttcatagtaggacaaacaggaaataaaagaaagaaatacgtagaagccgctgacggcacaaatctattctttgcaatatacgtaagcgtagatggaattagatcatataaaaccatcccattacgcgaagttgcggaaagactcaaagaaggcttaatacctgtaccagagaaaaatgacaaagacgaccacttgctgttttggctatcgccaggagaccttgtgtatgtaccatcaatagaagaagaaggccgaatagtggaaatagagaacataaaacaagatcgaatatataaagtcgtatcctgtacagaaaacgaatgtcactgtatcccgcatttcgtagcatccccaatagtaaaaacagatgaactgggagctaataataaagcacaacgtgcatggtcaggagagatgataaaagaaacgtgcattaaaataaaaatgaatcgactaggacaaatcgtcaaaatttga

SEQ ID NO: 5760 - RNA, 4581 nt, synthetic construct
  misc_feature 1..4581: note = Cas9 variant
  source 1..4581: mol_type = other RNA
atgaagaaaatacttggactcgatctaggtaccaattcaattggatgggcagtcctcaacgcagctgatgataactccttaaaatacatagaagctgccgggagtcgaataataccaatggatgctgcaattctcggagattttgatcgaggtaactcaatatcacaaacggcggaacgaacgagaattagaggaatgagacatctgcgagaaagatacttactacgcagagccagacttcaccgaattttaaacttattaggatttttaccattccactatgcacaagatatagacaggtacggtaatttctcagccgacatggaaccaaaaattgcttggaggaaaaacctggaaggggaactcgaatttatattcatagaaagtttcaacgaaatgttagaagactttcgcaaaaaccaaccggagctagtagcagacaataagaaagttccctacgattgggtgatttactaccttagaaagaaagcgttagagaagaaaatatcaaaagaagaattagcctggattcttttaaacttcaaccaaaaacgaggttattaccaattacgcggagaagatgacgatgagtctatgaaaacggccaaaacaagacagtatttcgacaaacaaataatcaaaaacataatagacactaatcaaacgtataaaggccaacgaatattaatagtagaactccaaaatggagacaaaggaaaaattttcaagaaagaaattccagactggatagggcaagagaaaaacataatagtgaccgttgatatagacaaagacggcaatgacaaatacgaagaatcaggaagtttaagctgccgtttcaaaatacccaccgatgctgaatgggaaagcgaatggaaattaataaaaatgaaaacgcaaaaagacctagacgaatctaacaaaaccgttggaacctacatctatgactcgattttgcaaaatcctacacagaaagtacggggaaaattagttcgcacgatagaaagaaaatactataaagcagaactaaaacaaatactagaaaaacaaacagaatttcacagcgaattgcaagataaagatttgtacatcgaatgtctgaatgaattatactctaataacgatacacaccgaaacgcaataactgacagagacttcgtatatctatttatgaatgatatcttattctatcaaagaccattaaaaagcaagaaatcattgatagataactgtccatacgaaagaaatatttacatagataaagaaacaggagagataaaatactcacctatcaaatgcatagcaaaaagtcatcctctatttcaagagttcagattatggaagtttatctcatcaatccgcatataccaaagggaatctgtcgtagaagtagtcgataaacaactagacttattcagttcacaaagcacaagcgtacaaaaattagtaacagacgtagacgtaacagacaaatttctaacatgtgaaaacgactacgtcgcactattcgaatggcttaacaagaagaaaataatagatcagaaagagttcttaaaataccgcccatttggtcttaaaggtgacatagataattatagatggaattatgtggaagataaaagctatccctgcaatgaaacacatgcaatgatattgacttactttgccaaagcggggatatccgaagatatactgaccaaagaaatggaagaagcgctctggcacatcctgtattcagtagaggacagacaagaaataaccaaggctttaagaacatttgcgtcaaaataccacttatcggattcgttcgtgaaagtattctcgaacatacccccatttaagaaagagtacggaagctactcagctaaagccatcaagaaattattgagcctaatgagaatgggaaaatattggagcgaagacgcaatcgacgtgaatacaagagagagaatagataaaatagtcacaggagaatatgacgagaaaattagagatagagtccgagagaaaacgattagactaaacgacataagacacttccgggcccttccagattggttggcatgttacgtagtatatgaccgccactctgagacaagagaaatcacagaatggaaaagcccagaagaaatagatgaatatataagaaacttcaaacaacacagtctgcgaaatcccatagtcgaacaagtaataacagaaacattacgcacggtaagagacatctggaaacaggttgggtgcatagatgaaattcatgtagaactgggcagagaaatgaaaaaccccgcagataaaagaaaaagaattacttcgcaaataatagaaaacgaaaatgccaaccttagagtaaaagcattactcacagagttcgtaaacccagaatttgaaatagaaaacgtaaggccatacagtttgggccaacaagacatattaagaatatacgaagacggagtattaaacagcgtcgctgaggtcccaggggatatcgccgggattcttaagaaatttaatgaaaatgacgccaagaaacgaccgacaacaagtgaaatcctaagatacaaattatggttagaacaaaaatataggtctccatacacaggcgaaatgatacctttatcaaaactattcacaagtgcttacgagatagaacatgtcatacctcaaagcagatacttcgatgactcttttagtaacaaagttatatgtgaagctgaagttaacaaactaaaagacaatgcactaggctatgaatttatcaagaaacaccacggcgaaaaagtagaattaggtttcggaaaaatcgtagaaatattctcagtctcagtgtacgaacaatttgttaaagacaactacagtagaaatcggggaaaaatgaagaaactactaatggatgaaatacccgagcaattcatagaacgacagctaaacgattcgaggtatatatcaaaagttgtaaaaacgttactatcaaacgtagttcgcgaaaaagccgaacaagaagctgtgagcaaaaatgttatcgtatgtaccggaggagttacagatagattaaagaaagactggggaataaatgatgtttggaacaaaatagtgttacccagatttcttcgtctcaatgaattaacaaattcaacaaatttcacagctaaaaatgcagcaggaaacgaaataccagcaatgccacttgaactacaaaaaggctttaacaagaaaagaatagaccacagacatcacgcaatggacgcaattgtcatagcctgcgccaatcgaaacatagtaaattatctaaataacgaatcagcgagcagaaaagccaaaataagtcgccatgatctacaagcaatactttgcgacaaagtaagaactgacgacaaaggcaactatcaatggcgagttaagaaaccatgggacacctttactcaagacgtctacgtagctttagaaaatatcatagtgtcattcaaacaaaaccttcgggtaataaacaaaacaagtaactactattggcattatgaaaacggcaagaaagtgttagtcaagcaagtaaagggtgatagctgggccataagaaaaccaatgcataaggacactgtattcggagaagtaaatttgagaaaagtgaaatccgtaagtcttaacgaggcacttaaaaaccctcaatttattgtagaaaaggatctaaaaagacaactactaagcctattacagcaaaacttcgacatcaagaaaattaagaaatactttgaagaacataaagatatttggtcagacatctccctgtctaaaatgaatatatactatttcaccaaagaaacgaaagaccgctacttcgcaactaggaaaccattagacgcatcatttgataagaagaaaatagaaagttgcataacagatacgggaatccaacagatattgttaaggcatttagaactgaaagagaacgatccagaaagagccttctcaccagacggcatagacgagatgaacaggaatattattcaactaaacaaaggcaaaggacaccatccgatagcaaaagtacgagtctatgaaaaagcagataaatttgaagtcggtcaaagaggtaataaatcttcaaaattcgtagaagccgcaaaaggtacaaatctattctttgcagtttatgaaacagaatacccggatgagaaaactaactcgatagtacgaaaaagaaactatgcaaccataccattaaacatagccatagaaaggcagaaaagagggctatcgacagctcccgaagatgaaaaaggtaacgtaccatcatttgttctatctcctaatgatttagtatatcttcctacatctgaagatatagtaaacggacatataacacaaccgatagataaatcacgaatatacaagatggtttcaagcagcggatcacaatgcttctttataaaacacaatatagctaacataatagtagataaatatgaatttagcccactaaataaaatggaacgtgctatttctaatgaaatgataaaagaaatttgtataccagtcaaagtggaccgattaggtaatatagtaaaattaggaaaatccgagtga

SEQ ID NO: 5761 - RNA, 4581 nt, synthetic construct
  misc_feature 1..4581: note = Cas9 variant
  source 1..4581: mol_type = other RNA
atgaagaaaatattaggactagacctaggaacaaattcaataggatgggcggtcctaaatgctgcggacgataactcactaaaatacatagaagcagccgggagtagaataataccaatggatgcagccatactaggagacttcgatagaggtaacagtatttcccaaacggcggaacgtacgagaatacgaggaatgagacatctaagagaaagatatttactcaggagagcaagactacatagaatactgaatctactcggtttcctcccattccactatgctcaagatattgacagatacggaaatttttcagcagacatggaaccgaaaatagcttggtgtaaaaacctagaaggcgaattggagttcatattcatagagagcttcaacgaaatgttagaagactttaggaaaaaccaaccagagttagttgcagataacaagaaagtaccctatgattgggtcatatactacttaagaaagaaagctctggaaaagaaaatttcaaaagaagaattagcttggatactactaaacttcaaccagaaaagaggatactatcaattaaggggcgaagatgacgacgaaagcatgaaaacagcgaaaacacgacaatatttcgataaacaaattatcaaaaacatcattgatacaaatcagacatataaaggacaaagaatactcattgttgaactccaaaacggcgataaaggtaaaatttttaagaaagaaatacctgattggatcggccaagagaaaaacatcatagtcactgtagatatagacaaagatggcaatgataaatacgaagaatcaggaagtttaagctgtcgattcaaaattccaacagacgctgaatgggaatcggaatggaaacttataaaaatgaaaacacaaaaagacctagacgaatcgaacaaaacagtaggtacttacatctacgacagcatattgcaaaatcccacacaaaaagtacgaggaaaattagtacgaacaatagaacgaaaatattataaagccgaacttaaacaaattctagaaaaacaaacagaatttcacagtgaactacaagacaaagacctatatatagaatgtttaaacgaattatattcaaacaatgatacacaccgcaacgcaattacagacagagactttgtgtacctattcatgaacgacattttattttaccaacgtcctttaaaatccaagaaaagtctcatagataactgtccatacgaaagaaacatatatatagacaaagaaaccggggagatcaagtatttgccaatcaaatgcatcgctaaaagccaccctctatttcaagaatttagattgtggaaattcatatctagcattcgaatctatcaaagggaatcagtcgttgaagtggtggacaaacaattagatctctttagttcccaatcaacctctgtacaaaaacttgtgacggatgttgacgtcacagataaattcctaacatgtgaaaacgactacgtcgccctcttcgaatggctaaacaagaagaaaattatagatcaaaaagaatttctaaaatacagaccgttcggactaaaaggcgacatagataattatcgttggaactacgtcgaagacaagagctacccatgtaatgaaactcacgctatgatattaacctatttcgcaaaagccggtataagcgaagatatactaactaaagaaatggaagaagcgttatggcacatcctttactcagttgaagaccgccaagaaataacaaaagccctcagaacatttgcatcaaaataccatctatccgacagttttgtaaaagtattcagtaatatacccccttttaagaaagaatacggaagctactctgcaaaagcaataaagaaactattatcattaatgcgaatgggaaaatactggtccgaagacgcaatagacgtgaacacaagagaaagaattgataaaatagtaacaggtgaatacgatgagaaaataagggacagagtaagagagaaaacaatcagactaaacgatataaggcacttcagagcactgcccgactggctcgcatgttacgtagtatacgacagacatagcgaaacaagagaaataacggaatggaaaagcccagaagaaatagatgaatatatcagaaactttaaacaacatagcttacgcaacccgatagtcgaacaagtaataacagaaactctaagaacagtcagagatatatggaaacaagttggatgtatagacgaaatccacgtagaactaggacgagaaatgaaaaaccctgcagataaaagaaaaagaatcaccagtcaaataatagaaaacgaaaatgctaacctccgagtaaaagcgttacttacagaatttgtaaatcccgagttcgaaattgaaaatgtacgaccgtatagtctatcacaacaagatatcctaagaatttacgaggacggagtactaaactccgtagctgaagtcccaggcgatatagctggcatactcaagaaattcaatgagaacgatgcaaagaaaagaccaacaacaagtgaaatattaaggtataaactttggttagaacaaaaatatagatcgccatataccggcgaaatgataccgttatcaaaattattcacaagtgcatatgaaatagaacatgtaattccccagagccgatactttgatgactcattctcaaataaagtaatatgcgaagcagaagtaaacaaattaaaagacaatgctcttgggtacgaatttattaagaaacaccacggtgaaaaagtagaacttggttttggcaaaatagtcgagatattttccgtaagtgtgtatgagcaattcgtaaaagacaactactcaagaaacagaggaaaaatgaagaaattgttgatggatgagataccagaacaatttatagaaaggcaactaaatgattcaagatacataagtaaagttgtcaaaacactactttcgaacgtagtccgagaaaaagctgaacaagaagcagttagcaaaaacgtcattgtatgcactggtggagttactgatagactaaagaaagattggggaataaatgatgtttggaataaaatagtattaccaagatttctaagacttaacgaattaacaaactcgactaatttcactgccaaaaacgccgctggaaatgaaatacctgccatgccactagaattacagaaaggctttaataagaaaagaattgatcaccgtcaccacgctatggacgcaattgtaatagcttgtgcaaatcgcaacatagtcaattatctcaacaatgaaagtgcaagtcgaaaagcaaaaatctcgagacatgacctacaagcgatattatgtgataaagtaagaactgatgacaaaggaaactaccagtggagagtcaagaaaccatgggacacatttacgcaagatgtatacgttgctctagaaaatataattgtttccttcaaacaaaatttacgagtaattaacaaaacatcaaactattactggcactatgaaaatggcaagaaagtcctagtaaaacaagtaaaaggagactcatgggcaatccgcaaacccatgcacaaagatacagttttcggcgaagtaaacttaagaaaagtaaaatctgtatcactcaacgaagcccttaaaaacccccaatttatagttgaaaaagatctaaaaagacaactattatcattactacaacaaaactttgatatcaagaaaatcaagaaatatttcgaagaacacaaagatatctggtcagatatttccctcagtaaaatgaatatatattatttcaccaaagaaactaaagacagatattttgcaacccgtaaaccgctagatgcatcattcgacaaaaagaaaatagaatcatgtatcacagataccgggatacaacaaatcctacttcggcacttagaattaaaagaaaacgatcctgaacgagcattctcaccagacggcatagatgaaatgaataggaacataatacaattaaataaaggtaaagggcaccacccgatcgcaaaggtcagagtatacgaaaaagcagataaatttgaagtaggtcaacggggaaataaatcaagcaaatttgtagaagctgcaaaaggaaccaaccttttctttgcggtatatgaaaccgaatatccagatgagaaaacaaactctatagtcaggaaacgaaattacgcaaccatacctttaaatatagccattgaacgccagaaaagaggattatcaactgcacctgaagacgaaaaaggtaacgtaccatctttcgtattatccccaaatgatttagtatacctaccaacctctgaggacatcgtaaatggtcatatcacccaacctatagacaaatcccgcatttataaaatggtatcatcaagtggatcccaatgctttttcattaagcacaacatagcaaatataatcgttgacaaatatgagttcagtccactgaacaaaatggagagagcgattagtaatgagatgataaaagaaatttgcatacccgtcaaagtagatagattaggcaacatagtaaaactaggaaaatccgaatga

SEQ ID NO: 5762 - RNA, 4584 nt, synthetic construct
  misc_feature 1..4584: note = Cas9 variant
  source 1..4584: mol_type = other RNA
atggcaaagatattaggactagatttaggaacaaatagcatcggatgggccattgtcgaaaaagatggcaacgatttcagcctagtagataaaggagttcgaatctttagtgaaggtgttaaatcagagaaaggtatagaatcaagcagggcggcggaaagaaccgggtatagaagcgccagaaaaataaaatataggagaaaactgaggaaatacgaaacgctgaaagtccttagtttgaacggaatgtgcccgctatccatagaggaagtagaggaatggaaaaaatcaggctttaaagaatacccactgaatccggaattcctggagtggcttagaactagtgatgatgagaacatcaatccttacttcttcagagataaagcttcaaaacaaaaagtcactcttttcgaagtaggtcgtgcattttaccatatagcacagagaagaggatttttaagcaacagactcgatcaatcggcagaaggtatactagaggaacattgccctaagatcgaagctctagtggaagatttaaacagtacggatgagatactaacatctctaaaagactatttctttgatacaggtattttagatgcaaacgaaaaaggtggatttgccaaagatctagacgaaggagacaaaaaattggtaagtctatatagatctatacaagcaatagttaaaaaaaacgacacggactttgaaaaaggtaaggcagaaataattgaaagacttaacaagaaagacgtgttgggaaaagtaaaaggcaaaatcaaagatatatcacaagccatgctagaaggaaatttcaagactcttggccaatacttcttcagcctgtataacaaagaacgaatcagaaaccaatacacttcacgagaagaccattacctagaggaattcaaaataatatgcaaattccaaggcataggtagtattaatcaaaacgaaaaactacccgaaaaaaaatttgagggattggctaaagaactgtataaagcaattttcttccaacgacccctaaaaagccaaaaagggctcataggtaaatgctcttttgagaaatcaaagagcagatgcgctataagtcacccagattttgaagaaaaaagaatgtgggaatatcttaacacaataaaaattggaacccaaagcgaaaaagtgttaagatttttaagccaagaagagaaattaaacttaattccgaagttcctcagaaaaaaagataacttcaactttgaagacttagcaaaagaactaatagaaaaaggcgcgacattcggcttttacaaaagcagcaaacgggattctttccattactggttcaattacaaaccaactgacacagtatcaggatgcccagtatctgcgagtctgaaaagtgtagttggcgaagattggaaaactaagagtttcatatataaaacgaccaatagcaaagggatagaagtatctagaacggtaaattacaaagacttatggcatttattgagcgtctcaacttcggacatctacctatacgaatacgcaaaaaacaaactgggacttgaagacaagaatgccaaagccttctccaaaatcaagctgaaaaaagattttggtaacctctcattaaacgcaataaacaaaatactaccctatatgagagaaggtctactatactcacacgcagtcttcatggcaaacatagagagtatcgtagatgaagttatatggaacgacttaggtcaacgtaaatacatacaagataaaatagcagctatcattgctaacaacatcgtggataacggtctattagaagtggtaaacggcttaataaaggagtgcaaagttgacggagcgtactattcaaaagaagcagccgacacataccgaaaagatctgagcaaaaaattagtcagcttttttaaatttcaccatattgatgatggaataaaacaagaaaccatcttgaacgaattattcccagtgttcatagaacaactcaaagcacacgaattcatcaaggttaaaagactagacgagaaagtcttagaattcctgaaaggtgagaatcaagacggagaagtattctgcaacaatgcaaaacaactcaaaaaactgtatcacccatccgacatagaagtatttaagaaacaaatagtcaaagacaaagatggcactgaaactggtcaattaatattagggagtcccctcaccagttcgattaaaaatccgatggccatgcgtgcgctacatcagttaagaaaagtactcaacacattgatagtggaagaacaagtagatagttccacgcgaattcacatagaaatggcaagagaactaaatgatgcaaacaaacggaagggtattcaagattatcaaaatgaaaacaaaaaagagagagaaaagtacagagatgaaataaaaaaactatacttagcagaatgtaacaaagaaatagagcccacagtggacgatctattacggtaccaactctggatagaacaagacagaaaagaaatatatgaaaacgggaatagtattagcatatgcgatataataggtgataacccagcatacgacatagaacacacggtacctagatcaataagccaagataattcacaaatgaacaaaacattatgttcacaaaaattcaacagagatgtaaagaaacagaaaatgccatttgaactagggaaccatctggaaatacttcctcgtatcgctcattggaaagaagaagcagacaacttaagcagagaaattgaaatgataatacggtcaacaaaaacggcagccacaaaagaagccaaagacaagaagatcagaagacggcactatttaaccttaagaagagactacttacagggtaaatacgacaggttcatttggacagagccaaaagtaggatttaaaaacagtcaaatacccgatacaggaattataacacggtatgcacaagcatatcttaaatcatatttcaatagagtcgaatcagtaaaaggaggcatggtagccgaatttcgtaagatatgggggatacaagaatcataccaggaaaatggcaaaaaatacttcaaagagaaagatagatcaaaacatacacaccatactatagacgccataactatagcatgcatgaccaaagacaaatatgacgttctggcacacgcttggacactggaagataaagaacaaataacagaggctcgtaaaatcgtggctgaatcaaaaccgtggaaaactttcaaagaggacctgaaaaaaatagaagaaggcatccttgtttcacactatacaccagataacgtaaaaaaacaaagcaaaaaaattgtcagggtgagaggaagaaaacaatacgtagcagaaatagaaagagatgtaaatggaaaagcagtggcaaagaaagatatttcaggaaaagtaatatataaactggacaaagatggtaaaaaattaccgcgactgcaacaaggagatacaatcaggggatcactacatcaagattcaatatacggcgcaataaaaaatccattaaaaacagaagagatacgatatgtaatccgtaaagatctcgaatccataaaagcatcagatgtagacaatatagtagatgaaatggtaaaagaaaaagtgaaagaagcaattgcctcaaaagtgctaatactaagctcaaacccacaacaaaaaaacaaaatcgatggaaaagtatggatgaacgaggagaaaggtataccaataaacaaagtacgattatatgcaaattcagtaaaaaacccactagagattaaagaacatagttcactctcaaagtcacgtcacgaacacaaacaaaaagtttatggacagaatgatgagaatttcgcaatggccatatacgaaggtctcgataaaaaaggaaaaacggaaagagccttcgaactaataaactacatggatgcaggatattactacaaactaaaaaataaaaacgaaaggaaaaaagatataatatcactggtaccggaaaaacatatcgaaacgggctttaatctactgagatcgaataaaatccccataattttaaaaaaaggattaaatgttatcttatataaaaacgagaaagaggaaatcgatttcaataatcctaacagtataattaaaaggttatacaaaataagtggattagataaggacggcattaaattgatgtactgcataagcgctaaaggatctacagaaaacatcgcttatatgaatgacgtcattaacaaacaaaaactgtttgagctcaaatcggaaatggaaaaattaggactatgggataaggttttcagtgactttaaaaacgacaatctaaaaaaaagtgactttttcaaaaaactaaatgatctattgaataaacactacttcgagaataatgtgtgtgactcaataggatccataaagaaggtaaaaatcaaagaatcaggactaacaaccccaaaaggaggtgacgtaatagataactttaaggacttcccgtacattaaattcaaagtgtccaacttcaatgcattaatagagggaatcgactttaaaatttcgccaactggaaaatttgtacaaatatga

SEQ ID NO: 5763 - RNA, 4587 nt, synthetic construct
  misc_feature 1..4587: note = Cas9 variant
  source 1..4587: mol_type = other RNA
atgaagaaaattcttggattagatctaggcacaaacagcatagggtgggcacttgtagaacaagattttaaaaataaacaaggtaatatcatgggaatgggatctcgagttataccaatgtcacaagaaatactcggagaatttgcacgaggaaatactaaatcagaaaccgcagaacgtacacgattgagatcagtaagaagattaagagaaagacacttacttagaagagaacgtctacacagagttctacatatcctgggcttccttccaaaacactatgtgaaccaaatagatttccaagaaaggctgggaaaattctttgaagaaagcgaacctaaactagcgtacgatacaggagatttcttattcaaaccgtctttccttgaaatgctagaagaatttaaaatacatcaaccgagctttgttgaaggtgacaagaaagttccatatgactggacaatatacttcttgaggaagaaagccctaacggaacgaattgaaaaagaagaattagcctgggttatactcagttttaaccagaaacgaggatattatcaacttcggggagaagacgaagaagaaaaaccaaataaactcgaagaattttactctctgaaaattgtggatattaaagtagacgaatctccgaataagaaaggagacacatggtatagtttaactttagaaaatggatggatatatagaagatcctcgaaagttccgttggatgattggctaggcaaaacacgagacttcattgtaactacagacatagatgaagaaggtaacccaaaactagacaaagagggaaatccgaaaaggagcttcagagcccccagcgaagacgattggggactaagaaagaagaaaacagagaaagaaatactggattcatcaaaaacagttggccattttatcttcgagaacctactagcagatcccacacagaaaataaaagggagattagtacgaacaatagaaagaaaattctacaaagacgaactgaaacaaatcctagtatcgcaaaatagatttcaccccgagttgtcagacgcagatatgatggccgattgtgtaagagaactatataaacataaccattcacatcaaaatttcctagcaagcaaagatatcaaacatctacttgtagacgatataatattctatcaaaggccactaagaagccaaaagtcaacaataggaaattgccccttggaatttaaaacatttaagaaagacggaatcgagataaaagtaccatataaagtggcacctaagtcgcaccctttatttcaagagttcagactactacaatgggtgtcatcattacgaataattagaaaatctgacgattccgatgtaacgagggagttcctaggcacgcaagataaaacaaaacaactcttggattacttaatgacacaatctgaaatggactgtaacaaattaatgacctttttactgacacaagagggttacaaaagaaaagacttgaagtcagaagttggaaaatttagatggaattatgtatttgactctgaaactggagaatcaaaaacttacccaggaaatagcacaagagcagagtttctcaagcgactaggcaaagtagaaggattcgatttctcgaaatatacagaagaatttgaagaatctctttggcatttggtatacagtgttaccgacaaagtagagttcgaaaaagccctaagaaaatttagtaggaaaaacggaatagaaatcaacagttttgtcgaaaacctcaagaaattcccaccttacaagtctgaatatgcgtcttattcattaaaagcaataaagaaattgctcgccctgatgcgtttcggggaaaattggaaagaagacagtattgattctataagtaaacaccgaatcgagaaaatattaacaggtgaatacgatccagaaataaaagacaaagtaagagaaatatctcgagcgtttgatgaagtagaagactttcaaggactaccagtttggtttgcaaattacgtagtttacggacgtcacagtgaagcgtctgaattgataaaatggacaagcagtgacgaaatggcagactttataaaagaatttaaacaacactctctgcgtaatccaatagtagaacaagtagtgttagagacattacgagtagtgaaagatatttgggacaaatacggtcatggacaaaaagacttctttgacgaaatacatgtagagctggggagagaactaaagaaccctgcagaacaacgggctaggctaactacacaaatatctgcaaatgaaaatactaatttaagaataaaaagtttattagtggaactattacacgacccaggagtggaaaatgtgagaccctactcaccaatgcagcaagaaatattgaaaatatatgaagaaggcgtacttaaatcaagtttcgaagtaccggacgatattcttaaaatatcaaaaacggcacaaccgagtagctcagatttaaaaagatataaactatggttggaacaaaaatatagaagtccatacacaggaaaaataataccattaaacaagctatttacccctgcatatgaagttgaacatgtaataccccaaagcaggtacttcgacgacagtttctctaataaagtcatatgcgaagcagctgtgaacaaactaaaagacaatagattaggtatggaatttataaaatgctttcacggccaaagagtatcattaggattcggggaagaagtcgaaatatttagtgagtctgcatacaaggcttttatacaagataacttcccgaaaaatcctgcgaagaaacgaaaactactaatggacgagctccctgaacaaatggtagaaagacaaatgaatgatacaagatacattagcaagttcgtaacaagcattttatccaacatagttcgcagtgaagagaatgacaccggctttaatagcaaaaatattattcctggcaatggcaaaataactacagctctgaaacaagattggggtctaaatgacgtatggaacgaattaattttaccacgcttcgagcgaatgaatcaactgacaggtaccacggtgttcacagcctggaatgagaatcaccaaaaattcttgcccacagttccactcgaatatgccaaaggatttcagaagaaaagaatagaccatcgacatcacgccatggatgcccttgttatcgcatgcgccacaagagaccacgtaaactacctaaataatgaacacgcattgggcaaaaactacaagggaaaagaggaaaaacaatcacgtcgatttgacttaaggcagaaactatgcctgaagaagaaaaatgggcacagccaagaacaatacgaatggatatttagcaaaccttgggattcatttacccaagatgccaagaaaaatcttgagagaatcatagttagttttaaacagaacttaagagtcatcaataagacttcaaacaaatatctatcttataaagacgaggagggtaatctaagacttgattcacaaggcaagcccgtaaaagcattaacgaggcaaataaaaggagatgcatgggcaatacgcaaatcaattcacaaagatacagtctctggccttgtgaagctcagaagagtaaaaatggtaaacctaagtgtagcattagacaacccagaaaacatattaaataagaaacttaaaaagaaaattgcagaactcgtaaaactaaattatgacaataaattactcttaaaatattttcgtgatcgcgactacatgttcgacggacgtgaagtctcaaaactagatgtatattactttgaagagggcttggctgcttctagggtttcactggacacaagtttttcggacaagaaaatacaatccataacagacacaggtatacgcaaaatattattggctcacttagcaaactaccacggaagactcgacgaaaaagggaaagtcattcctccagaaacattagcttttacgccagagggcattgaagaactgaacaaaaatataaaaggtctcaatggaggaaaattccatcaaccaatatttaaagttcgtacttacgaacccaaaggtaataaattccaagtaggcttcaaagggaacaaaaactctaaatatgtcgaagcagcaaaaggaacgaacctattctttgctatctatcttaatgacgaaggaaaacgatcatatgaaacaattccattcaacgtcgtaatggagagattaaaacaaggtgaaggaccagtaccacaaaccaacgagaaagggggaaaactgttatttcatctctctccaaacgaattggtctacgtcccagaaactgacgaaaattacaccaatgtagatttcaaaaatttaagtaaagaacaagtagagaaaatttacaaaatggtgtcaagtacagggtctgaatgccattttgttcgagcagatatatctagcttaattaaaggttacgatgccaaaaccaaagtaggagaactaggatcactcaataaacaagaagtaacaaataatggaatgactagaattaaagaaaaatgctggaaaataaaaattgatagactaggaagtatatga

SEQ ID NO: 5764 - RNA, 4587 nt, synthetic construct
  misc_feature 1..4587: note = Cas9 variant
  source 1..4587: mol_type = other RNA
atgaaaaaaatcctaggcatagatctcggaactaattcaattggctgggcagtagtcaacagtttcgacgaaaatcaaaatgaagaaagccttaaacatattgaatgtgttggctccagaatcataccaatggatgctgcaatactgggagactttgacaaaggcaattctataagtcaaacagcaaagagaacagaatttaggagcgtaagacacctaagagaacgacatttactcaggcgagcaagattacataaaatactaagcctgctcggcttcttaccagatcactacgtacaagacttagattctcatggcaatttcccagtgaacgtagagccgaaaattgcatggaggaaggactcaaacggagcatttgagttcatatttaacgatagttttgacgaaatgctccaagactttgcaacgtatcaacctgagctaatagcatgcaacaaaaaagtaccatatgattggaccatatattacttgagaaaaaaagcgctcactaaaaaattatcgaaagaagaattatcctggatactcctaaattttaatcaaaaacgaggatattaccaattgcgcggagaagaggacgatgaatctgtaaaaagcgcaaaaaccaggcagtattttgacagacaaaaaattaagagcatagtagatacaaaccaaacatataaaggccaaaaagtactgattgttgaattggaagacggtattaaaggaaagatattcaaaaaagaaattccaaactgggtaggacaagaaaaaagtatcatagtaactatcgatattgataaggacggatgcgataaatacgaagaaagtggcgaactaagttgcaggttcaaaattccctcagatgcggaatgggaatcagaatggaaacttataaagatgaaaacacaaaaagacttggacgcaagcggcaaaacagtaggggcgtacatctatgacgcaatattacaaaacccaagccagaagattcgaggaaaactagtacgtacaatagaacgcaaatattataaagaagaactcaaacagatattaaaaaagcaagtcgaatttcacccagaattaagagacaaggatctattcctggactgcttaaatgaactttatccaaacaatgatgcacatcgtaacgcatgtgcagacagagatttcatatacttatttatggacgatattcttttttaccagagacctttaaaaagtaaaaaaagtctcatcgcagattgtccatatgaaaaacacatgtacagagataaagaaaccggcgaattaaaatattccagcgtcaaatgcatagcaaagtcccatccattatttcaagagtttagattatggcattttatatcaaacatacgaatatatcagaaagaacgagtagtagacgtagatgctgaccaatcagcgctctcttcagcacgatccgcactgaagtcaaaattagaggctgacgttgatgtaacaaatgaatttctaacatgcgaagctgactacgtctcgttgttcgaatggctcaacaataaaaaaagcgtttcccaaaaagacttcttaaaataccccgcattcggaataaaaaagtctggggataattacagatggaattatgtagaagataaatcttatccatgtaacgagacaagagctctcatattatcacatctagagaaagctaacatacggggagatatattcacacgcgaacaagaagaagcactatggcacatcttatatagtgttgaagaccggtatgagatagtaaaagccttgcaatcttttgccgccaaatatagatttaatgacgactttgtgacagtcttcagcaaattcccaccttttaagaaagaatacggatcatactctgctaaagcaataaaaaaattattaccactaatgagaatgggaaaatattggtccgaagcagcaattgatatcaaaacacgagaacgtatagaaaaaataattacaggagaatgcgacgactccattagagagagagtacggcttaaagcgatacgcttacatgatataggagacttccgcgcactaccagtgtggttagcctgctatgtagtatatgatagacattccgagtcgggagatataacgaaatggaaaacgcctcaagaaatggactggtacatacaaaattttaaacaacactctctaagaaatccaattgttgaacaagtcattacggaaacattacgcgtagtcagagatatttggaaacaagtaggcagaatagatgaaatacacgtggaattaggacgtgaaatgaaaaacccagccgacaagagggcaaaaatgaccgcacgaatgatagaaaatgagaacaccaatttgagaataaaagctatgttaaccgaatttctcaacccagaattcgaaatagaaaatgtacgaccatactccgcaagccaacaagatattttaagaatatatgaaaacggagtcttaaactcagtaagcgaaatacccgaggaaataaccggtatactcaaaaaattcaacgaaagagaacaaagaaaaagaccctcaacttcagaagtgctacgctataaactatggctagagcaaaaataccgatcaccatataccggaaagatgatacctcttggaaaattgttcacaccagcttacgaaatagaacatataatcccacaaagtagatatttcgacgattcgtttaacaacaaagtaatatgtgaagcagaagtaaataaactaaagggtaatttactaggatacgaattcattaaaaaacatcatggacgaagagttgacttaggactcggggaaattgttgatatatttagtgttgacgagtatgaaacatttgttaaagactattacagtgcgaatcagcagaaaatgaagaaattactcatggatgaaatcccggaacaatttatagagagacaacttaatgactctcgatacatctctaaagtagtaaaatcgctattaagtaacatagttagagaacaagatgaacaagagtctataagtaagaacctcatcgtctgtacaggaggcgtgacagaccggctcaagaaagattggggcatcaacgacgtatggaacaaattaatattaccaagattccaaagactcaacaatatcacagaaaccaccgagttcacggcaaaaaacatgcaaggtcatgaaataccagtagtacctttcgaatatcagagaggtttcaacaagaaaagaatcgaccaccgtcaccacgccatggacgcaatagtaatagcctgtgcaggtcgaaacatagttaattacctcaataatgaaagcgcccgaaaaaaagcacaaatatcccgatacgatttacaaagactgctatgcgataaagtcaaaaccgacgacaatggaaactataaatggattttaaaaaaaccatggtctactttgacacaagacgtatatgctgcacttgacaacgttatagtatcatttaaacaaaatttaagagtaataaacaaaacaaataatcattacgttcattacgaagctggtaaaaaaatcatagcaaaacaggaaaaagcttcatgggccatacgaaaaccgatgcacaaggatacagtcttcggtgaggtaaatctacgtaaggtaaaaactgtttcactcaacgaagccataaaatcgccccactgtatagtacaaaaagactttaaaaaaaagttactcagtttactaaaacaaaatttcgacgcgaaagaagtaaaagcatatttcgaagaacataaagatgtatggtccgacataaacctatccaaaatcgaagtatattacttcacaaaagacacaaaagaaagatttttcgcgactagaaaaccactagactcatcatttgacagaaaaaaaatagagtctgtaacagatacgggaattcaaaaaatattgttacgacatttagaacaaaaaaacggagattcagatttagcatttagtccagacggcatagaagaaatgaatcaaaacatagtacaattaaacgggggcagaaaacaccaaccaatagtaaaagtacgggtttacgaaaaagccgataaatttgcaattgggcaacaaggaaataaggcgtcaaaatacgtagaagctgccaaaggaacgaaccttttttttgctgtatatgaagaagaagtcagagacaaaaaaactaacgcagtaatgttcaaaagaaactatgcatcgataccactgaacgttgcgatagacagacagaaaaaaggacttagcacagctccggaagacgagaacggaaacgcacccatttttgtacttagcccaaatgatctagtgtacctcccaaccgcggaagatataatcaatgcgcgaatatcatttccaataaataaaaaccgtatttacaaaatggtatcatgtacaggataccaatgtttctttataaagcaccatgtagcgaatgtaatagttgataagaaagaattttctgctcttaacaagatggaaaaagcggagacaaatgaaatgatcaaagatatatgtgttccaattaaactagatagactcggaaatatagtaaaaatcggggtatacaaatga

SEQ ID NO: 5765 - RNA, 4587 nt, synthetic construct
  misc_feature 1..4587: note = Cas9 variant
  source 1..4587: mol_type = other RNA
atgaaaaaaatacttggattagatttggggactaatagcatcggatgggcagttgtaaattcattcgacgaaaaccagaacgaagagagtcttaaacatattgaatgtgtaggatctagaataatacctatggacgccgctatattaggagacttcgacaaaggcaattcaataagccaaactgcaaaaagaaccgaatttagatctgtacgacatctacgcgaaagacacctattacgacgagcaagactacacaaaatactgagcttgttgggattcctaccagatcattatgtacaggatttagactcccacgggaatttcccagtcaatgttgaaccaaaaatcgcttggcgcaaagacagtaatggcgctttcgaattcatatttaatgacagtttcgacgaaatgttgcaagacttcgcgacataccaacctgaactaatagcctgcaataaaaaagtcccatatgactggacaatatattacctaagaaaaaaggcactcacaaaaaagttatctaaagaagaactatcatggattctactaaactttaaccagaagcgaggttactaccaattacgaggtgaagaagatgatgaatcagtaaagagcgcaaaaacaagacaatatttcgaccgacagaaaataaaatcaattgtagatacaaatcagacatacaaaggtcaaaaagttctcatcgtagagttagaagacggaatcaaaggtaaaatcttcaaaaaagaaattcccaactgggtgggacaggaaaaatcaatcattgtaaccattgacattgataaagacggatgcgacaaatatgaagaatctggagaactcagctgccgattcaaaatcccaagcgacgccgaatgggaatctgaatggaaactgattaagatgaaaacccaaaaagacttagacgcatccggtaaaacagtgggagcctatatatacgatgccattttacaaaacccatctcagaaaatacgaggaaaactcgtccgaacaatagaaaggaaatattataaagaggaattgaaacaaatactaaaaaaacaggtagaattccacccagaactgcgtgataaagatttattcttagactgtctaaacgaattatatccaaacaacgatgctcacagaaacgcgtgcgcagacagggattttatatacctctttatggatgatattctattctatcaaagaccacttaaatcaaagaagtctctaattgcggattgcccctacgagaaacatatgtatagagacaaagaaacaggcgagctaaaatatagctctgtaaaatgtatcgcaaaaagccatccacttttccaagaattccgactgtggcatttcatatcgaatataagaatttaccaaaaggaacgtgtagtcgatgtggacgcatgccagcctgatctttcgtccgcgagaagtgcattaaaatcaaaactagaggcagacgttgacgttactaatgaatttctcacctgtgaagcagattacgtgagtttatttgaatggttaaataataaaaaaagcgtctcacaaaaagattttcttaaataccctgcatttggcataaaaaaatcaggggataactatcgctggaactacgtggaagacaaaagctacccatgcaacgaaactagagcactaatcttaagtcacctcgaaaaagcaaacataagaggtgacatatttacaagagagcaagaagaagcattatggcatattttatactccgtagaagacagatatgagatcgttaaagcactgcaatcatttgccgctaaatatcgcttcaatgatgattttgtaaccgtattctcaaagtttccaccattcaagaaagaatacggaagttatagcgctaaagctattaaaaaactactcccactcatgagaatgggcaaatattggagcgaggcagcaatagatataaagacacgagaaagaatagaaaaaatcatcaccggagaatgcgacgattccataagagaaagagtccgattaaaagctatccgactacacgatataggcgactttagggcacttccagtatggctagcctgctatgtagtctacgatcgacatagtgagtcaggtgacataaccaaatggaaaaccccgcaagaaatggactggtatatacagaacttcaaacaacactcattacgaaatccaatagtagaacaagttattacagaaacacttcgcgttgtaagagacatctggaaacaggtaggaagaatagatgaaattcatgtggaactaggtagagaaatgaaaaacccagcagataaaagagcaaaaatgacagcccgcatgatcgaaaatgaaaacactaatttaagaattaaagcaatgctcacagaatttctcaatccagaatttaaaatagaaaacgtacggccatattcagccagccagcaagatattctacgaatatacgaaaacggtgtacttaattcagtatcagaaataccggaagaaataaccggtatactaaaaaaattcaatgagagagaacaaagaaagcgaccctcaaccagtgaagtactacgatataaattatggctagagcagaagtaccgaagcccatacacaggtaaaatgattccactcggaaagctgtttacaccagcgtacgaaatagaacacataattccacaatctagatacttcgatgacagcttcaacaataaagtcatatgtgaagcagaagtaaacaaattaaaaggaaatttgctaggatacgaattcattaagaagcatcacggtagacgggtagatctaggcttgggagaaatagtagacatattttctgtagacgaatatgaaacctttgtaaaagattattatagcgcaaaccaacaaaaaatgaaaaaactcctaatggacgaaatacccgaacaattcattgaaagacaattaaatgactcacgttacatctcgaaagttgtaaaaagtttactctcaaatatagtacgtgaacaagatgaacaggaaagcatatcaaaaaacttgatcgtatgcaccggcggagtcaccgatagattaaaaaaagactggggcataaatgacgtatggaataaactaatactccccagattccaaagattaaataacattacagaaactacggaatttacagcgaaaaatatgcaaggtcatgaaatccccgtagttcccttcgaataccaaagaggatttaataaaaaaagaattgaccacagacaccacgcaatggacgccattgtaattgcatgcgcagggcgcaacattgtaaattacttaaacaatgaatcagcacgaaaaaaagcacaaatatctagatacgatttacaaaggttactatgcgacaaagtaaaaacagatgataatgggaactataaatggatcctaaaaaaaccatggtcaacactcacgcaagatgtatatgccgcattagacaacgtaattgtatcattcaaacaaaatctaagagtgatcaataaaacgaacaaccattatgtgcattacgaagcaggaaaaaaaataatagcaaaacaagaaaaagcttcatgggcaatccgaaagcctatgcataaagacacagtattcggtgaagtgaatttacgaaaggtaaaaacagtaagccttaacgaagcaataaaaagcccacattgtatagtgcaaaaagattttaagaaaaagcttttgtcactgctaaaacagaacttcgacgcgaaagaagtaaaagcatattttgaagaacataaagacgtctggagcgacattaatttatctaaaatcgaagtatactacttcacgaaagacactaaagaacgatttttcgcgacaagaaaaccactagattcatcattcgatcgaaaaaaaatagaaagtgttacagacactggaatacaaaaaatattattaagacaccttgaacagaaaaatggagactctgacctagcatttagtccagatggaatagaagagatgaaccaaaacatagtacagctaaatgggggcagaaaacatcaacccattgtaaaagtaagagtatatgaaaaagcagataagtttgctataggacaacaaggaaataaagcatcaaaatatgtagaagcagccaagggaacaaatttgttcttcgcagtatatgaagaagaggtacgggataaaaaaacaaatgccgttatgtttaagcgaaactacgcatccataccgttaaacgtggcaattgaccgtcaaaaaaaaggtctttcaactgcgcctgaggacgaaaatgggaacgcacccatatttgtccttagcccaaatgacttagtgtacttaccaacagcagaagatattataaatgcaaggatatcctttcccatcaacaaaaataggatttacaaaatggtatcatgtacaggatatcaatgcttttttataaaacaccacgtcgcaaacgtcatagtagataaaaaggaattctctgctctcaataagatggaaaaagcagaaacaaatgaaatgatcaaagatatatgtgtacccattaagttagaccgattgggtaacatagtaaagataggcgtgtacaaatga

SEQ ID NO: 5766 - RNA, 4590 nt, synthetic construct
  misc_feature 1..4590: note = Cas9 variant
  source 1..4590: mol_type = other RNA
atgaaaaaaattctaggcttagatcttggtacaaattcgataggctgggccgtcgtgaactcattcgacgaaaatcaaaatgaagaatcactaaaacatatagaatgtttaggtagtcgtattatcccaatggatgctgcaattctaggcgatttcgacaaaggtaattcaatcagtcaaactgcaaaaagaacagaattccgtggagtcagacacctccgcgagcgacacttgttacgaagagccaggctacacaaaattctacgcctcctaggatttcttccagaccactatgtacaggacctagacggacacggcaactttttagtgaacgttgaacccaaaatcgcatggagaaaggatagcaacggtacctttgaatttatatttaacgatagctttgacgagatgttacaggacttcgctacgtatcagcccgaactaatcgcgtgtaatcgaaaagtaccatatgactggacgatatattacctaaggaagaaagcattgacaaaaaaattaagtaaagaagaattaagttggatcctactaaattttaatcaaaaacgtggatactatcaactcagaggtgaagaagacgatgaaagtgtaaaaacagctaagactagacaatacttcgatagacaaaaaatcaaaagcatagtcgatacaaatcaaacatataaaggacagaaagtcctcatagtcgaacttgaagacggagtaaaaggcaaaatatttaagaaagaaattccaaactgggtaggacaagaaaaaagtataattgtaaccgtagacatagataaagacggatgtgacaaatatgaagagtcaggagaactatcatgcagatttaaaattccaagtgacgctgagtgggaaagcgaatggaaattaataaaaatgaaaacgcaaaaagacctggatgctagtggcaaaaccgttggtgcgtacatatacgatgccattctacaaaaccccagccaaaaaattagaggtaaattggtgagaacaatagaaagaaaatactacaaagaagaattaaagcaaattcttaaaaaacaagtggagtttcacccagaactgcgagataaagatttgtttcttgattgtctcaacgaactatatcctaacaatgacgcccatcgaaacgcatgtgctgatcgagattttatatacctattcatggatgatatcctattctatcaaaggccccttaaatcgaaaaagtctttaatagcagattgtccttatgaaaagcacatgtatagagataaggaaacaggtgaacttaaatactcaagcgtcaaatgtatcgccaaatcacacccactcttccaagaatttagactctggcacttcataagtaatatcagaatttatcagaaagaacgagttattgacgtcgacgcatgtcaacctgaccttagctcagcacggtcagccctaaagtccaaattagaagcggacgtggatgtaacaaatgaatttctaacctgcgaagccgactatgtatcattgttcgaatggttaaacaacaaaaagtcagtaagccaaaaagactttttaaaatatcccgctttcggcataaaaaagagtggcgataattacagatggaattatgtagaagataaatcatacccctgcaacgaaaccagagcactaatactgtcacacctagagaaagcgaacatccgaggcgatattttcaccagagaacaagaagaagcattatggcacattctatattcagtagaagaccgatatgaaatagtcaaagcgctacaaagctttgcagcaaaatataggttcaatgatgatttcgtaacagtattttcaaaatttccacctttcaaaaaagaatacggctcatactcagcaaaagccattaaaaaattattaccactaatgcgcatggggaaatactggtctgaatccgccatcgatataaaaactagagaaaggatagaaaaaatcattacaggagaatgtgatgattcgatacgagaacgtgtccgactaaaagcaatacgcctacacgacatcgagcatttccgtgctttaccggtatggttagcatgttacgtagtctatgatcgccatagcgaaagcggcgacataatgaaatggaaaacaccgcaggagatggacagttacatacaaaactttaaacaacattcactcaggaaccctatagtcgaacaagtaatcacagaaacgctacgagtggtcagagacatctggaaacaagtaggacgaatagacgaaattcacgtagaattaggaagagaaatgaaaaatccagcagataaaagaaaggaaatgacaaaacgaattatagaaaacgaaaatactaacctcagaattaaagcaatgctaacagaattccttaatccagaattcgaaatagagaatgttcgcccctactccgcatcgcagcaagatatactaagaatatacgaaaatggggtattaaattcagtctcggaaataccagaagaaattacaggaatcctaaagaaatttaatgaaagagaacagcgaaaacggccttcaacctctgaagtactacggtataaactttggttagaacaaaaatactgtagtccctacaccggaaaaatgatacccctggggaaattatttacacctgcgtacgagattgaacacgtaatcccccaaagcagatattttgacgatagttttaacaataaagtaatatgtgaggccgaagtaaataaactaaaaggtaacttgttaggctacgagtttataaaaaaacatcacggccaacgagtagacctcggactaggagaaattgtagatattttctcagtagatgagtacgaaacattcgttaaagattattactcaggaaatcaacaaaaaatgaaaaagctcttaatggatgaaatcccagaacaattcatagaacgccaacttaacgacagtaggtatatctcaaaagtagtgaaaagtctcctttccaacatcgtcagagaacaagatgaacaagaatcgatatcaaaaaatgtaatagtttgtacaggcggcgtcacagatcgcttaaaaaaagactggggaatcaacgacgtttggaacaaactcatcctccccagattccaaagacttaataatataacagaaaccacggaatttacagccaaaaacatggaaggtcacgagattccagtagttccatttgaatatcaaagaggatttaataaaaaacgaatagatcatcgacatcacgcaatggatgcaatagttatagcatgcgcaagccgcaacatagttaactatttaaataacgaaagtgcccgaaaaaaggctaggatatccaggtatgacctccaaaaattactctgtgacaaagttaggacagacgacaatggaaactataaatggatcctgaaaaaaccctggggtacattaacacaagatgtttacgcagcattagacaatgttattgtttcatttaaacaaaacctacgagttatcaacaaaactaaaaattactatgtacactatgaggccggaaaaaaaacaatcgcaaaacaagaaaaaggatcgtcttgggcgataagaaaaccaatgcacaaagacactgtcttcggcgaagtaaaccttagaaaagtaaaaacagtatctctaaatgaagcaataaaaaaccctcagtgcattgttgaaaaagactttaaaaaaaaacttttatccctcttaaaacaaaattttgacgccaaaaaagtaaaagcatacttcgaagagcacaaagacgtatggtcagatataaatctgtcgaaaatagaggtatattattttacaaaagataccaaagaacgattcttcgcaacgcgcaaacctttagatagtagttttgacaaaaaagagattgaatcagtaactgatacaggcatacaaaaaatattattaagacacctagaacaaaaaaacggagaccccgatttagcattcagtccggacggaatagaagaaatgaatcataacatcgtccaactaaacggaggaagaaaacatcaacccatagtaaaagtaagagtatatgagaaagcggacaaattcgcaattggtcaacaaggcaataaatctagtaaatacgtagaggccgcaaaaggaacaaatttattttttgcagtttacgaagaagaagtacgggacaagaaaacaaacgccgtcatgttaaaacgacattatgcatcaattcccttaaacgtagcaattgacagacaaaaaaaaggactttcaacagcaccagaagatgagaacggaaacgtacccatcttcgtactgagtccaaacgatcttgtatatttaccaacagcggaagatattgcaaatgcaagcatatccttcccaataaataagaacaggatatataaaatggtaagttgcacaggcaatagatgttttttcatcaaacatcacgttgccaacgtgatcgtagacaaaagcgaattcagcgttttaaacaagattgaaaaagccgaaacagacgaaatgatcaaagaaatatgtgttccaataaaaatagacagattgggaaatattgtaaaaataggtgtctataagtga

SEQ ID NO: 5767 - RNA, 4608 nt, synthetic construct
  misc_feature 1..4608: note = Cas9 variant
  source 1..4608: mol_type = other RNA
atgaataccatcttgggattagacttaggaaccaactcaatcggatgggccctaatcaaagtactaaatgataaaacaagactgccactagaaatcatagatttaggagtagtcgtcattccaacggatcaaaggactctagataaattcagtaaaggagaatccatatcgaaaactgcagaaagaacaaaacaaaaaggagtacgcaaactttacgaaaggaagaaactgagaagagaaagattgcacagagtactaaatatattaggatttctaccggaacattactctaagaaaatagactttaagaaacaccttgggcaatttttcgggaactcacaacctaaaatttcttacgtcgaaaacgatcacggaaaacatgagttcatttttatggattcctacagagaaatgctaaaagagttcagcaaacataacatcaaaaatgtcccatacgattggactatctattacctcaggaagaaagcgctttcccagaaaataagcaaagaagaattagcatgggtaatactgaacttcaataagaaaagaggatactatcaattcagagatgacaacgcagacgaaaataaagaaaataaaatagaaaaatactatgctctcaaagtaacaaacgtcaagaaagaagacgcacaaaattacacaattaccctagaaaatggatggatatacaaaaataaaagcaaaattagtctacttgactgggttgggagcaccaaagagttcatatcaacagaaaaatttgacaataaaggtaatataatcaaaaagaaaaatggcgaagacgacagaacattaaaattagtagacagcgaaaaagattggatagcaataaagaaatcgaccgaagacagaatagaaaactatggtaaaaccgtaggaacctacctttacgaacatttattaaaagacccaaaccaaaaacttaacggcgaacttataaacattattgacagaaaattttataaaaacgaattaaaacaaatattagaaaaacaaaaagagttccacccagaactcttaaatgaagatctcttccaaaaatcaataatagaattataccccaaaaactcaactcgtcaaaaagaactgaaaaacaaagatctatgttacttactgatagatgacgtaatatattaccaacgagacctcaaaaagaaaaactcaacaataaataaatgttcattcgaaagcagagaatattacctcaacggagaaaaacaaatacagaaaatcaactgcatcgcaaagagcaaacctctctatcaagagttcaggacactacaattcatcaaaaacctaaaagtctatgaaataattgacggcttagaaaaagatatcacttcgaaactcttaccagacttcgaaacaaaagaacacttcttcgaatggttaaacgacaaagagaagatagatcaactgcaactactgtcctataaatgcttcgatctacatgataacgtcaaaaacgatttaatcgctaaagggataaaacgaccaacagaaaaagcgattcgaacagaactactggaaaaatacagatggaattacagcaaagacaacgataggaactttctattaaatgaaacaagatttaaaatactaaaatatttgaagaaagtcgacaagaaactaacactaacaaacgaacaaatcgaatccctgtggttgctactctatagtgctaaagacgaaagagaactcaaaaacggcttacaaaaattttccgagaaaaataaacttccaaagaaattctccgacatattcatatcatttcccccattcaagaaagaatacggagcatattccgaaaaagcactcaagaaactattaagcctagtccgattcggcaaatactggagcttcaataaaatcgacaacaatatacaaaataaaataatgaacatcctaaacggagaagtcgatgactcaataagtgaccgagtcagagagaaaacaatcttattacaagacaaaaacgattttcaagaccttccattatggttagcatcctacgtagcttataaccgattctcagaagtgagtgaaataaaatactgggatagtccagataaaatagagttcctcaaacaacacagcatcggaaatcctatagtagagaaaataatcaacgaaaccctaaaattgatcaaagatatctgggttattcacggcaaatcctgcaaaaacttcttttcagaaatacacatcgaactatcgcgagaaataaaatcgtccagcaagaaaagagcccaaataacaaataacaatacgaaaaaccaaaaattaaacaaccttattaaatcgttactaatagaaatggcaagcgacacaaaatacgagaatgtaaccccatatagtccatcacaacaagaaatactaaaaatatacgatgaaggcatatatagcaaagaagaaaattcagagaaaatcaaagaaatcaacaaaataaggaacaataacaaaatttccaaaagcgatataacaaaatataaactatggctagaacaaggttatatatcgccatataccggtaaaatcatccccctcacaaaattatttaccgccaaataccaaaaagaacatatcataccacaaacgaaattcttcgacgactcatttaacaataaagttatctgcgaagcagaagtaaataaacttaaagacaacagcctagctatgaactttataaaagcaaaaggcggaaaagcagtaaaactgtcagacggtgaaacagtaacaatcctcaaccaagaagaatacaaacagttagttagaacaagtttcaagaaaaatagcatcaagttgcgaaacctcctattagaagaaattcccgatacattcacaaaaagacagttaaacgacactaaatatataagcaagctagttctatcactactctcaaacatagtcagagaaaaaggagaattagaatcaacagcaaaaagaatagtaagcacaaatggacaaattacatccatattacggaatgactggggtctaaacaatatatggaataaactaataacacctagattcgagcgtctcaacaacatcaataaaaacaaaatctacggaaactgggaaaacaagaaagggaaaaatgtatttcaaattaattatcttaatgacaacttatcaaccctcaatacaaaaagaatagaccatcgccaccacgcactagatgctttaatagtagcctgcacaacgagaaaccacataaatttcttaaacaaccaatacgcaaaaagcaggaatcaacgacacgatctgagggcaaagctcaaacgacgagaaaccataactaccgaaggtagcaagaaacaagtattcaaagatttcataaaaccatgggagagcttcacacaagatgctttaaagaaactagaaactacaatagttaacttcaaagtaaataaacgtatcatcaacaaaactattaattggtataagaaatgggaaaaacaaaaagacggcacttataagaaaattcaaaagaaacagacgaaaggcgatgcgtgggcgatccgaaaaccgctccacatagacaccatctacggaatcgtctgcaagaaattaccacttaagtctgcactcgaaaactacaaaaatataatagacgaaaacttaaaacacaaaataaaagaattaaaagaagtaaacaaatttgacaataaccaaatcataaactttttcaaagaatgcaacttcatatttgaagacaacaacatacaaaaagtagaagtttatgactttaaagataacagagacaaaacaatattaagctcatccaggcagcttattgatgaatcattcacccccaagaaaataggaaaagtcttagatcctactattagaaatatactgctaaagcacctaaactcaactaaatacaacaacaagttcgacagtgacggcaatccaatcaaacctgaaaaattagccttttcaccggaaggcctaaaagatctcaacaaaaacatcaaacatctgaacaataacaaggaacatcagcccattaaaagggtaaaactttttgaaacactcggaaataaaataaaagtcggatacacacagcagaaaaacaagaaatttgcagaaacagctacaggcacaaacctattcctaggaatatattctgacaataacaaaagagactttaagactatcccactaatactagctatccaacgagaaaaagaaggattaaacccatgccccgacaccgacgaaaaaggaaaccaacttttattctccctaagccccaacgaattagttttcgtcccaaataacgaagaacgaaagaatcccaacttagtagactttgaaaacttatctaaagaccaaatagatcgcatctacaagttcgtttcgtgtacaggttcggaagcctacttcgtcccttcccgcactgcaaaaccaataattgaaaacgaaaacggaacaaataataaatcccagcgaatcatagaatttaacgagaaaacaagcatcaaaaacgagaaaaacgaaccagtactcataaaaacaatttgttggaaaatagaagttaacagattaggtaagataattaaagtcataaaatga

SEQ ID NO: 5768 - RNA, 4608 nt, synthetic construct
  misc_feature 1..4608: note = Cas9 variant
  source 1..4608: mol_type = other RNA
atgacgaaaatattaggactagacttgggaaccaattccataggttgggcaattcgtgataccgaaaatgaaggaatcaaccaaatactagataaaggagcccggatttttagtgaaggagtaaaatcagaaaatggcaaagaaatatcgcgagctgcggaacgaaccgcatatcgatctgctcgcaaaatcaaataccgtcgcaagctcagaaaatatgaaacgctaaaagtactaagtatcaacgggatgtgtcccctatccgtagaggaagtcgaacaatggaaaaagtcaggattcaaggaataccctctaaatcccgaattcctcgactggctcaggaccaatgaagacaaaaatataaatccatatctatttcgagacaaagcctcgaaacaaaaagttacattattcgaattagggcgagctttataccatatagcccaaagaagaggtttcctaagtaataggttagatcagagtgcggaaggcgttttcgaagaacataacccacaaattcaaaatttaatagaagatctagactcatctaacacaattcttaacgaactaaaggaatattacataaatctcggaattatagacgaaaccgaaaaatcggggtttaaaaaagacttagacgaaggagaaaaaaagctgaaatctctatacaacagcttagtagcaataacaaaaaaaaatgccaatgatatagaaacatgcaagcaggagttaatcgccagactcaataaaaaagaggatttaggcaaagtcaaaggcaaaataaaagatataagtcaagcgatgctagatagaaatttcaaaacactaggacaatactttttctcactatacaacaaagaaaggataaggaaccaatatacttcacgtgaggaacactacctagaagaattcataataatatgccaaacccaaggtatagaaggaattaatactaacgaaaaattaccagaaaaaaaattcacaggcttagcgaaggacctgtatagagcaatttttttccaaagaccgttaaaaagccaaaaaggcctaatcgggaaatgttcctttgaaaaaaacaaatcacgatgcgccgtatcgcatcctgattacgaggaattccgtatgtggtcttacctaaacaccatcaaaataggcactcagtcagaaaaaacactaagatttttaactttagaagaaaaattaaagttagtacccaaattctaccgaaaaagcgattttaacttcgaagtactagcaaaagaactagtggaaaaaggagcatcatttggatattacaaaagcagtaaaaagaatgaattcttctactggttcaattacaaaccaaccgatagcgtatcggcgtgtgtagtatccgctagtctagaaaacgcaataggtaaagattggaaaattaagacattcgaatatcaaactagaaataccgagaaaaacgaggtcacaaaatccgtagactacaaagacctctggcatctactaagcgtcgcgacatcagacacctatctatatgacttcgcaatcgagaaacttaaattagaaccgaaaaacgccaaagctttctccaaaacaaaattaaaaaaagatttcgcatcattatcattagcagcaatcgcaaaaatcctaccttacttaaaacagggactattatattctcatgccgtctttatggcaaacatagaaaacatagtagacgccgacatatggaaagatgaagaacaacaaaaatttatacaatcgaaaatagttgaattagtagacaattacatagtagaaaaatcaaaactggaactcataaatggactattaaaaatatacaatacagaagataaggaaggcagaaaagtttattactcgaaagaagctgaatcgttatttgaagcagatctacgtaaaaaattggtgcccttctataaggcaaatataatcatcgaagagcacgagcaagagatcatatttcaagaccttttcccaatactcatggaccaactcaaaaaacaagaatttataaaaattggtaggttagacaaacaaatcgaagcattcttagaaggcgaaaatgaagaaggccaaatattttgtaaccacacagataagcttaaaaagttataccacccatcagatattgaagttttcaaaaagaaaaccataaaagatgaatggggtaacgaaaaagtcgtacttggcagtccactaaccacttccataaaaaaccctatggcaatgagagctcttcaccaactaagaaaagtacttaacacactaatagcgaacgatcaaatagatgaagatactaggatacacattgaaatggctcgtgaactcaatgatgctaataaacgtaaaggaatacaagattttcagaatgaaaataaaaagttccgagaagaagcgattaaagaaatcaaaaaattatacttagaagagtgtcacaaagacgttaacccaacagaggatgatatacttcgataccaactatggcttgaacaaggtaaatgcgaaatatacgaagagggaaacaacatctccatatgcgacattataggttcaaatccaagttacgacatagaacacacaataccaagatcaataagtcaagacaacagtcaaatgaacaagactttatgtagcttaaaatttaatagaagtattaaaaaacaaaaaatgccagtagaactctccaattataatgatatacttccacgtatagctcattggaaaaaagaggccgaggaattaactcgacagatagaaacaataagtagaagtataaaatcagcagcaacaaaagtcgcaaaagacaagaacataagaaaaaggcactacctaacattaaagagagattatattcttggcaaatatgaacggttcacttgggaagaaccaaaggtcggattcaagaactcacagatacctgacacaggaataataacgaaatacgcgcaagcttacctcaaatcctatttcaaacgagtagaatctgtaaaaggtggagcagtagccgaattcagaaaattatggggaatacaggaatcatttatagatgaaaattggtggaaacattacaaggataaagatcgtgataaacatacacatcacacaatagatgcgattacaatagcatgcatgccaaaagacaaatatgatctattggctcatgcctggagattagaggacgaacaagacaaaaaagcggcaaaagtattaatcgaacaagccaaaccatggaaaacgttcaaagaggacatcgaaaaaatcgaaacagagattttagtatcccattttaccccagacaatgtgaaaaaacaatccaagtcaatcataaaaaatagaggaaaaaaagtatacgtactcaaaaatgagctgccagtgaacttcaagaataaaatagaaggaaaagactattttaaactaaaatttgacagtaaaatattgtataaaatacccaaaaaaaaggaaaaacaaacagacacgttttacgaagagctgccaaaaaattacctaaatggggtagaaggaaaagattacttcaaaataaacacgaccggaaaaacattctacaaaatacccatatttaatcaaggcgacactataagaggatccctgcaccaagaaacaacatacggagccattaaattaccagacatcgacatagaaacgaaaaaaccactgcacacagacaaagggggcttcatattgaaaaaagatattaaaggcaacgaaatagttttctttgtagtaagaaaagaaatatcaaaaatttcagaaaatgacgtacaaaatattgtcgacaatgttgtgcggaaaaaaatcgaaaacgctatagcaaacagtctcatcacatttaaaattgtaaaaaaaaagaaagttgcagttataaaagaaggggtgaccatatggatgagagaaccaaacatagaaaaaggaattgaaggaattcctataaaaaaagtacgaattataaccaacagcgtcaaaaacccaatagaaataaaagtccactcacccctatcaaaatcacgacataaacacaagcaaaaggtatacggacaaaacgacgaaaattatgccatggcactctatgaattggatggtaagagagagtttgaactaataaataactttaacctagcaaaacttttgaaacaaagccaatcatattaccccttacataaagaaaaagaaattaaaggaaaaaaaatccttgtacccatagaaaaaaggaataacaaagatgtgatattaaaacggggacaacaagttgtattctacgataaaacagttgaaaaccctaaagatatcagcgaaataattgacttccgggaaaggatatacataatcgaggggttaacaatacagagacaaaaagacaaaaaaacttcaaaagtgaacgaatatggtataatacagctaagacatttcaaagaagccagaaaaagtgaagagataagtaaagataactttaagccagacggcgaatttaaaatcaacgaaaacaaaccaacacgtaaaatgaatcacaatcaattcactgcctttgtagaaggtattgatttcaaagtactaccttcaggaaaattccaaaaaatatga

SEQ ID NO: 5769 - RNA, 4614 nt, synthetic construct
  misc_feature 1..4614: note = Cas9 variant
  source 1..4614: mol_type = other RNA
atgaaaaaaatattaggcctcgatctaggaaccaattcgataggatgggccttaacgacaaatgactttgacacaaaaaaaggaactattgaaggtctaggatcccgaataatacctatgtcgcaagatatactaggaaaatttgatagcggcgtatccttatcacaaacagcgcagagaaccgaatacagaggaaaaagaagacttgtccaaagatttttactaagaagagaaagacttcacagagtgttacacatcctcgaactgttgccaaaacaatactcagaagcaatagattttgataaaaaactcggacagttcaaaccagaaagagaacaaaaaatatccttctacaaaaacgaatccgggaaaaatcaattcatctttacaaaatcacaccaagaaatgttgacagaatttcagacctactatccaacaataaaaaacatcccatatgactggactatctactacctacggaaaaaagctctaacagaaaaaataagtaaagaagaactcgcatggatacttctgaactttaaccaaaagaggggatactatcaactgcgaggtgaagaaaaagaagaaaacaaaaacaaaaaagaggaattccacactttattggtaaccgatattattgagcgcgataaaggcaagtcaggaacatggtataatgtcattctcgaaaatggatggatatacaaaagagaaagcaaaatatccttagcagattggatcgggaagacaaaaagttttattgtaaccactgaatataatgacgacgggtctgtgaaattaaccaaagacaacgaagaaaaaagatctttccggtcaccaaaagaggatgactgggggctaataaaaatacgaactgaaaaaactataaaccaatctgacaaaagtgtcggagcttacatatacgatgctctcctcaaaaatcccaatcaaaaaataaaaggcgaactagtgagaaccatagaaagaaaatactacaaagacgaactacgcgaaatactaaaaaaacaactagaatttcacagcgatgtacttaatgacaaaatattatataaaaaatgcatagacgaattatataaaaacaatgacagccacaaaaattccataaaagacagagggtttgattacttattcctagatgatataatcttctaccaaagacctctaaaaagtaagactagcctaatatcagattgtagcttagaattcagaccaatcaaaaacaagaacggtgttttagttaaggacacagacggaaaacaaatagcaaaagcacttaaatgtatagcccgatcaaacccaatattccaagaattcagactactgcaattcgtcaaaaacctaaaaatatataaaagaggtgtagtcgatgacgtcgaagtcactaatgactatctaaaaagtgaaaacgacgtagaaaaactttttaattggttaaacgacaaagcagaaataaatcaaaaacagtttctagttaactttaagctaaaagaggacaaacacagatggaactttgtagaagacaaaggctacccatgcaacgaaacccgaaaccaattcctgaacgcgatagcaaagatagacgttgataaatctttttttaacactaaaaatacacaagacctttggcacattctgtactctgtaacagataaaatagagattacaaaagcaattactacattcgccaaaagacacaatttgccaaatgaatttataataaatttttcaaaaataaaaccctacaaaaaagaatatggatcatttagtgaaaaagctatcaaaaaactactgcccctcatgcgatttggaagttactgggacgccaaaaatatagacatcaaaaccctagatcggatagacaaaatccaaactggagaattcgacgaaaaaatccgaaacagagtacgggaaaaagcgatagatctacacaaaattgacgatttcaaagatctaccattatggctagcaagctatatagtttacgataaacactcggaagcatcagacgtatccaaatggaaaacaccagcagacattgagaaattcctaaaacacgaatttaaacagcacagcttaaggaacccaatagtagaacaggttattacagaaacacttcgagtcgtaaaagatatatggcttcaatacggtgaaggcaaagagaattttttcaatgaaatacatatagaattaggacgagaaatgaaaaatgataaagccacaagagagaagatcagtaaaaaagtaagtgaaaacgaaaatacaaatctccgaattaaagcgatacttacagaactcaaaaacgacggggtatcagacatccgaccctattcgccatcacaacaagaaattctcaagatctatgaggaaggggtctataacaatgaaagcagaaaagaaaaactagaagaagtagataaaattcgaaaaaacgcaaaacctactacatcggaaataataaaatataaattatggctcgaacaaggatacgcctcaccctacaccggaaaactgatacctatgtctgaattatttaccactaaataccaaatcgaacatataatcccacaatcacgctttttcgatgattcactatccaacaaagtgatctgcgaatccgaagtaaatgaactaaaaagcaacatgaccgcactcgaattcatactaaccaacgaaaaccgaatagttactttaacaggaggtgaaacagtgaaaatctttacaaaagaagcctacaatcaacacatcataagttactacagtaaaaacaagaacaaacaaaaaagacttttgacagaagaaattccagaacaattcatatcaagacaacttaacgatactaaatacatatctaaaatcgtaaaaaacctcttatctaaaatagtccgtgaagaggacgaacaagaagtcacttcgaaacacgtagtatcactaaacggatccatcaccagtcggatgaaacaagactggggtctcaacgacgtatggaacacaatcgtatcacccagatttgaacgtttgaatacactaaccaactctaacgacttcggacaattcgagctaaaaaaagatgcctacgggaacgaaggaaaaagagtattccaaacaactgtaccagacgctatcgctaagggattcacgaaaaaacgaatagaccaccgacaccacgcactagacgcacttgtcatcgcttgtgtcaatagaactcacatcaattacttgaacaatctaaacgcaaaagatacagacgataaagcagtaaaacacgaattaagaaacaaactttgcttcaaaacaaagccagattcaaacgggaactacaaatgggaatttcataagccgtgggaaaaattcacaaaagaggcacaggacaaattaaacacaacaatagtaagtttcaaacaaaacacaagagtgataaacaaaactgttaataaatacgtatcttacaaagatgaaaatggaaaccttaatgtcgatgcaaacggactacctcaaaaaaaagttataacacaaaccaagggagataactgggcgattagaaaaccattacacgcggaaacagtctccggtaaggtattcttgaaacgtataaagcaatcccacataacaattgcaaacgctatagaacaagtggagttaatagtagacaaagaagtcaaaaaacaactcaaggcgaagattaaactctacccaaataatatcgcaggactaaagaaacacttaaaagcatttccagtcatgataaacgacaaagcaatagacaaaatacaaatatatgaaacgctagaagccacagcgacacgaaaaattctcgatataacgttcgacgaaaaaaaaattcagaaaatcaccgacaccggcatacaaaaaatattactgaaccacttgaaacaagagaaatatcaaaatactgtcgatgaaaacggcaagaaactagccccacatgaaatcgccttcagcgaaaacggcctagaagacctaaataaaaacataacatttctaaatgacggaaaaaaccatcaacctatcaaaaaagtacgcatatttgaagaaggtaataaatttcctctcggggaagtaggtaataaaataaataaatttgtcgaaactgctaaaggcacaaacctattcttcgccgtatatgaaaacgatgacaaaaaaaggaactacaaaacaattccattcaacgaggtaatagaaagacaaaaacaaggactgaacgcggcattggaaattgacgaaaatggaaacagactcctatttacactgagtccaaatgatctagtatacataccgctagaagacgagatcggatacctcaatggtgtctactttaaaaacctaaacaaggaacaaactgtaagaatatacaaattcgttagttgcactggaggtgaaggccatttcgtaccaaataactactctaaagaaatcatatcaaatgaaaacggctcgaacaataaaaatgaacgcatgcttaattttaacaacttcaatattatatttgatggaaaagaaaagcccgtaatgataaaaagtatatgctggaaattagaagttgatcgtctcgggaaagtgataaagattattaaatga

SEQ ID NO: 5770 - RNA, 4617 nt, synthetic construct
  misc_feature 1..4617: note = Cas9 variant
  source 1..4617: mol_type = other RNA
atgaaacacatattaggactggacctagggacaaacagcatagggtgggcgttggtaaaaagtgaacaagactgcgatgacgtagaaagaatcaacggaattgaagccgctggatccaggataataccaatggatgcagcagtactaggagacttcgcgaagggtaatactaaatcacagacagcagacagaactgcggcacgtggaatacgtagaatgggagaacgtcataaactaagaagggaaagacttaacagagtattagacgtaatgggattcttgccagaacattacagtgcagccttaactagatatggaaaatttaaagatggggaagaatgcaaaatcgcatggcgaaaggatgaaagtgggcaatggacctttgtattcgaagatagttttcgagaaatgttagcggactttgtagcacatcagcccgaatggctggcagggggtagaaaagtcccgtacgattggactatctactatcttcgaaaaaaagctcttagtaagccattgaccaaacaagaactagcgtggcttctattaaacttcaaccaaaaaagaggatactaccaattaaggggagaagacgaacatacagatgataagggcaaactagttgaatattacgcattaaaagtagtaggagttgaagacacaggtgataaaaaaggcaaggatacgtggtttaatataatgttagaaaatggaatggtttataggcgaccagcagcagaagcaccagattggataggaaaaacaaaagaattcatcgttacaaccgacttagagaaagatgggacgccaaaaaaagataaagaaggaaacataaaaagaagctttcgaatgcctaaagaagatgactggacactaataaaaaaaaaaacagaaaacgacatagaccgctctgggaaaacagtcggtgaatacatatatgatgctctcttagctgatcccacacaaaaaattcgcggcaagcttgtgagaaccgtcgaaagaaaatactacaaagaagaactgaaaaaaataataaactcacaaaaaagattcatacctgaattgaatgacaacgaattatatggcagatgcatcagcgaactatatcagagtaacgacgcgtatcgtcaaagtatctccagttgcgactttacatacctcttcgtcgataatataatattctatcagagacctctaaaatccaaaaaaagcctaattgacaattgcccctatgaggaacactcatatacagactcaaaaacaggtgaagttaaaacggcccctgtgaagtgcgttgcaaagtcaaatccattgtttcaagagtttaggctatggcaattcgtacaaaacataagaatatttgaaagacaaaaaaaaatcggagacagtgttaaaacagacgtagatgtaactggagaatttataaaaagtgcggatgatgttgtgtcactttttgatttcttaaatgacagaaaagatatcacgcagagcgtcctcctcggcacatattttaagattaaaaaacccaaaggaaaagacagtgactacccatatcgctggaattatgttgaagacaaaacatacccctgcaacgaaactagggcgctgatactaaaaggactaaaagatgcaggaatcgatgaaggattcctggataaagacaaagaatacagcttatggcacatactatattcagttgaagataaacaagaaataactaaggcaatggagaaattcgcagcaaaaaacagtcttggaggaaaatttgcagaagttttttctagtttaccaccgtttaataaaaattatgggagttattcagaaaaggccataaaaaagttactagcactaatgagaacaggaaaatactggagcgctgatgcgatagataaacatacactagaaaggatagataagattataaatggggagtatgatgaatcaattagaaccagagtacgagaaaaagcaataaatctaactgatgtatcacattttcgtggattaccgctatggttagcttgttatatagtctatgatagacactctgaatcaaaggatataacatgttggaattgtccagcggacatagaccagtatttagatcatttcaaacagcacagccttagaaaccccatagttgaacaggtagtaacagaaacgcttagaactgtcagggatatttggagacaatacggaaaaatcgacgagatacacatagagatgggaagagacatgaagaatccagcagatgttcgagcaaaaatgagcaaacgcatgatagacaacgaaaatgccaatttacgcattaaagctatgttagctgaattcgctgacccagactttggaatagcaggagtcagaccatactctccaagccaacaggagatgctaagaatatacgaagaaggtgcactagaatcagtagacgaagtacccgatgaaataaatgaaattattagtaaattcaaccaaacagacataaaaaaaagaccaactcatggagagatcataaaatataaactatggttagaacaaaaataccagtcgccgtatacgggccgaactatttccttgtcgagactgttcacagatgactatcagatcgaacacgtaataccccaaagtaggtatttcgacgattcaatgagtaataaagtaatttgcgaagcagaagtcaatcaactaaaagatagaatgttaggctatgaatttataaaagcacaccacggagaaaaagtattactaagctcaggcgaaacagttacaatactaactgctgaggaatatgagaggctagtgcagctaaactttcgcaaaaatccagtaaaaatgaagaaactactcatggacgacataccggataaattcattgaaagacaattaaacgatagcagatacatatcaaaaaaaattaaatctttactatcaaacatggtacgagatgaaggagaacaagaagatatatcaaaaaatgtcatagcttgcaatggagcgataacggacaggttaaaaagagactggggggtaaacgacgtatggaaccatattattctaccaagatttgaaagactaaatgcagtcacagggtctgacagattcaccacaacaagtactaatggacataccatcccagatatgccacttaatctccaaaagggattcaataaaaagaggatcgatcatagacatcacgcaatggatgccatagtaattgcatgcacgacccgtagtcacgtaaatctcttaaacaatgaggccgcaatgagcaaaaacaacgcagttagatatcaactatcgaggaaacttagaagatacgaagatacaatggtaactagaaatggggaaactcgaacaatatcagtagcacgagagttcttaaagccttggccaacatttaatgcagacgtagaaaaagccctgcgaggaatcgttgtatcatttaaacaaaacttaagagttatcaacaaaaccgtaaataaatatcaaaaattcgtatataatgaagaaaagcacataaaagaaaaaaaagctgtaagacaagaggaacgaaacggtcgacatcttttagcaataaggaaaccgatgcacaaagatacagtttatggcgaggtaaaccttcgccgaataaaagaagtcagtcttaaagacgcagtggcaaatccaaaggctgtagtagataaggatttaaaaaaaaaactaatggcaatgatcgagttaggttacgatcttaaacaaataacaaaatactttgaagataataaagacgcatggcaggatgtgaacttaaaaaaaataaaagtatattactttactaaagataccggtgatcgctattttgcaacaaggtttggtaacgatttagttacactgttttcgaaaattacaaaagcagatgacgcgaaaaaacaaatagaaagaatcacagacacgggaatacaaaaaatcttaaaaagacacttagaagcaaatggaggagattgtcaaaaagcatttagtgcggacggcatagatgaaatgaatcgaaatataacccaacttaacggaggacgaccgcataagccagtatataaagtaaggatatatgaaaaagcagacaaattcgcaataggtactaaagggaataaggcagcaaagttcgtagaagcagcaaaaggaactaacctgttttttgctgtatatcttaaagaatatgaggattcaacaactggagaaacaataaaaaaaagagtattcgacactattccacttaagacagtaatcgatcgtttaaaaaacggacaaacacctgctcccgaagaaaaagacggggcaaaattattgtttgtattgtcacctaatgatttagtctatttaccaaccgaagatgtcgtaaaaaacggcactataaacagacccctggacaaacgtagaatatacaaaatggtatcgtgcacaggtaccgaatgttactatattccgtttatcgtcgcatcccccatcgtagacaaagtagaattctttagtctaaacaaaattgggcgcgcaattacaggtgagatgataaaagaaatatgcatacctatcaaagtagatagacttgggaacattacagaagtaaataatgaaaaaatatga

SEQ ID NO: 5771 - RNA, 4623 nt, synthetic construct
  misc_feature 1..4623: note = Cas9 variant
  source 1..4623: mol_type = other RNA
atgaataaaatactaggactagatttaggcaccaactcaatcgggtgggccctggtaggaaccgacgaagaaggtaatccaatacgaatttacaaaagtggaagtaggataattccaatgtcacaagacgtattaggtaacttcgaccggggtaactcaatcagtcaaactgcagaacgaacctcatatagaggcgtaagacgattaagagaacgacatttactaagacgagaacgcctacacagagtattacatctgatgggctttctcccctcccactatgaagaagcaatcggttgggacaaaggcgacaataaaacatttgctaaattctatagcgatacagaaccaaagctaccatggcgaaagaatgccgaaagggagcacgagttcctcttcaacacaccatataatgaaatgctcgtagacttcaggaaaaaccaacctcaattatttaaaataaaaaaaaacggtcaagaaagtttaatcccctacgactggacaatctactacctaagaaaaaaagcactatcaaaaccaataagcaaaaaagaactcgcgtggataatactcaattttaatcaaaaaagaggctactaccaactaaggggagaagaagaggaagagaattcaaacaaattaatagaatatcacgcgctcacagtagtgaaagtaatagctgacgaaccacaaaaaggtaaatctgacatatggtacaatgcagaactggaaaatggatgggtctacagaagaagctcgaaaacacccttattcgactgggaatctaaagtcaaggaattcgtagtaaccaccgatctcaatgctgacggttcactaaaagtggacaaagaaggaggagtaaaaagaagctttagagtaccatcagaagatgattggatgctggtcaaaaaaaaaacggaatcggacatagaaaaatcagacaagacagtaggatgttacatctatgataccatattacagaatccatcacaaaagatacgaggtaaacttgtacgaacaatagaaagaaaattttacaaaaaagagcttacagaaatattaaataaacaaaaggaatttcattcagagttacaaaataaagaactatatcaagaatgcataaaagaactctatcctcataacgaggcacactatgatagccttctagtcaaggattatacggatctattcgtaaacgatatcatattctatcaacgacccctcaaatcaaaaaaatcattaatttccaactgtccatatgaataccgtgtctacagaaacgactcagggatagtagaaagggtaccaataaaatgcattgcaaaatcgcaccccttataccaagaatttagactttggcaattcattcacaacctaagaatctacgaacgtcaaagagaagtaaatgggaaaccagaaacagatgtagacataacggcggaatttatacccactacagaagacagagtaaaattattcgactggttaaataataaaaaagaaattaagcaagataccctactccaatcatactttaagataaagaaaaaaaaaggggacgacaaattcccctatcgatggaactacgttgaagacaaagaatatccatgcaacgaaacgagagcactcatactaagccgattaactaaactcaatttaagcgaagatttcttaacaaaagaaatggagctagctttatggcacatattatatagcgtagaagataaagaagaaataaaaaaagcttttaaatcgtttgcacaaaaacataatttagatgatagttttgtagatcaatttataaaatttccgccattcaagaaagactacggtagttactcagctaaagcaatcaaaaaattattaccactaatgcggataggtaaatactgggacgaaaaagcaatcagcggaaacaccagaagtagaatactatcaattaacgaacgacttgaagatatgcgatccagtgggaaaaaaatagaagacgtatcagatgatgacataccaaaacaagtactcaagtcattcgacaaagtcaacggtgtctatagtggtctgaacacttaccaagcatgttacgctgtctacgggagacattccgaggcatccgaaattacaaaatggaaaacgccacaggatatcgatgactacttaaatgaatttaagcaacacagtctaagaaatccaatcgttgagcaagtgataacagaaactctaagagttgtaagagacatatggaaaaaatatggagatttcagcgaaattcatatagaattaggtcgcgaaatgaaaaatccagcagacaaaagagctaaaatgaccacccaaatttcagaaaatgagaacaccaacttaaggatgaaaagtcttctcgcagaacttaaaaaccataatgacgtcgaaaatgtccgaccgtattccccatctcaacaagaaatcttaaaaatttacgaagaaggagtattaaacagcgtgtccgagataccagaagaaataattaagataactaaaagtagtcaaccaagccaaacagaattagtacgatataaactttggctagaacagaaataccgatcaccctacaccggagaaattatacccttaggaaagctattcacgtcagcatacgaaattgaacatgtcatcccacaatctagatattttgatgacagcttgtcaaacaaagtaatatgcgaatcggaggtcaacaaactaaagggtaacctccttggatacgaattcgttaaaaaccatcacggagtaaaagtagaactaaactttaacaaaactgtagaaatattctccattaatgaatatgaagaatttgttaagggaaactacggcaaaaatagaggcaagatgaagaaactattactagaagacatccccaaatcgtttatcgaaagacagttgaacgacacccgttacataagtaaagtagtaaaaggactactatctaatatagtaagagaagatggggaacaagaagcaacctcaaaacatgtaattccttgtacaggaggggtaactactatcctgaaacaagattggggacttaacgatgtatggaacaaaatagttacacctagatttgaaagaatgaacgaacttacaaacacttctttattcggacagtgggaaaataaggaaggcaaacgaatattccgaacagaagttccattagaacttcaaaagggattcaataaaaaaagaattgaccatcgacatcatgcaatggatgcaatagtcattgcctgtgccacaagatcacatgtaacttatttaaataatgaatcatcaaaggcaaatgccaaagaaatcagagatggcctaaaacataaactatgtttcaaatccaagacagacgagactggaaactataaatggcagtttcacaagccttgggatacctttacacaagacgtacaagacacacttgaaaacatagtaatctcattcaaacagaatttacgagtaattaacaaaacaacgaaccgttaccaaaaatacgaagaagagaaaaaaattttgaaaagtcaagaaaaaggcgattcatgggcaataagaaagcctcttcataaagacactgtatttgcaaaagtttccctccaaaaaataaaatgcgtgaaactagctatggccttaaaggactggaaaaatattgtagataaacaactgaaaaaagaaatacggaggctaatcctatcttatggtaaattcgatgcggaaattctcaacaaatatttcaaagacagaaaatacatcttcaaagatgtagatatatcaaaagtagacgtatactattttgaaacagaatatgtagctactcgaaagaatctagatacctcttttgaccgcaaaagtatagagtcaattacagacacaggaatacaaaaaattctactgaaccacctcggtgtaaaaaataataacccagaactcgcattttcggccgaaggaatagatgaaatgaatcaaagaatagtagaattaaatggcggtaaacaacatcaaccgatctacaaagtaagaatgtatgaacccttaggcaataaatttcaagtaggaagaatcggaaacaaaaaagacaaatacgttgaagctgcaccaggcacaaacctgttctacgctatataccaatcagaggacaaaaaaagaatctacgacactataccacttaacatcataatagagcgccagaaaaaagaattatttcccgtcccagagaacaaggaagacaaggacaacctttataaactactcttttggttaagtccaaacgatatggtctatctcccaactgaaaaggagtgggcgaatcctgacttatttaatttcaacaatatgacaaaaaaccaaagaaaaaaactctacaaatttatcgatggatcaggaacaacagccaatttcatacccaatacagttgcaaacataatattttctataccgaaaaaagactcaggaaaatactcaatgggaaatcgaattgtccaaaatgaattcgggattgggtccccacaatctaaaaatcaaaaagcatttaccggagaaatgataaaagaacggtgctggaaactaaaaattaaccgacttggtgatattatagaatgcatcaaatga

SEQ ID NO: 5772 - RNA, 4629 nt, synthetic construct
  misc_feature 1..4629: note = Cas9 variant
  source 1..4629: mol_type = other RNA
atggaaaaaagaatattaggactagatttaggtactaacagcataggatgggcactcgttaagggagaacggcatgaaaatgataatgaaacaatactaagttacatagaagcagcgggatcccgaatactcccactagatgcggcggcccaaggagatttcgagaaaggaaatccagccaaaacacagacaagtgaaagaacaagaatgagaggaatgaggcatttactagaacgaagtttattaagaagggaaagactacaccgcgtcttggatattatggattttctgccccctcattacagccaatcattaactcgctatggaaaattcaaggcagacacagagtgtaaactagcatggcgaaaaacagaaacaggacattatgaatttctatttcaagatagttttcaagaaatgttacaagactttcaaaaccatggaaagcttgaggaaaataagaaaataccatacgattggacaatttactacttaagaaagaaagcactaacgcaacccgtaagcaaacaagaattagcatggatactcctaaattttaatcaaaaaagagggtattatcaaagagaggaccaagcagtagatgataatcaaaagaaaagagtagagtaccaagctctaaaagtcataagtgtggaggatacgggagaaaaaaaagggaaaaatacatggtacgacgtaagattagaaaatggattagtgtatcattatagcgcaccaataaaaccagactggaaaggcgaaactaaggaattcatagtcactacaacaatagatcaaaatggaaaacctgagctagacaaagacggtaaacccaagtacagtatgagggcaccaaaagaggatgattataaactacttatggagaaaacaaaaaaagacataacagatagcggaaaatcagtaggagaatacatatacgacgcactgctagtcaatccacagcaaaagataagaggaggattggttagaacaatagaaaggtacttttataaaaaggaactagaaaagatcctcctgtcacaggagcgattcataccagagctgactgaccgagaattataccgcagatgtgtagaagaactttaccccagtaatgatgcatacagacatttaatcgaatcgagagacatgagatacttactagtcgaagacatattgttttatcaaagacctctaaaatcaaaaaaaagcctaattgatgactgtccctacgaatcaagatcatatgtggatcgcgaaacaggagaaatcaagtcaagccccgtaaagtgtatagcacagtcacaccctttgttccaagaatttaggttatggcaatttattcataacttaagaatctatcaaaatgagaggtcagtagaagggaaattgcaactagacgtagatgtaacagaagaagtgctaccaactcctgagtccaaagcagcactattcagatttctaaatgatagagaaaatgtaactcaggagatacttttgaaagaagttttcaaaggacgaaaattatccgtaaaagattgcccataccgatggaattacgcaggcgaaggaaaaaagtatccctgtaatgagactagacatctaatgttgaagctgctcaaaaaagcagggatagacactgcctttttaacaccagaaaaggagcaagccctttggcacattatgtattctgtggaagacaaagatcaatatgaaaaagcgctttctacatttgcgagaaaaaatgacttaccagatggatttaaagaacagttcaagaaagcaccaacatttaagaaagactatggtgcgtattcattaagggcgatcaaaaaattacttccactaatgcgagtaggagaatactggagtgcagattgcattgatagcgaaacaaaagaaagaataagtcaaataatccgaggagaaatggacgaaaaagtgtcacaaagaatgacaaagtcgagagatagctttacagatataagtcaatttcaagggctcccagtatggcaggcatgctacgtagtatacggccgacacagcgaagcaacagaaatccagaggtgggagaaacctgaagatatagatgtttacctcaaagcattcaagcaacactctcttagaaatccaatagtagaacaagttgtactagagacactaagggtggtaagggatatatggaaaacatatggaaaagtagatgaaatacacatagaaatgggaagggacatgaaaaatacagcagaagaacgaaaaagaattttcaacagaaatcagcaaaatgaaaatgacaatctaagaattaaagctcttttaaccgaatttatgaatcctgattttgaaatagaaggagtacggccatattcaccaagccagcaagaagcactaagaatatatgaggacggagcttggagtggacttgatgaagaaaaggaggataaaaaagaacttgaggcaataagagaaatattaggtaaattcagtcaatcggataaagcaaaacgaccaacccattcagaagtcttaagatataaggcttggttagaacaaagatattcaagtccctatactggagaagccattccacttgcgaaattattcacacctgcctacgaaattgagcacgtaatcccacaatcaagatttttcgacgactctttttcaaataaagttgtctgtgaagccgaagttaataaattaaaagatcgaatgctgggctacgagtttataaaagctcaccaaggggaagtcgtgagtttaagcggaacaggaaggtgtgctagaattctaagtccagaagaatacgaacaacgcgtaactgattgttataaacataacaccgcaaaaatgaaaaaattattaatggaagaaattccagatgattttatccaacggcaaatgaatgactcgcggtatatctcaaaattagtaaaaagtctactatcaaatatggttagagaagaaggcgaacgagaagccatatctaagcatgtaataacatgcaacggaactataaccgatagattaaaaaaagattggggggtcaacgatgtatggaaccatataattctgccgcgattccaaagaatgaaagatttaactggtagaaacgactttgtcgctgttaactctcaaggccatgaaattccttccgtgccaccagagttacaaaaaggattcaagaagaaaagaatcgaccacaggcatcacgcgatggacgctatagttatagcatgcaccacacgcaatcatgttaatttactaaacaatgaagctgctatgagtgagaacaaggctaatagaatagccttaagccggaaactaaggcgatacgaaaactgtgcaatttacaagggtggcgaaactaaaaacattagtgtagcaaaagaatttcttaaaccatgggccacttttccggctgacgtcgagcgagctttaggagatatagttgtaagttttaaacaaaatttaagagttataaacaaagccacaaaccattacgagcattataaagatggaaaaaaagtgaaagtgccacaaaaaaaaggagatatgtgggtagttcgaaagccattacacaaagatactgtatatgccttagtaaatcttcgaaacgtaaaaacagtaggccttaaagatgcaattttgatgcctgacaggattgcgaataaggaccttaaaaaaaaggtcaaagaattactcgctcaaggtgacgatctcaaaaaaataaaaaaatatttcgaaaccgaaaaagacacatggcaagatgtagatgttaaaaaaatagaagtgtattattttagcgaagaaacagcaaaccattactatgcaacaaggaaaccctttgatgccaacgttaaaatagactctgtaaccgatacgggaattcaaaaaattctaagacgccatttagaagaaaacggaaataaagctgatgtcgcattcagtcctgaaggcatagctagaatgaatgaaaacatattcaggttaaacggaaacaaacatcaccaaccaatatataaagtaagagtctacgaaaaagccaataaatatcccgtaggacagacaggtaataaggccagtaaattcgtagaagcagcgaaaggaacaaacctttacctcgcagtatacgagtcagaagtagtggataaaaaaacagcagaaatttctaaaaaaagaagttatgtgattgtaccactaagagatgcagtagccagacaaaaacaaggcgtccctgtggcacccgaaagaaatgaagaaggagggaaacttttatttgttttaagcccaaaagattttgtatacgtacctactgaagaggaacgctcaaaaggcgaagtacttctgcccttagacaaaaacagaatatatataatgatggatgcatcagatggtatagtcaattttcttccctacagtgtagcaaatctaatttacgctctaccaaaagatcaagcaagcggtttttgtacagacggcaggatgatacaaaatgaatttgggttagggtcaccaaagagcaaaaatgaaagagcactaactggagaaatgataaaagaaatctgtctcccagtgaaagtcgacagattaggaagaataactgaaataaacgggaacaaggtctga

SEQ ID NO: 5773 - RNA, 4644 nt, synthetic construct
  misc_feature 1..4644: note = Cas9 variant
  source 1..4644: mol_type = other RNA
atgaagaaaattctcggtctagacctgggaaccaactcgataggatgggcactcacaaacaacgatttcgataacaaattaggaagtatagaaggattagggtcaagaataatcccaatgagccaagacgtattaggaaaattcgatagcggcgtgagcatatctcaaacggcagaaagaactaaatacagaggcacaagaagattagtacaaagatttctcttacgcagagaacgcctccatagaatactaaacattctggactttttgcctcgccactacagcgaagccatagattttgataagaaattcggtcaatttaaaccagaacgcgaagaaaaactatctttctacaaaaacgaatcaggcaaaaatcaatttctatttttagaaagccatcaagaaatgttctcagaatttaaactcacacacccagatctaaaacaagtaccatacgactggacaatatattacctacggaagaaagctctaacacagaaaataagcaaagaagaactcgcttggattattctaaatttcaaccaaaaacgtggatattatcaacttagaggagaagaagaagaagttaacaaaaacaaattagaagaatttcataccttagtgatagtcgacgtaatagaacgtgaaaaaggaaaaagtggcgtttggtacaacgtaatactggaaaatggttggatatacaaacgtgaatctaaaatagctctctttgactggatcggaaaacagaaaaatttcatagtcaccacagaattgaatgatgatgggacgattaaactaaacaaagacaatgaagaaaaacgatcattcagaagccccaaagaagatgactggggtctaagaaaaatacgaacagaacaaacaataaaccagagcgagaaaagcgttggttcgttcatatacgacgaactactaaagaaaccaaatcagaaaataaaaggagaattagtacggacgatagaacgaaaattctataaagatgaactcagcaaaatacttaaagcacaaataaccttccactatgaaatcttaggagaccgaaacatttacaagaaatgcatagacgaactatacagacacaatgactcccataaaaataacataaaagataaaggcttcgactatctattcctagatgacattatcttctatcaacgccctctaaaatcaaaaacatcattgatctcggattgcagcctagagttcgtccccattaaagataagaaaggcatacttgtcaaagattcaaatggaaaacaagtagtaaaaccactcaaatgtatagctaaatctaacccaatttttcaagagttcagattacttcaatttgttaaaaatctaaaaatatacaagaaagaaataataaacgaaatagatgtaacaaatgattacttaaaaacagaagaagacctcgttgaactttttgattggctaaacgataaagcagaaatatctcaaaaacaattcttagcttatccaaaattcaaattaaaagaagataaatatagatggaacttcgtagaagataaaatctacccgtgtaacgaaacacgtaaccaatttcttaatgcaatagcgaaaatcgacgttaacaaatccttcttcgacgccaaaaatacgcaagacctgtggcatatattatactccgtaaccgacaaaacagaattattcagcatcaacactgaaactggcattcaaagtggcgcgctctcaacctttgcaaaaagacataacttatcaaacgagttcgtctccaatttctctaaaattaaaccatataataaagattatggatcttatagtgaaaaagcgataaagaaactattgcccctaatgagatttggtagtaactggaacaaaaataacatagatgcaaaaacactagcacgaatagacaaacttcaaacaggagagttcgatgaaacaatgagaacgcgagtgagagaaaaagcaattcacctaagcaaaattactgacttccaaggcttacctctctggttagcatcatatataatatatgataggcatagcgaggcttctaacataagcaaatggaaaacacctgaagacatagcgtggtttttaaatcccaaaaataaatcaggcttcaaacaacactcactccgaaaccccatcgtagaacaagtaataacagaaaccttgcgggtagtgaaagacatttggcaacattatggcgaaggaaaagaaaacttctttaacgaaatacatatagagctaggcagagagatgaaaaacaatgccaatgacaggaaaaggataactgaaaccataaaccaaaacgaaaacacaaacctaagaataaaagctatattaaccgaattaaagaacgacgggataaatgacgtaagaccatactctccttcacaacaagaaatcttaaaaatatacgaagaaggtgtctacaattcagaaatacgaaaagaaaaattggaagacatagataaaataaggaaaaatgcaaaaccaaccccgtcagagataataaaatataaactatggcttgaacaaggttacatatccccatataccggaaaacttataccactatcagaccttttcacaactaaataccaaattgaacatatcatacctcaaagtagactattcgatgactcacttagtaacaaggtcatatgcgaatcagaggttaatgacctaaaaggaaacaacaccgcacttgagttcatactcaaaaacgaaggaagaatagttctcctaacaggaggaaaaacagtaaaaatattcacaaaggaagcatataaccaacatataacaagttattacatcaaaaataaaagtaagcaaaaacgtctcttaacagaagaaataccagaaaagttcattgacagacaattaaatgatacgaaatacatttctaaaatcgtcaaaaacttactatcaaaaattgtacgcgaagaagatgaacaagaagtaacaagcaaacacattgtatcactcaacggttcgataacttcacgcatgaaacaagactggggactaaatgacgtatggaacaaaatagtaagcccaagatttgaaagattaaacgcgatcaccaattctaacgactttggaaaactcgaactaaagaaagacgagttcggaaatgcaggcaaacaagtatttcaaacaacagtcccagatgacatagcaaaagggttctccaagaaaagaattgatcaccggcatcacgctctagacgcattagtaatagcatgtataaacagaacccacataaattatcttaacaacctaaacgcgaaagacgaaaatgataaaacaatcaaacacgaattaagaaataaactgtgcttcaaaacgaagccagattccaacggcaacagtaaatgggaatttcataaaccatgggagaacttcacaaagaaagtagaagacgaactaaaccaaacaattataagttttaaacaaaacacgcgagtaataaacaaaacagtaaataaataccaagtctggaaagaagaggatggtgccatgaagaaagttaccgtaaagcaaactaaaggcgataattgggcaataaggaaaccaatacacgcagaaacagtatccggaaaggttttcttaaaacgaataaaacaatcacacataactatcgccaacgcaatagagcaaatcgaattaatagttgataaagaggtacgaaaacaactaaaagcaaaaataaaacagtatccgaataacaaagaaggattcaagaaacacttaaaggcttttccaatcatgataaatggaaaagccatagacaaagttcaaatatacgaaactattgaggccacagcgacaagagaaagaaacaatcttgatataacatttgatgagaagaaaatagagaaaattactgatacgggaatacagaaaatactcctcaatcatctaaaacaagaaatatatcaaaatgcaatagacgagagtggaaagaaaattgctccacacgaggtagcattctcagaaataggtatagatgagctaaataaaaatatcaaagttctgaataatggcaaaaatcaccaacccatcaaaaaggttagaatattcgaagaaagcaaacgattcagcttgggacagagtggttcaaaaacggacaagtacgtggaaaccgcaaaaggaacaaacctattctacgctatctatgaaggcaagaaaggcaatagaaattacaaaacaataccacttaacgaagtaatagaaagacaaaaacaaggactaaatagcgcattagttaccgacgaaaacgaaaatagattattattcactttgagtccaaacgatctcgtctatattccaacaaacgaggagaagaaaaacctaacaactataaattttgataaactatcaagagagcagactgaaagaatctataaatttgtcagttgcacgtcaggagaaggtcactttgtctcgaacaactactcaaaagaaataattagtaacgaaaatggaagcaataataagaacgaaaggatgcttgagttcaacaacagcaatacaatttatgatgaaaaagaaaaaccagtaatgataaaatcggtatgttggaaactagaagttgaccgtctcggtaaaatcaaaagaatcataaggtga

SEQ ID NO: 5774 - RNA, 4677 nt, synthetic construct
  misc_feature 1..4677: note = Cas9 variant
  source 1..4677: mol_type = other RNA
atgaagaaaatactaggtttggatcttggtacaaacagtataggatgggcgttagtcaacgtagataaaaacggaaatccatttggcattgaaggcctaggatcacgaataatcccaatggatcaagcgacattatccgacttcgagaaaggaaattcaaaaagtcaaacagcagaaaggaccatgtttcgaggagcaagacgcttaagggaacgaaaacacctaagaagagaaagactacaccgtatcctaaacgaactaaacttcctaccaattcactacagatcatgtattgattttgtccataggttagggaaatttaaagcaaaccatgaaccaaaaatagcatggagatccaatgatcaggataaaatggagttcatatttcagaatagctttctggagatgatgtcagacttcacaaaaaggcagccggaattagtcaaagaaggaaagaaaataccttatgattggactatttacttcttaagaaagaaagcactaggacaaagaatcgaaaaagaggaactagcgtggttattattacacttcaaccagaaaagaggctactaccaattaagaggagaagatgagatagacgcaactagatcggctaaaacacgaaaatacttcgaccgcaaaatcataaaatccataatagataccggcgaagaatataaaggactcaaagtactgattgttgaactagataatggaaaccaaggaaaaatattcaaacaagaagtacccgattgggtaggtcaagagaaaaatatcatagccacagtagatctagataaagacggaaaagaccgttttgacaaaggagtattatcccaaagattcagcatccccagtgacagtgaatgggaaaccgaatggaaactaataaaactaaaaacggaagaggatttagaagccagtcagaaaaccgtgggaacatacatttacgattcactattaaagaatccaaaccagaaaataaaaggaaaattagtaaggacaatcgagcgaaaatactatagggacgaattaagagctatcctaaacaaacaaagagaatttcatcctgaattaaatgacaagaaattataccaacactgcatattctcactttatccacaaaatgaggcattcagaaatagcatcgctaacaaagacttcacatacttatttctagaagatattatcttctatcaaagacctctaaaatcgaagaaatccacaatcaataactgtgcatatgaagtaaggcggtatatggataaagaaacaaaagaactaaaagaagtgccactaaaatgcatagctaaaagtcacccaatattccaagaatttagattatggcaattcatatctaatctacgaatatataagaaagacataacagatattgatgtgacaaatgattttctacactcgcaagatgactacgctaacttattcgaatggttgaataacaaaaacgaaatagaccaaaaagccttcttaaaataccccgcattcggattcaagaaagacgcagtcaactatcgttggaactatgtagaagacaaaagctacccatgtaacaaaacaagatccgcaatcttatcaaaactggataaacacgaacaagaatttttaaccaaagagctagaactcaaaatatggcaactactctacagtgtaaacagtaaagaagagatagataaagcattgaacgtcaattcaccaaaaattaataacaaaataagcatcgatcatacagggattctccacgaactaaaaagcagctcattgagcgatatttcaattcaaagacttaaagctataaattttgaggaaaaagactacgggtcatatagctacaaagcaatcaaaaagttactggcattaatgaggcaagggaaatatttcgataatacagcaatcacagatgcaaccaaggcaagaatcaatagcatatttgatcgcctggaatctataagtttcgatccagaacgtatcaattcaatatctgatgacgacataccaaaacaaatactaaaatcattcataaaactcaatcgaacgtatggaggtttcaacacatatcaagcatgctacgcagtctacggaaggcatagtgaagcgaaagaaatagcgaaatgggaaaaacccgaagatatagaccaatatcttgccaaatttaaacaacatagtttacggaaccctatagtagaacaaataataacagaaaccttaagagtcgtgagagacatctggaaaaagcatgcctacaaaacaatcaacaaagacaatcaaggcaacaattgcgaaagcgaaagcgaattaactgaaatacacatagagttaggccgagacatgaaaaacaataaaagcgagaggctacgaatctcaagaattaactcagaaaatgagaacactaatttaagaatcagaaaattactaatcgagttcaatgaccccgagttcggcgtagaaaacgttagaccacactctccctcacaacaagaaatcttgagaatctatgaagatggagtcttaaaatccggcgtagaaatccctgaatacgtcgataacattataaagaaatttaaggaaacagatgtaaagaaacaaccgtccaaaagcgaagtgctgcgctacaaattatggctagaacaaaaatatcgatcgccatatactaatgaagtaataccattagggaaattattcacaaatgactaccaaatagaacacataataccacaatcgcgatatttcgacgactcattcagtaacaaagtgatatgcgaagctgaagttaaccaattaaaagaaaatgaattgggatgcgagttcataatgaataatggtggtagaattgttgaactgtcatttggaaaaacagttagaatccttgattttgaagcatacgaacaatttgtgcaacaaaattacgctggcaacaggcccaagctccgaaacctactcatgacagaaataccaaacgattttatagatcgacaattaaacgattctcgatatatatcaaaagtagtcaaaggattattatctaatatagtaagggaagacggggaagcagaaagcacatccaaaaatttaatatcatgtactggaggcgtaactgctagattaaaaatggactggggactcaatgacgtatggaacaaccttatatacccgcgcttcgaaagattaaacgaactgacaaactctaatcaattcggctactgggacaagaaagatggtaaaaatgtgtttcaaacgcaagtacccatggatatacagaaaggatttaacaagaaacgtatagatcaccgacaccacgcattagatgcccttgtaattgcatgcgctacccgatcacatataaattatcttaataacgaatcagcgaaatccaacagcaaagaatccagatatgatttaagacgaaaactgcgccgactagaagttatacagaaagaatatacaataaacggaagaaaagaaattagaaacatagaggtagcaaaagagttttataaaccatggaactcattcacacaagacgcgcagtcagcgttagaaaatatagtagtatcgttcaaacaaaacctaagagtaatcaataaaacaaccaactatttcctacgtttcaataaggaaggtaaaaagatattcgaaacacaaacaagtggatcaaactgggcaatacgaaagccacttcacaaagacacggcatttggactcgtaaatttaaaaaggaccaaaaccgtatccctagcaaatgctatactagactacgaccaaatagttaacagaaaactatggacaaagataaaagaactaatctcaataggatacgacaataaaagaatattaaaatactttactgatgacaaagaaaattggaacgaaataatatcatcaggaatcgaggtgttttattacaccgacaatttcgaaaaacaagttgctacgagaaaaccactagatacatcttttactgagtccaagatcattaacagcataaccgacctcggaatccacaaaatactattggcgcatctaagagccaatgaaggcaatcctaatattgcattttctccagaaggaattgaaacaatgaatcgacatatctgtgaattaaatggagggaaatttcatcacccaatatacaaagtgcgtgtccacgaacctcttggatataagtttaaagtaggtgacaaaggaaaccgtagtactaaatatgtagaggccgcaaaaggtacaaacttattcttcggcatttacataaacagtcaaggcatacggtcatatgagaccatcccactaaacgtcgcgatagaaaggcaaaagcaaggattatcgcctgtacccgataacaacgaactaggtgaacgactgctattttggctctcacctaatgacctcgtgtatttacccacatccgatgaagtggaatctggaatctgttgtaacaaactgggtatagatcgcatttacaaaatggtctcttgtacaggttacgtgggcgatttcataccagctcacatagcaaacccaataatacaaacacttgaactaggttctaacaataaagcgcaaagggcatggacaggagaaatgattaaagaaatttgtatacctgttaaagtagataggatgggtaacatagtcgaaatattcaatcgaaacaaaaactga

SEQ ID NO: 5775 - RNA, 4695 nt, synthetic construct
  misc_feature 1..4695: note = Cas9 variant
  source 1..4695: mol_type = other RNA
atggcaaaaatactaggactagacctaggaacaaactctataggatgggcaatagtagatgacaaaaattcaaaaatactagacacaggtgtacgaatatttccagaaggagttgttgcaaaaacaataggtagtggtgacaaagaagaaagcaaaaatgcaaaaagacgcgaatctagacaaacaagaaggggattctacagaaaaagacttaggaaaataaaactattacggacactaataaatttcaaaatgtgccctctagaacacttcgaattagacgtatggagtaaatgggataaaattaaaaagaaagaaggaaggatggcaccggaactatttttaccggaaaatagcgcttacaacctatggctgaaacaaaacccatacatattgagagataaggctttatccaaagacctgacgctaacagagttcggtagggtactttaccatctcatacaacgacgtggatttctctcgaatcgcaaaggcaaagatgacggtaaaatatacggaggcaaagaagggatagtaggaatagacaaaactaatgaacaaatcaaaaattcaacacttggaaaattcttatttaaaatactaccaaaagaaggtgaacccttcaaaataatagaagacgaactaggaaacgaattacgagttaggtcaaggtatactctaagagacatgtatatagcagaatttgaggcaatctggaatagacaagccaaacacctagggttagacaacatatactactccaatgtcaaaaacgtactactaaaaggatcccttaaaaataagaaaaatgaaaggaaaataaatcatctaaagaaaataaaaggaaacggcaacatagaaataataacattaaataacaacttatctaaaaatgaaaaaccaaaatacctactaaaaattgcaacgaaactcccactaaaagaatttttagcagggcgtatagaaaaagatgaagatggcaaaataaaattcaaaagcaatgaatctgtcttattctggcaaagacctctcagatcccagaagaaactacttgctaaatgcagattcgagccagacctaaaagacgacaacgggaaatttattcaaaaaggcaaaacaccatgccatttaagtcacccactatatgaagaatacagagcatatcaatatgtcaataacatcgaatacggcaagaaacaaagattagaagaaagccagagaaaacaagtaattgatttgataaattcgaaagacggaaactttaaattctcagaaataaagaagaaactaaaactaagctacgagaccttcaactattcagacgacagctccgtaaatggtaactatatgatcaaaaatctaaattcaatattccctaaagaaatcttagaaaaagagttcgttgttaatgtaaataaagaggatataatagaatacggatacgaaagaatatggcacctgtttcatttttgcgaagacaacgatgtactgataaagaaactgcaagataatttcgatctatcggaaaacgatatcgagaaaatatcgaaaataaacttaaaagaaggttactccaatgtcagtctcaaagcaatcaaaaacatacttccgtatctcaaagaaggtaaattgttgagcgacgcagtaatcttaggaggtgtaagaaatgtattcgggaagaaatggcacgagttcattgattttcatgagaaaattgaaaaagacatattgtatataaatcaccagaaaagcaataaagaaggggaagcaatagagaaaatcaagaaatatctcatagattataaattcgggttcacagaaaacgacaatagattcaagaaattataccaccactcacaagatgtagtcgaagtaaaattacagaagaaaataggtcccgtggaagatctaagaaaccccattgttcaacagggcgtaaatgaagtaagaagactggtaaatgaattacttgacgtacatggaaaatttgaccaagtgcgtgtggaattaggcagagatctcaaaaataataaaagcaaaagagaagagataggatacaaaatacgcgaaaacacagccaaaaacgaaaaagcaaaagaactgcttatcgagtacggattaagacaatctagagacaacgtacaaaaagttctattattccaagaaatgttagacagaggcacagtagccgtgtgtccatacacaaataaaactataaatataagtgacgtactagggaacgaaaacaaaatgcaaattgaacacatcatacctaaatcaatatcacttgacgacagttttgcaaacaaaaccttatgtgattcaaaatttaatggcttgaaaggtgaaaggactccatatgagttctatcaaatcaataatgacgcaaacttatggggcggttcaaaatcatgggaagaaatagaaagaagaacatttaggatattaccttatagcaaagcaaaaaggtttacatcaaaaactaaatttgaaactaacgacttcatccaacgacaactaaacgacactcgttacatatctaagaagactaaagaaatcctatcacaaatttgcgaagatgtgagagttatgccagggtcactaacagcagaattaagaaagctatggggcttaaataacattctacatccagcctttgttctagatttaccagccttacacatagatgcaaataaacatatcccacactatgtagtacttgacgaggacaacgtacctatcctctcccaaagaatatacaatgacaaacctatattgaaagcgaatcagactagcatcaccggattcgtagacaatgaaatatttaagtcaaaagagaaatacgtcaaatttgaagttaaagctcccaatttaagcaatggcgaatattgggcgaaattacttctaagcaacccaaaaagcatagttcgagtttttaaggagaaacccaaaagtacggaaaatgaaatagtagttcgcggcaagatcgaaaaagaaaagtttaagcacgaaggattatcaggaatcaacgccgagggcaaagaaaatggaacctactgggccaaacttagtatagtagacaagaaatttaagaaacctaagaaagatgatcaaccaaagaaaaacggaaaacaaatccttcttttcggcgctgtaaaagaaggagtattcagctcttatatgtacgaatgtgatgcagacttagaagatggaaaatactggttaatattagacatagattttgaaaatgtagagttcgaaaaagccttaaacgagcgaccagaagtactagaaaatcaaatactcatccaaggtataactaacgatgaaaacgtattcgttagcgatatggattgccaacaccagtttcttatgaatgagggcaaaggaaaatattacgtcctattcgatattataagcgaagtaaacgaattttacccaataaaaacgaaatcacctgaacttgagaatggacaaagtttaacagaaggtaccatttgggtcgacaaatatacgggggaaattaaattcgaccctaagaaaaaccgtgaggaccatcggcatcacgcaattgacgcattagtcatcgctctaacaaaagaaacttactttcaacaattatcgagaagaaatgcaagttctgaaaataagaaacgtggcaacgaatatgagaaagaacaacttgatttcgcggaaccatggaaagagttccatgtagatgcacaaaaatctattaacagcatcttgatatcacataaacaaaataaaaacatcctaactaaaataaccaagaaaataaccaaaaacggaaaaacctacaaatcagagggaatgagcgtacgtggtcaactccacgacaaaacatactacgggcacaacaaaaactgtaaagcggatgaatacgtctacagagtggacataaataatcttagtttttcacaactaacaaatattattgacctaaatcttaaagccgtcatagtagaaggcgtcatcaagaaattcgaggaatcagaaaagctcctttttaagaaaatgaatagtaaagtacagaacctagacaaaagcaaagtaaagaaaatcaaagcaaaagtagacaaaatcctcaaagaaaccagcttctttatgccaaatgaagggaaaaggtacattaggttaaatatcatagaaccagccaattttgaaagaatgccagtcccaattaaaaaggtaagaataagaaaagtcctacggaacgccgaaaagttgaacaatgaaattaagcaatttgtagacccccaaaacaaccaccatgtactaatatacaaagatgaaaacggaaacttaaaagaggaagtagttacattctggacagtagtagaaagaaaaagaacaggagaaccagtatacaaactaccgtcagatggcaagaaaattgtaaccacacttcaaataaacgatatgtttctcctgggattaaacgaagacgaaattaattgggaaaatcccaattataatcacttaaaggaacatttatacagagtgcaaaaatttacttcgggagatttttacttcagaattgctaagacaagctctattcaaaacggcgaagaaaaacaacaaataaactcatttggtttagggaagaatggatggttaacccacaacccaataaaagtaaaaatctctgtaagtggaaaaatactaaaagtatga

SEQ ID NO: 5776 - RNA, 4713 nt, synthetic construct
  misc_feature 1..4713: note = Cas9 variant
  source 1..4713: mol_type = other RNA
atggagaactcaaacaactcaagtaaaaaatactatcttggcttagatatgggaaccgactcctgtggctggtgtgttaccgatgataaatacaatattatacgatctcacaaaaaaatttatggaccagatgggaaactagtaaaaagagaaggatgccacttatgggggtcacgattattcagaccagcaaacacggccaaatcaagacgactgaatagaactgcacgacgaagactcgcaagaagacgcagaagaattatcttactaagggaactgttccagccagaaatagacaaagtagacccaaatttctttcgaaggctagaccaatcaaatttatggaatgaagacaaagataaagagctccaaatggaacacaacttcctattcaatgacaaggatttaacagataaagaatattacaaagactttccaacaatataccacctaaggaaagcgatggtaaacggattaacaataaacggttattattatgacccaaaaaagcaatttgatatacgtgaagtatatctagtactagctcatatgatcaaatatagaggtaactttctcatggaaggagatgtaaaagattcagtcgtagaccccacatatttaaaacaatgtttcgataacatcgacgtcatcttgatatcgctaaataatggtgaagacgatgagaacgaagacgataaaatagatccaagcgagtgctgtttcaacgtagacgaaaaaaaagctagaaaactagctaataacttccaagagactaataaggtaagtgatctggaagacgacgaaagagacttatttggaaaatttaacagcaaggatataagaaagaaaatactgaaactcataaacggtggaagcggcgttaaacttaaagacttcctacccaaagaaattctagtagcacacgatggagatgatgaatatggagataaaaaaatagacctcagctcagaaacgttagaagatgatattaatggctattcactaccagaatcttatgtcgaaatcatactagaggctaaaaaaatatatgatttcaagaccttagcatatctattacatggcaaatccttattatgtgatgcaatggtcaatgtatacgaagaacataaagaacaactagcagccctcaaaagactatacaagaagtacgcaacgaaagaacaatattactttatgtttagagacagtcgaatcctcgatggagacgactcagacgacgaagaagataaagaagaatcaaataaagaagaatcaaaagacaaaaaaaaaaaggcttcatacgtatcgtacatcggatatacaaaaaccaatagtaaagccaaatatactggtgctcatatcacaagcgagaaaaacataagtgcactaattaaacaaataaaagacgatttaaaattcgacgacttaaaatcaaaagtggatgaccctagccaacaaaacgaactatccgacgaagacaaactcgacatccaatgtatagaagaagcaatcgaatcgaacacatttctgccgcggcaaaactcgcgcaacaatggagccttcccctaccaactcaatcttaacgaaatgcgcacaataatcgaaaatcaatctaaatattacccatttcttaaagataaagcaccaagttttccagacggcaaaacagaagaatacaaaatagtgtccctcctgaaattcaagataccatattacataggtcccttatcacaacccaatgactacgtgagagacgacaagagggacaaccattgggttcagttcagaggagaaaacaaccaagggattataaatccatggaatttcagtcaaatcgttgatttagaaggcaccgcagacaaatttatctcaaatttaaccaactattgcacctacatatttggagaaaacacattaccaaaagaaagcctaattttccaagcatacaaagtactaaacgatttgaataatctcaaagtaaatggcagcctgataagcaaagaggacaaggattacatcatacaaaacgtttatttaaaaaaaaaaaaaattaaaggcaaagatatagtaaatgcattaaaaaataaatacaaattgagtgatgaagatcccacagtaaccacaaaaggcagcggaaaatcaatcggtgaagatgaagtggacctaacaatgttcaacagtagtttaagttcctttatagacatgagcgatccaaacgcattcgggccagaattttacaaagattcaaacaaatttgagttagctgagaaagtcatagaactaattactatagtagaagataaagacttgttgaaggaaagactaaaaaaattaggcctcagcgacaaccaggtcaactatctctttaaacaaaaatactcgggatgggcacctctaagtcgcaaacttctcgacggaatcacaatagattgtgtaaatgaaaacaccggcgaagcatacccagtgaccatcatcgatgtaatgcgagacactccactaaatttcatggaaatctatgaaaccaaagaaagccaattttctggattcaaggaaaaagtcgcggagttgaacgatgaaaaaaaactttcgcgagatgatctaatagaagagagctacgcaagtcccgcaatgaaacgaagcgtacgccaaacctttaaagtaatagacgaactaaaaaataccctaaacatcgaccattttgatagaatatttgtagaagccacacgagcgcctggtgaagcaggaaaaatggttaaatcacgtaaaaaacaactacaagaagcctatgacgcagccaaggatcttgtagatcaagaatcccgagacgacctacaaaaactaagagatgatcttgaaaaacaaaccgacgaccaactcagaagaaaaaaagtgtacctctattttatgcagctaggcagatcagtatacagcggagaaaagatagacttaaacgaattagataaaaactacgacatagaccatattattccgcaggccaaactaaaagacgactcgtttaataatatggtcttagtcgaacgtgaattaaacaacaagaaacaagatgaatacccgatacctagcaccattatatcagaacacggtagaaactggatacaaaagctagctaaaattcaagacaaaaacaaaaggagttattttatgcccaaagataaagcaaaccgattattgagaccagaatcgaaacaattaacaagcgacgagctgaacggattcattaatcgacaactaacactaacgaaccaatccgtaaaagcagtttgcgatatcctcaaaatgacagaaaagggaagtgaaatagtttattctaaagcaaactttgtctcagattttaggaaactttgcggcgagctaagaccaagctatgatgcattcgtaaaagtacgagacatcaatgacttccaccatgcaaatgatgcatacctaaacatcgtagttggaaacgtatactacgaaaaatttaaaaatttttacattaataaccgtatagactacgacaataatggcaaaaaagacctctcagtcctcgccagcaaactattcacaaagacacaagcagacgacaaaacaggaaacatatactgggaggctagatttcacaatgaaaaagagacagattcaaatggaaaagaaagaacaataaaagtacgagatgagggtacagaatcaacatttgataagatagagtactacatggaactcaacgatccacttgtaacacagatgcaatatacacttagtgggaaacaaggattttttaaaaaaattaccctaaaaacaaaagccaaagacaatgaagacaatagcgacaaactatttccactgaaacaatatttacgatcggatagtaataaagtaatggatgttaataaatatggaggctactctgacatgataacaccatactttatgctagtccaaagtgaagggaagaaaggaaaacatatatactccctagaatcaataccaacaatatacttaaagtcattcaaaaaaaaagaagaagatataattaactacttgtcatgcaaaaacaaattaaaaaatcccgtggtcatttctgacaaactcttaatgcgaacaatagtcaaaataccatacttcaaaaacgacagcaacttatccctagtcaaactaggtacatctggaagaactggtaataacataatttatataaacctatcagaactaatcctaccaatagagtggaaaaactactacagaaaaatctcaaacttactgggaacaaacgtatcaagtacaaaacccaaagacctaagtaaattcaccgagcaaatgaaaaacgatcccacgagcacgctagttgatgggtcaaacaaagtcgaacacgataagaataatcgattcttcagttacttaatcaacaacgttattaacaaaccaatattcgaaggactacccaaaacctcgtgcagtttcataaaattagaatcaaaatacgacgaattctgctcattaaatacactagaacaagcaaaaataatagcaacaatcattaaactactatcatgcaaaagtgtacaaggatgcaaactttctaatctgagtggactacccagctctttaggtgcactgatatccaataaagccctaacagaaggaacgatcatatcaaaggaatccagttgcggtttaaaagaaaacatcatattcgtagtaccaaacgactga

SEQ ID NO: 5777 - RNA, 5067 nt, synthetic construct
  misc_feature 1..5067: note = Cas9 variant
  source 1..5067: mol_type = other RNA
atggaatttaagaaagtattgggattagacatagggaccaattccatcggctgtgcattattatccctgccgaaaagtatacaagactacggtaaaggaggacgtttagaatggctcacaagtagagtaatacccctcgatgctgattacatgaaagccttcatagatggtaaaaatggcctacctcaagtaatcacccccgctggcaaaagaagacagaaaagaggatcacgaagactaaaacatagatataaattgagaagatcaagactaataagagtttttaaaacattaaactggctgccagaagacttcccattggacaaccctaaaagaatcaaagaaactataagtacagaaggaaaattttcattccgtatatccgactacgtcccaatcagcgacgaatcttaccgggaattttatcgtgagttcggatacccagaaaacgagattgaacaggtaatcgaggaaataaattttagaagaaaaacaaaaggcaaaaacaaaaacccaatgataaaacttctcccagaagactgggtagtgtattacttacgcaagaaagcgttgataaaacctaccaccaaagaagaactcattaggataatctatctctttaatcaaagaaggggatttaaatcttcgagaaaagatttgacagaaacagctattctagactatgatgaatttgcaaaaagactggccgaaaaagaaaaatacagtgccgaaaactatgaaacaaaatttgtttctataacgaaagtaaaagaagtagtggaactcaaaacagatggaaggaaaggtaagaaacgattcaaagttattctagaagatagcagaattgaaccatatgaaattgaacgtaaagaaaaaccagattgggaaggaaaagaatatactttcttagtcacacaaaaactagaaaaagggaaattcaaacaaaacaaacctgacttgcccaaagaagaagattgggcattatgcacaactgcactcgataataggatggggtcaaaacatcccggagaatttttcttcgatgaactactaaaagcattcaaagaaaaacgtggatacaaaataagacaatatcctgtcaatcgctggagatataagaaagaactagagttcatttggacaaaacaatgtcaactaaacccagaactaaataacttaaatataaataaagaaattttaagaaaactcgctaccgttctgtatccgagccaaagcaaattctttggacctaaaatcaaagagttcgaaaattcagatgttctacatatcatctcagaagatattatatactatcaaagagacttgaaaagtcaaaaatcactaatctctgaatgcagatacgagaaaagaaaaggcatagatggagaaatatatggactaaaatgtatacctaaatcatcacccctataccaggaatttagaatctggcaagacattcataatatcaaagtaataagaaaagaaagtgaagtaaacggcaaaaagaaaatcaacatagacgaaacacagctatacattaacgaaaatataaaagaaaaactatttgaactatttaactcaaaagatagtctaagtgaaaaagacatcctcgaactgataagtttgaacataataaactcaggcataaaaatcagtaaaaaggaagaggagaccactcataggatcaatctattcgcaaatcgaaaagaactcaaaggaaatgaaacgaaaagcaggtacagaaaagtctttaaaaagctgggctttgacggagaatatattctaaatcatccaagcaaactgaataggctatggcattcagactattcgaatgactacgctgacaaagagaaaaccgagaaaagtatactgtcctccttaggctggaaaaacagaaacggtaagtgggaaaaatcaaagaactacgatgtgtttaatttaccactcgaagttgcaaaagcaatagccaacctacccccattaaagaaagaatatggatcttattccgcgttagctataagaaaaatgctagtagtaatgagagatggaaagtattggcaacatccagatcaaatagccaaagaccaagaaaacacatcgctcatgcttttcgataaaaacctaatacaactaacaaataaccaaagaaaagttctgaacaaatatctcttgaccctagcagaagtacagaaaagaagtaccctaataaagcaaaaactcaatgaaatcgaacacaacccatacaaattagaacttgtcagcgatcaagacttagaaaaacaagtactaaaatcattcttagagaagaaaaatgaaagcgattacctaaaaggcttaaaaacataccaagcgggttatctgatttatggtaaacattcagaaaaagacgttcctatagtgaatagcccagatgaactcggagaatatataagaaagaaattaccaaacaactcactaagaaatccgattgtggaacaagtaataagagaaacaatatttatagtgcgtgatgtttggaaatcattcggtataatagatgaaatccatatagaacttggaagagaattgaaaaacaatagcgaagaaaggaagaaaacatcagaaagccaagagaaaaacttccaagaaaaagaacgcgctaggaaactactaaaagaattgctcaattcctctaactttgaacactatgatgaaaacggaaacaaaatattttcaagtttcacagtaaaccctaacccagattcacctcttgacatagaaaaatttagaatctggaaaaatcaatctggactcaccgatgaagaactaaataagaaattaaaagatgagaaaattccaacagaaattgaagtcaagaagtatatattgtggcttacacaaaaatgcagatccccatatacgggaaaaataatacccctatctaaattgttcgatagtaatgtgtacgagatagaacatattatacctagatccaaaatgaaaaacgatagcactaataacctcgtcatatgtgagcttggcgtaaacaaagccaaaggtgaccgactagcagctaatttcatatcagaaagtaacggtaaatgcaaattcggagaggtcgaatatactctgctaaaatacggagattatttacaatattgcaaagatacgtttaaataccaaaaagcaaaatataaaaatttattagcaacagaaccacctgaagacttcatagaacgacaaataaatgatacaagatatatcggcagaaaattggccgaattattaaccccagtagtaaaagacagcaaaaacattatattcaccataggctcaataacaagcgaattgaaaataacttggggtctaaatggagtatggaaagatatattacgccctcgcttcaagagactagaaagtataataaacaagaaactgatatttcaagacgaagacgaccccaacaagtatcactttgatttgtcaataaatccacagctagataaagaagggttgaaaagattagatcacagacatcacgcgttagatgctacaataatagcagccacgactagagaacacgttagatacctaaattcgttaaacgccgcagacaacgacgaagaaaaacgagaatatttcctatctctatgcaaccataagataagagactttaagttaccgtgggagaactttacctcggaagtaaaaagtaaactgttatcatgcgttgtaagttacaaagagagcaagcccatactctctgaccctttcaataaatatcttaaatgggaatacaaaaatggtaaatggcaaaaggtattcgcgatacaaatcaagaatgacagatggaaagctgtgcgacgatccatgtttaaagaaccaattggcacagtatggatcaagaaaataaaagaagtatcactaaaggaagcaataaaaattcaggcaatctgggaagaagtcaaaaatgaccccgtaaggaagaagaaagaaaaatatatttatgatgactacgctcagaaagtcattgctaagatcgtccaggaattagggctaagttcatcaatgagaaaacaagatgacgaaaaactaaataaattcataaacgaggcaaaagttagcgccggagtaaacaaaaacctaaataccacaaataaaacaatatacaacttagaaggcagattctatgagaaaataaaagtagcagaatacgtactatacaaagcaaaacgaatgccactaaacaagaaagaatatatcgagaaactgtcattacagaaaatgttcaacgacttacccaactttattttggagaaatcaatcctcgacaactaccccgaaatcttaaaagaactagaatcagacaataaatatataatagaaccacataagaaaaataatccagtaaatagattattacttgaacacatcctggaataccacaataacccgaaagaagcattctcaacagaaggattagaaaaactaaataagaaagcaatcaacaaaataggaaaaccgataaaatacataacccgactcgatggcgatataaatgaggaagaaatatttagaggcgcagtattcgagactgacaagggtagtaacgtatactttgtgatgtatgaaaataatcaaacgaaggacagagaatttctaaaacccaacccatcaattagcgtattaaaagccattgaacacaaaaacaaaatagacttcttcgcgccaaatagactaggcttcagtagaattatactgtctcccggagacttagtatatgttccaacaaatgatcaatatgtcttgataaaggacaatagttctaacgaaacaattatcaactgggatgacaacgagttcatctcaaacaggatatatcaagttaagaaattcacaggaaactcctgctacttccttaaaaacgatatagcatctttaatacttagctattcagcctcgaatggtgtcggcgagttcgggagtcaaaatattagtgagtactcagtagacgacccaccaattagaataaaagacgtgtgcataaaaatcagagttgatcgcttaggaaatgtacggccactatga

SEQ ID NO: 5778 - RNA, 3924 nt, synthetic construct
  misc_feature 1..3924: note = Cpf1 variant
  source 1..3924: mol_type = other RNA
atgacacaattcgaaggctttaccaacctttatcaggtatcaaaaactctacgtttcgaactgatcccacaaggcaaaacacttaaacatatacaagaacaaggatttatagaagaggacaaagccagaaacgaccattacaaagaacttaaaccaatcatagacagaatatataaaacctacgcagatcaatgcctacaacttgttcaacttgactgggaaaacttatcagcagcaatagactcatatagaaaagagaaaacagaagaaacaagaaacgcactaatcgaagaacaagcaacataccgaaacgccatacatgattattttataggccgcactgataaccttactgacgctataaacaaacgacatgccgaaatttacaagggtcttttcaaagccgaattatttaatggtaaagtcctaaagcagctaggaaccgtaacaaccacagaacacgaaaacgccctcctacgcagctttgacaaatttacaacttacttctcaggtttctacgaaaatcgtaaaaatgtattctcagcagaagacatcagcacagccatcccacacagaatcgtccaagataatttcccaaaattcaaggaaaattgtcatatattcacccgactaataacagctgttccatccctcagagaacattttgaaaatgtaaagaaagctataggtattttcgtttccacatcaatcgaagaagttttcagctttccgttctacaatcaattacttacacaaacccagatagacttatacaaccaattactcggcggaatcagtagagaagcaggaaccgagaaaattaaaggccttaatgaagttttaaacctagcaatacagaaaaacgatgaaaccgcacatataattgcatctctaccacatcgattcatcccactttttaaacaaatactatccgaccgtaacacattatcttttatacttgaagaatttaaatcagatgaagaagtaatacaatctttttgcaaatacaaaaccttacttcgcaacgaaaacgtactagagacagctgaagcacttttcaacgaattaaattcaatagaccttacccacatatttatatctcacaagaaattagaaacaattagctcagcactctgcgatcattgggacacgttaagaaacgctctatacgaacggagaatatcagaactaactggaaaaataacaaaatcggcaaaagaaaaagtacaaagatccctcaaacatgaggacattaacttgcaagaaataatatcagctgccggaaaagaactatctgaagcattcaaacagaaaacatctgaaatcttaagccacgcacatgcagctttagaccaacctttaccaacaacccttaagaaacaagaagaaaaagaaatattaaaatcccaactcgactctctattaggactttatcatttgctcgattggtttgcagttgacgaatctaacgaagttgaccccgagttctcagctagattaacgggaatcaaattagaaatggaacccagcctgtccttttataataaagcaagaaactatgcaacaaagaaaccgtatagcgttgaaaaatttaaactaaacttccaaatgccaactctcgcaagtggctgggacgttaataaagaaaagaataacggagcaatcctttttgtcaaaaatggattatactatctaggtataatgcccaaacaaaaaggcagatataaagccctatcgtttgaaccaacagagaaaacatcagaaggattcgacaaaatgtattacgactattttcccgacgctgcgaaaatgatacctaaatgtagcacccaacttaaagcagttacagctcatttccaaactcatactacacctatattactctcaaataatttcatagaacctttagaaatcacaaaagaaatttacgacttaaacaatcccgaaaaagaaccaaagaaatttcaaaccgcatacgccaagaaaacaggagaccaaaaaggatatagagaagcactgtgtaaatggatagattttacaagagatttcctctctaaatatacaaaaacgacatccatagacttatctagtctaagaccatcaagtcaatataaagatctaggagaatactacgccgaattaaatccattactttatcacatatccttccaacgaatagcggaaaaagaaattatggacgctgtagaaacaggaaaactctacctatttcaaatctataacaaagatttcgctaaagggcatcacggtaaaccaaatcttcatacattatattggaccggattattcagtcccgaaaacctcgcaaaaacctcaattaaacttaacggccaagccgaattattttaccgaccaaaatccagaatgaaacgcatggcacatagactaggtgagaaaatgctcaacaagaaactaaaagaccagaaaaccccaattcccgataccctatatcaagaactatatgactacgtaaaccacagactaagtcacgaccttagcgatgaagcacgagccctactgccaaatgtcattactaaagaagtctcacatgaaataattaaagatcgacggttcacctcagataaattctttttccacgtaccaataaccctaaattaccaagccgcaaactcacccagtaaatttaatcaacgagtaaacgcctacttaaaagaacaccctgaaactccaattataggaatcgatcgaggcgaaagaaatctcatctatattactgtaatcgacagcactggcaagatattagaacaacgatcactcaatacaatacaacaattcgactaccaaaagaagttagacaatagagaaaaagaaagagtcgcagcaagacaagcatggtctgtagttggcacaatcaaagacctaaaacaaggttacctttcacaagtaattcacgaaatcgtagatctcatgattcactaccaagccgttgtcgtacttgaaaacctaaattttggattcaaatcaaaaagaacaggaatagcagaaaaagcggtatatcagcaatttgagaaaatgttaatagacaagctaaattgtctagtcctaaaagattaccccgcagaaaaagtcggcggagtactaaacccttaccaactaacagatcaattcacttccttcgctaaaatgggcacccaaagcggattcttattctatgtaccggcaccatatacctcgaaaatagatccattaacaggcttcgtagatccgttcgtttggaaaacaattaaaaaccacgaatcccgaaaacatttcctagagggcttcgactttttacactatgatgtgaaaacaggagacttcatacttcacttcaaaatgaacagaaacctatcattccaaagaggattaccaggattcatgcccgcatgggatatagttttcgagaaaaacgaaactcagttcgacgcaaaaggaactccctttatcgctggcaaacgaatcgtacccgtcatagaaaatcatcgtttcacaggaagatatagagatttatatccagcaaacgaactgatcgccctactagaagagaaagggatagtttttagagacggtagcaacatactacccaaattattagaaaacgacgactcgcacgctatcgacacaatggttgcgctaataaggagcgtactacaaatgcgcaattccaacgcagcaacgggggaggactatataaatagcccagttcgtgatctcaacggggtatgcttcgactctagatttcaaaatccagaatggcctatggacgctgacgctaacggagcctaccacatcgcacttaagggacaattattactcaatcacttaaaggaatcgaaagacctaaaactacagaacggaatttcaaatcaagattggttagcatatatacaagaattaagaaactga

SEQ ID NO: 5779 - RNA, 3903 nt, synthetic construct
  misc_feature 1..3903: note = Cpf1 variant
  source 1..3903: mol_type = other RNA
atgtcaatctatcaagaattcgttaataaatactcattaagcaaaaccttaagatttgaactgatcccccaaggaaaaacactagaaaatataaaagctagaggcctcatattagatgacgaaaaaagagccaaagattacaaaaaagcaaaacaaattatagacaaataccatcaatttttcattgaagaaatcttatcatctgtctgcataagtgaagacctcctacaaaactacagcgatgtttactttaaactcaaaaaatcagacgacgacaacttacaaaaagatttcaaaagcgcaaaagataccatcaaaaaacaaatatccgaatacattaaagactcagaaaaattcaaaaatctatttaatcaaaacttaatagacgcaaaaaaaggtcaagaatctgatcttatcttatggctaaaacaaagcaaagataatggcatagaactcttcaaagctaactccgacataaccgatatagatgaagcactagaaataattaaaagttttaaaggatggaccacgtatttcaaaggattccatgagaatcgaaaaaacgtgtacagctctaatgatataccaacatcaattatatacagaatagttgacgataatctaccgaaattcttagaaaacaaagccaaatatgagtctctaaaagataaagccccagaagcaattaattatgaacaaattaagaaagatctagccgaggaactcaccttcgacattgattataaaacttcagaagtaaaccaaagagtctttagtctagacgaggtctttgaaatagcaaacttcaataactacttaaatcaatcaggaataacaaaatttaacacgatcataggaggaaaatttgtcaatggcgagaatacaaaacgaaaaggtattaatgaatacataaatctatatagccaacaaatcaatgataaaacgcttaaaaaatacaaaatgtcagtgctatttaaacaaatattatcagatactgaaagtaaatcttttgttatagacaaactagaagatgacagcgacgttgtaacaacaatgcagtcattctacgaacaaatcgcagcgtttaagacagttgaagaaaaatcaataaaagaaacactatcccttctatttgacgatctaaaagcacaaaaactagatctaagcaaaatatatttcaaaaacgataaatcacttactgatctatcacaacaagttttcgacgactattcggtcataggcacagcagtactagaatatataacccaacaaatcgccccaaaaaatcttgacaacccaagcaaaaaagagcaagaactaatagccaaaaaaacagagaaggccaaatacttaagtctcgagacaataaaattagccctagaagaattcaacaaacacagggacatcgacaaacaatgcagatttgaagagatattagcaaacttcgcggcaatccccatgattttcgacgaaatcgcacaaaataaagacaatctagcacaaatttccatcaagtaccaaaaccaaggcaaaaaagacttattacaagcttcagcagaagatgatgtgaaagcaatcaaagacctattagatcaaaccaataatctattacataaactaaagatcttccatataagtcagtcagaagataaggccaatatcctagacaaagacgaacacttttacctagtcttcgaggagtgctactttgaattagccaatatagtaccgttatataataagatacgaaactacataacccaaaaaccatattctgacgaaaagttcaaactcaactttgaaaactcaacacttgccaacggatgggacaaaaacaaagagcccgacaatacagcaatactctttattaaagatgataaatactacctaggagtcatgaacaaaaaaaataacaaaatattcgacgataaagcgataaaagaaaacaaaggagaaggatataaaaaaatagtatataaactccttccaggagcaaacaaaatgctaccaaaagtctttttctctgcaaaatcaatcaaattctacaacccatcagaagatatactacgaatccgcaatcactcaacgcacacaaaaaatggctcaccacaaaaaggctacgaaaaattcgagtttaatatagaagattgtagaaagtttattgatttctacaaacagtcaatctctaaacacccagaatggaaagacttcggcttccgtttcagtgatacacaacgctacaattctattgatgaattttaccgagaagtcgaaaaccaaggatacaaattaacttttgagaacatatccgaatcctacatcgattccgtagttaaccaaggaaaactttatttattccagatctacaacaaagacttctccgcatacagtaaaggaagaccgaatctacacacactatattggaaggcattattcgatgagcgaaacttacaagatgtagtatataaattaaatggagaagctgaactattctatcgtaaacagtccattccaaaaaaaatcacacatcctgcgaaagaagccatagcaaacaaaaacaaagataacccaaaaaaagaatccgtattcgaatacgacctaataaaagacaaacgctttacagaagataaattcttcttccattgtcctattacaataaacttcaaaagctcgggagccaataaattcaacgatgaaatcaatttactactaaaagaaaaagcaaatgacgttcacatactcagtatagatagaggagaaaggcacctagcatattacacgctcgttgatggtaaaggaaatataataaagcaagacaccttcaatatcataggaaatgacagaatgaaaactaactaccacgataaattagcagctatcgaaaaagacagggactctgcaagaaaagattggaaaaaaatcaataacattaaagaaatgaaagagggatatctatcccaagtagtacacgaaatagcgaaattagttatagaatacaatgcgatagttgtattcgaagatctcaatttcggtttcaaaagaggccgctttaaagttgaaaaacaagtatatcaaaaactagaaaaaatgttaatcgaaaaactcaattatctcgtattcaaagataatgaattcgacaaaacgggaggagtactccgagcataccaactaactgcaccctttgaaacatttaaaaaaatgggaaaacaaaccggaataatctactatgtacccgcaggattcacttccaaaatatgcccagtcacaggcttcgtaaaccaattatacccaaaatacgagtcagtgtcaaaatcccaagagtttttttcaaaatttgacaaaatttgttacaaccttgacaaaggttactttgaattctctttcgactacaaaaacttcggagataaagcagctaaaggcaaatggaccatagcgtcatttggatctcggttaataaatttcagaaattccgacaagaaccataactgggacacccgagaagtctacccaactaaagaattagaaaaacttctaaaggactacagcattgaatacggacacggcgaatgtatcaaggctgccatatgcggagaatccgataaaaaattcttcgcaaagctgacatcagtattaaacactatattgcaaatgagaaatagcaaaaccggaactgaacttgattacctaatctcacccgtagctgacgtaaacggcaactttttcgactcccgtcaagcaccaaaaaacatgccccaggacgccgacgccaatggcgcatatcatataggcctaaagggcttaatgctactcggacgaatcaaaaacaaccaagaaggcaaaaaactgaacttagtaataaaaaatgaagaatacttcgaattcgtacaaaatcgaaacaattga

SEQ ID NO: 5780 - RNA, 1341 nt, synthetic construct
  misc_feature 1..1341: note = Cpf1 variant
  source 1..1341: mol_type = other RNA
atgaaaccagacataaaagaccgagaatatatgtatagacttattataggacaattattttacgacggacaccaacaaatagcagtaaatctcgcaaacacattaggatgctccgccccaccaccaccaccatcagataaattattccgattagttacaattgcaaaacaatttgtagaagacccagactataaagcagaagaaaacacaatgccaatgcaattcgaaacatcaagcgcaggactagacttacaatatgatgcagacgtagcagcaacatcaccagaaccatcacaatacgaaacaatatacctaactgtccacaaagcaccatgtagagctgcagcatttaatagcgatggatcactaattgcaacaggatcagcagactgctctatcaagataatggacgtagaaaggatactagctagagaaaaagaacacagagaaatgaatgagaatggtccagacgcacaccacccagttataagaacattatatgaccacgtagatgtaagaagggattttggtagattttcagacaaaatattagactttcaagatgtaaatacagtaatatttcacccacgagatgcaatattaatatcaggaagcaacgataaaacagtaaaattatttgatttctcaaaaacagcagtaaaaagagcaatgaaaacactatctgaagtataccctgtaagggcattatcatgtcacccaggaggcgaatttctccttgtagcaacagatcatccaacagtaagactttacaatatagaaactgcacaagcatacgcttcagctaaccctgacgatcaacatagagaatcagtaacagatgtacactattcagaaaatgcaagactatacgtaaccgcctcaaaagatggcgatgtaaaagtctgggatggagtatcatcaagatgcgtagaaacatttaaaagagcacatgacggaagttcaatatgcagcgcaaaatttactaaaaatggaaaatatatattaacatctggaatggatagcatagtaaaactatgggaattaagtaccaacagatgcctaatagtttatactggagctggcgctacaggagcacaagactatcccacatcagcctcattcaatcaaaacgaagactttgttttattccctgacgaaaaatctggctccatgtgctcatgggaagctagaaatgcagatcgaaaacgtctattagcactaggacatacttcagcttgcagaacttttgtccatagtcctagtatgcctgccttcatgacaggatcagatgatcacagagcacgattttggtatagaaaaccaacaacaaacgacaattga

SEQ ID NO: 5781 - RNA, 1293 nt, synthetic construct
  misc_feature 1..1293: note = Cpf1 variant
  source 1..1293: mol_type = other RNA
atgaaaccagatataaaagatagagaatacatgtatagattaataataggacaactattttatgatggacatcaacaaatagcagtaacactcgccaatacactaggctgcagtgctcctgcacctccaccatcagataaattataccgtcttgttacaattgcaaaacaatttgtagaagacccagattacaaagcagaagaaaaatctttaccaatgcaattcgaaaccgtatcaacaggactcgaccttgaatacgatgcagacgtccaaccagtatcaccagaaccaagccaatatgaaacaatctatctcacagtacataaagcaccatgtagagctgcagcattcaactcagacggaagtctagtagcaacaggttcagctgattgttcaataaaaataatggacgtagaaagaatattagcacgagaaaaagaacaccgagaaatgaatgaaaatggaccagatgcacaccatccagtaataagaacattatacgaccacgtcgacgacgttaacacagtactatttcacccaagagatgcaatattaatatccggatcaaatgacaaaacagtaaaattatttgacttctcaaaaacagcagtaaaaagagcaatgaaaactctatcagaagtatacccagtaagagcattatcatgtcacccaggtggagaatttctattagtagcaacagatcacccaacagtaagattatacaatatagaaacagcacaagcatacgcatcagctaaccctgacgatcaacacagagaatctgtaacagatgttcattactcagaaaatgctaggctctacgttacagcatccaaagatggagatgttaaaatctgggatggagtctcaaatagatgtgtagaaacatttaaaagagctcacgatggatcagccatatgcagtgctaaatttactaaaaatggaaaatacctactaacatcaggcatggatagtatagtcaagctctgggaattatcaacaaacagatgccttatagtatatacaggagctggagcaacaggagcacaagactacgctacatcagcatcatttaaccataacgaagactacgtcttattcccagacgaaaaatctggatcaatgtgtagctgggacgcaagaaatagcgatagaaaacgactgttagcactaggacacacaagtgcctgcagaacatttgtccattcaccatccatgccagcattcatgacaggatcagatgaccatagagcaagattttggtatcgaaaaccagcaaccacagacaattga

SEQ ID NO: 5782 - RNA, 3690 nt, synthetic construct
  misc_feature 1..3690: note = Cpf1 variant
  source 1..3690: mol_type = other RNA
atggccgcatcaaaactagaaaaatttacgaactgctacagcctctcaaaaacgcttagattcaaagccattccagtaggaaagacccaagaaaacatagacaacaaaagactactagtagaagatgaaaaaagagctgaagactacaagggagtaaaaaaactactggataggtattacctatctttcattaacgacgttctacactcaataaaactcaaaaatctaaataattatataagcttattccgaaaaaaaacaagaacagaaaaagaaaataaagaattggaaaatttggaaataaatctgagaaaagagatagcaaaggccttcaaaggagcagcagggtacaaatccctgtttaaaaaagatattatagaaacaattttaccggaagccgcagatgataaagacgaaatagctctagtcaattcatttaacggttttacaacggcatttaccggtttctttgacaaccgcgaaaacatgttctcagaagaagcaaaatcaacgtctatagcttttagatgtataaatgaaaatttaactcgttacattagtaacatggatatattcgaaaaagtagatgcaatattcgacaaacacgaggttcaggaaattaaagaaaaaatattaaactcagactatgatgtagaagatttcttcgaaggcgagtttttcaacttcgtactcacacaagaaggaatagacgtatacaacgcaataataggtggcttcgtcacagaaagcggagaaaaaatcaaaggtctaaacgaatacatcaatctctacaatgcaaaaacaaaacaagctctacctaaatttaagccactctataagcaagtactaagcgatagagaatcactatctttctacggagaaggctacactagcgatgaagaagtactagaagtattcaggaacacacttaacaaaaattcggaaatattctcaagcatcaaaaagctcgaaaaactatttaagaactttgatgaatattcatcagcaggaatatttgttaaaaacggccccgccattagcactataagcaaagatatattcggcgaatggaaccttataagagataaatggaatgccgaatacgatgatatacacctaaaaaaaaaggcagttgtaactgaaaagtatgaagacgacagaagaaaaagttttaaaaagataggttcatttagcttagaacaattgcaagaatacgcagacgccgacctatcagtagtagagaagctaaaagagataataatccaaaaagtagacgaaatatacaaagtatatggttcttctgaaaaactattcgacgccgacttcgtcttagaaaaatccctaaagaaaaacgatgccgtcgtagcaataatgaaagatcttctcgattcggtaaaaagcttcgaaaactatataaaagcgttctttggagaaggtaaagagactaacagagatgaatccttttacggcgacttcgtcttagcatatgatatcctgttaaaagtagaccacatctacgacgcaataagaaactacgttacccagaaaccctattcaaaagataaattcaaattatatttccagaatccacaattcatgggggggtgggacaaggacaaagaaacagattaccgagcaaccatcctaaggtacggatcaaaatattacctggcaataatggacaaaaaatacgcaaaatgcttacaaaaaatagacaaagacgatgtaaacggaaactacgaaaaaataaactacaaactcttacccggccccaataaaatgctcccgaaagtattcttcagcaagaaatggatggcgtactacaaccccagcgaagacatacaaaaaatttataaaaacggaacattcaaaaaaggggacatgtttaacctaaatgactgtcataaattgatcgattttttcaaagatagcataagccgatatccaaaatggtcaaacgcgtacgatttcaacttcagtgaaactgaaaaatataaagatatagcaggattctacagagaggttgaagagcaaggttacaaagtatcgtttgaatcagcatcaaaaaaagaagtggataagttagtagaagaaggcaaactatacatgtttcaaatatacaacaaagatttctcggacaaaagtcacggaacaccaaacttacacacaatgtatttcaaacttctttttgatgaaaacaatcatggtcaaattagactttctggcggagctgaattatttatgcgccgggcttctctaaaaaaagaagaacttgtcgtgcatccagcaaacagccctattgcaaataaaaatcccgacaacccaaaaaaaactaccacactatcatacgatgtgtacaaagacaaaaggttctcggaagatcaatatgaactgcacatacccatagcaattaacaaatgtccaaaaaacattttcaaaataaataccgaagtaagagtattactaaaacacgatgacaacccatacgtaataggaatagatcgaggcgaaagaaatctactctatatagttgtagtggacggaaaaggcaacattgtcgaacaatactcactaaacgaaataataaacaattttaatggaatcagaattaagacagattaccactcactactagataaaaaagaaaaagaacgcttcgaagccagacaaaactggacctccatcgaaaatatcaaagaacttaaagcaggatacatcagccaggtggtacataaaatatgtgaacttgttgaaaaatacgacgcagtaatagccttggaagacttaaacagcggcttcaaaaattcgagagtaaaagtagaaaaacaagtataccagaaattcgaaaaaatgttaatagacaaattaaattacatggtagacaaaaaaagcaacccttgtgccactggcggggcattaaaaggataccagattacaaataaattcgaatctttcaagtccatgagtacgcaaaatggattcattttctacatacccgcgtggctgacttctaaaatagatccaagtaccggattcgtcaacctattaaaaacaaaatacacaagtatagcagattccaaaaaatttatatcatccttcgacagaataatgtacgtgccagaagaagacttattcgagttcgcacttgattacaaaaatttctctcgaacagacgccgactatataaaaaaatggaaattatattcatacggtaacagaatcaggatattcgcagccgcaaagaaaaacaacgtatttgcatgggaggaagtatgtttaacatcagcatataaagaactatttaataagtatggaatcaactaccaacaaggagacatacgagccttactctgcgaacaatcagataaagcattttatagttcattcatggcactcatgtcacttatgttacaaatgcgaaactcaataactggaagaaccgacgtagatttcctaatctcaccagtaaaaaactcagacggaatcttctacgattcaaggaattatgaagcacaagaaaatgcgatattaccaaaaaatgcagatgcaaatggagcatataatatagcacgaaaggtcctctgggcaatagggcaattcaaaaaagcggaagacgaaaaattagacaaggttaaaatagcaatatccaataaagaatggctagaatatgcacaaacttcagtcaaatga

SEQ ID NO: 5783 - RNA, 3903 nt, synthetic construct
  misc_feature 1..3903: note = Cpf1 variant
  source 1..3903: mol_type = other RNA
atgtccatataccaagaatttgtaaacaaatactcattgtcaaaaacattacgcttcgaacttatcccacaaggaaaaacccttgaaaatatcaaagcacgtggattaatactagacgacgaaaagcgtgcaaaagactataaaaaagcaaaacaaattatcgataaatatcaccaattttttatagaagaaatcctatcaagtgtatgcataagtgaggatttactacagaactattctgacgtatatttcaagcttaaaaaatctgatgatgacaaccttcaaaaagactttaaaagcgcaaaagacacaataaaaaagcaaatatcagaatatattaaagactccgagaaattcaaaaaccttttcaaccaaaacttaattgacgctaaaaaaggacaagaaagcgacttaatactctggctcaaacaatcaaaagacaacggaatagagctattcaaagccaactccgacataaccgacatcgatgaagctctggaaataatcaaaagctttaaaggctggaccacatatttcaaaggtttccacgagaataggaaaaacgtatattcctcagacgacataccaacgtcaattatctatagaatagtcgatgataatctcccaaaatttttagagaataaagcaaaatacgaatccttaaaagataaagcacccgaagccataaactatgaacaaataaaaaaagacctagcagaagaactaacattcgatatagattacaaaacctcagaagtaaatcagagagtctttagcctagatgaagtttttgaaattgcaaattttaataattacctcaaccaatccggaatcacaaaattcaatacaataatagggggaaaattcgtcaatggagaaaacaccaaaaggaaaggaatcaacgaatacataaacctatactcccaacaaataaatgataaaacactcaaaaaatataaaatgagtgttcttttcaaacaaatattatcagatacagaaagtaaatccttcgtaatagacaaacttgaagatgattcagacgtcgttacaacaatgcaaagtttctatgaacagattgctgccttcaaaacagttgaggaaaaatcaataaaagaaaccctatcacttttattcgatgacttaaaagcccaaaaactcgacttatcaaaaatatacttcaaaaatgacaaatcacttacagacctatcccaacaagtatttgatgattactccgtaataggaactgcagttttggaatacattactcaacaagtcgcaccaaaaaaccttgacaacccaagtaaaaaagaacaagacttaatagcaaaaaaaaccgaaaaagccaaatatctatccctagaaaccataaaactggcactcgaagaatttaacaagcatagggacatagacaaacaatgcagattcgaagaaatattagcaaactttgcagcaattccaatgatatttgacgaaattgctcaaaacaaagacaacctggctcaaatcagcctaaaataccaaaaccaaggtaaaaaagacttattacaagcttcagcagaagaagatgtaaaagcgatcaaagacctattagaccaaaccaataatcttttacacagactaaaaatcttccacatatcacaaagcgaagacaaagcgaacatactagataaagacgaacatttctacctagtcttcgaagaatgctatttcgagctcgctaacattgtccctctctacaacaagatacgtaactatataactcaaaaaccatatagcgatgaaaaatttaaacttaactttgaaaactctaccctagcaaacggctgggacaaaaataaagaacctgacaacactgcaatactattcataaaagacgacaaatactacctcggagtcatgaataaaaaaaacaacaaaatcttcgatgacaaagctataaaagaaaacaaaggcgaaggatataaaaaaatcgtctacaaattactaccaggcgcaaacaaaatgctcccaaaggtatttttctcagcaaagtccataaaattttataacccttctgaagatatcctacgcattaggaaccactcaacccatacaaaaaatggaaatcctcaaaagggttacgaaaaattcgaattcaacatagaagactgcagaaaattcattgacttctacaaagaatcaatctccaaacaccctgaatggaaagacttcgggtttagattttccgatactcaaaggtacaatagtatcgatgaattctatcgtgaggtggaaaaccaaggatataaactaacattcgaaaacatctctgaatcatacatcgattccgtcgtgaaccagggaaaactatacttgttccaaatctataacaaagatttttcagcatactcaaaaggtcgaccaaatttgcatacattatactggaaagcactattcgatgaacgcaaccttcaagacgtagtatataaattaaacggcgaagctgaattattttaccgcaaacagagtattccaaaaaaaataacacacccagcaaaagaagcaatagctaataaaaataaagacaatccgaaaaaagaaagcgtgtttgagtacgatctcataaaagataaaagatttacagaagataaattcttcttccattgccccatcacaatcaactttaaaagcagcggagccaacaaattcaacgacgaaataaacttactccttaaagaaaaagcaaacgatgtacacatactatcaatagaccggggagaaagacacctagcatattatacacttgtcgacggaaaaggaaacataataaaacaagacaccttcaacataataggaaatgatagaatgaaaacaaactatcatgataaactcgcagctatagaaaaagaccgagatagtgcaagaaaagattggaaaaaaattaataacataaaagaaatgaaagaaggatatctcagccaagttgtacacgaaatcgcaaaattagttattgaacataatgctatcgtagtatttgaagatttaaattttggatttaaaagaggacgcttcaaagtggaaaaacaagtctaccagaaactcgaaaaaatgcttatagagaaacttaactacttggtattcaaggataacgaattcgacaaaacaggtggagtcctaagagcatatcaactaaccgcaccattcgagacattcaaaaaaatgggcaaacagacaggcatcatatattacgtcccggccggcttcacctcgaaaatatgcccagtcactggattcgtcaatcagttgtaccccaaatacgaaagcgtctctaaatcccaagaattcttctccaaattcgacaaaatatgttacaacttagacaaagggtacttcgaattcagcttcgattacaaaaacttcggagataaggcagcaaagggcaaatggacaatagcgagcttcgggtcgaggctcataaactttaggaacagtgataaaaatcataactgggacaccagagaagtctatcctaccaaagaactcgaaaaactactaaaagactacagcatcgaatacggacacggagaatgcataaaagcagccatctgcggcgaatcagacaagaaattctttgcaaaactcacatcagtattaaacacaatcttacaaatgcgaaacagtaaaacaggaaccgagctcgactatttgatttccccagtagccgacgttaacggtaatttttttgactccagacaagccccaaaaaatatgcctcaagacgctgacgctaatggagcataccatataggactgaagggactaatgctactagatcgcatcaaaaacaatcaagagggaaaaaaactaaatctcgtaatcaaaaacgaagagtatttcgaattcgtccaaaacagaaacaactga

SEQ ID NO: 5784 - RNA, 1071 nt, synthetic construct
  misc_feature 1..1071: note = Cpf1 variant
  source 1..1071: mol_type = other RNA
atgaaaacaaactaccacgacaaactagcagcaatagaaaaagacagagaatcagctcgaaaggactggaaaaaaataaataacataaaagaaatgaaagaaggatacctaagccaagtagtacacgaaatagcaaaactagtcataggatataacgccatagtagtattcgaagacctcaatttcggattcaaaagaggacgatttaaagtagaaaaacaagtataccaaaaactagaaaaaatgttaatagaaaaactaaactacctcgtatttaaagataacgaatttgacaaagcaggaggcgtattaagagcatatcaactaacagcaccatttgaaacattcaaaaaaatgggaaaacaaacaggaattatctactacgtaccagccgacttcacatcaaaaatatgcccagtaacaggcttcgtaaaccaactatacccaaaatacgaatcagtatccaaatcacaagaattctttagcaaattcgacaaaatatgctacaacctcgataaaggatactttgaattctcattcgattataaaaactttggagataaagcagcaaaaggaaaatggacaatagcaagcttcggctcaagactaataaatttccgaaactcagacaaaaatcataactgggacacaagagaagtatatccaacaaaagaactagagaaactactaaaagactactccatagaatacggacacggagaatgcataaaagcagcaatatacgcagaaaacgataaaaaattcttcgcaaaattaacatcaatactaaactcaatactacaaatgagaaacagcaaaacagggacagaactagattacttaatatcaccagtcgcagacgtaaacggaaacttctttgactccagacacgccccaaaaaatatgccacaagacgcagacgcaaacggcgcatatcacataggactaaaaggcctaatgctactatacagaataaaaaataatcaagacggaaaaaaattaaatctagtaataaaaaacgaagaatacttcgaattcgtacaaaacagaaacaaatctagtaaaatatga

SEQ ID NO: 5785 - RNA, 3792 nt, synthetic construct
  misc_feature 1..3792: note = Cpf1 variant
  source 1..3792: mol_type = other RNA
atggaagattactccggcttcgtaaacatatactcaatccagaagactctccgattcgaactcaaaccggttggcaaaacattagaacatatagaaaagaaaggctttctcaaaaaagataaaattagagccgaagattacaaagcagtaaaaaagataattgacaaatatcacagagcttacatagaagaggtcttcgactccgtactacaccaaaaaaaaaaaaaagacaaaactagattctcaacacaattcatcaaagagatcaaagaatttagcgagctatactataaaaccgaaaaaaacataccagataaagaaagattagaagcgttatccgaaaaattaagaaaaatgcttgtaggcgcctttaaaggagaatttagtgaagaagttgcagaaaaatacaaaaatctcttctcaaaagaactaataagaaacgaaatcgagaaattctgcgaaacagatgaagaaagaaaacaagtgagtaacttcaaatcatttactacgtactttaccggatttcacagcaatagacaaaacatatattctgacgaaaaaaaatccaccgctattggttatagaataattcatcaaaatctaccaaagttcctagacaacctaaaaatcattgaaagcattcaacgaagattcaaagacttcccttggagcgatctcaaaaagaacttaaaaaaaatagataaaaacataaaattaacagagtatttctcaatagacggctttgtaaatgttctaaatcaaaaaggaatagatgcctataacactatactaggaggtaaatccgaagaaagcggagaaaagatacaaggacttaatgaatacataaatctatatagacaaaaaaataatatagacagaaaaaacctcccaaatgtaaaaatattatttaaacaaatactcggggatagagaaacaaaaagcttcataccagaagcatttcccgatgaccaatccgtactaaactcaatcactgaattcgccaaatacctaaaactagataagaaaaaaaaatcaataatcgcagaactaaaaaaatttctatcctcatttaatagatacgaactcgacggaatatatttagcaaacgataattcattagcctccatcagcacatttttatttgacgactggtcattcataaaaaaatcagtgtcattcaaatacgacgaatcagtaggagatcctaaaaaaaaaatcaaatccccccttaaatatgagaaagaaaaagaaaaatggctaaaacaaaaatactatacaatatcattcttaaacgatgcaatcgaaagctactcgaaatctcaagatgaaaaacgtgtgaaaatacgtctagaagcttactttgcagaattcaaatcaaaagacgacgccaaaaaacaatttgacctccttgaaaggatagaagaagcatacgccatcgtagaaccattgttaggtgctgaatatcctcgcgatagaaacttaaaagcagataaaaaagaagtaggcaaaataaaagacttcttagacagtataaaaagcctccaatttttcctaaaacctttactctcagcagaaatatttgatgaaaaagatctaggattctacaatcaactcgagggttactacgaagaaattgactcaatcggacatctctacaataaagttaggaattacctcaccggaaaaatttactctaaagaaaaatttaagctaaacttcgaaaattcaacattgctaaagggatgggatgaaaatagggaagtagcaaacttatgtgtcatatttagagaagatcaaaaatattatcttggagttatggacaaagaaaacaacacaatattgtcagatatcccaaaagtaaaacccaatgaactgttttacgaaaaaatggtctataaactcataccaacaccacacatgcaacttccaagaataatattcagctcggacaatctaagtatatataacccaagtaaatcaatactaaaaatacgggaggcaaaatcatttaaagaaggaaaaaacttcaagttaaaggattgtcacaaatttatagatttctataaagaatccatctcaaaaaatgaagactggtcacgattcgactttaaattttctaaaacctcaagctatgaaaacatatctgaattctacagagaagtagaaagacaaggatataaccttgacttcaaaaaagtaagcaaattttacatcgactcactagttgaagatgggaaattatatttatttcaaatatataacaaagatttctccatattctcaaaaggtaaaccaaacctacataccatatatttcagaagtctcttctccaaagaaaacttgaaagatgtttgcttaaaattaaacggagaagcagaaatgttcttccgaaaaaagtctataaattacgacgaaaaaaaaaaacgcgagggccatcaccccgagctctttgagaaactaaaatacccaattctgaaagataaaagatatagtgaagacaagtttcagttccacctgcctatcagcctgaattttaagtctaaagaaagattgaactttaacctcaaagttaatgaatttctaaaaagaaacaaagatattaacatcataggtatagatcgaggcgagagaaacctactttacttagtcatgatcaatcaaaaaggcgaaatactaaaacagacactacttgactccatgcaaagtggaaagggacgcccagagatcaactataaagaaaaactacaagaaaaagaaattgaaagagacaaagcaagaaagtcatgggggactgttgaaaacataaaggaactcaaagaaggttatctttcaatagtaattcatcagatatctaagctaatggtagaaaataacgcaatcgttgtcctagaagaccttaacataggtttcaaaagaggaaggcaaaaagtagaaagacaagtatatcaaaaatttgaaaaaatgttaatagacaagctaaactttctagtcttcaaagaaaataaacctacagaacccggaggcgtcctaaaagcataccaactaacagacgaattccaaagtttcgaaaagctcagtaaacagactgggtttttgttctatgttccatcctggaacacatctaagatcgacccaagaacgggcttcatagactttctacacccagcatacgaaaatattgaaaaagcaaaacagtggataaacaaattcgatagcatacgatttaattctaaaatggattggttcgaattcacagccgacacacgaaagttcagcgagaacttaatgttaggaaagaatcgtgtatgggtaatatgcaccacgaatgtagaaagatacttcactagcaaaactgctaactccagtatccaatataactcaatacaaataaccgaaaagttgaaagaactattcgtagacatccctttcagcaatggtcaggacctaaaaccagaaattttaaggaaaaatgacgcagtattcttcaaatccctactattctacataaaaacaactctcagtctacgacaaaataatggtaaaaaaggtgaagaagaaaaagatttcatattaagtccagtcgtggacagcaaaggccgcttctttaactccctcgaagcctcagatgatgaaccgaaagatgcagacgctaacggcgcgtatcatattgcactcaaagggctaatgaacctacttgttttaaatgaaacaaaagaagaaaacctaagcagaccaaaatggaaaataaaaaataaagactggctagaatttgtctgggaaagaaacaggtga

SEQ ID NO: 5786 - RNA, 2820 nt, synthetic construct
  misc_feature 1..2820: note = Cpf1 variant
  source 1..2820: mol_type = other RNA
atgaacctatactcaaatctaacaaacaaatactcgctaagtaaaacacttcgctttgaattaattccacaaggagaaacattagaaaatatcaaagcacgtggtctaatactcgatgatgaaaaacgagcaaaggattataaaaaagcaaaacagataatagacaaataccaccaattttttatagaagagatactctcatcagtatgcatctcagaagacctactacagaactacagcgatgtatattttaaactaaaaaaatcagacgatgacaacctacaaaaagattttaaaagtgcaaaagatacaatcaaaaaacacataagcagatatattaacgactccgaaaaattcaaaaatctcttcaaccaaaacctaatagatgccaaaaaaggtcaagaatcggacttaatactatggctcaaacaatctaaagacaacggaatagaactatttaaagcaaattctgacatcacagatattgatgaggcactagaaataataaaaagcttcaaaggctggacaacatacttcaaaggcttccacgaaaatcgaaaaaacgtctatagttcagatgacataccaacatcaataatatatcgcatagttgacgacaatttaccaaaattcattgaaaacaaagcaaaatacgaaaacctcaaagataaagcacctgaggcaatcaattacgaacaaataaaaaaagatctagccgaagaattaacatttgacatcgactataaaacctcagaagtaaaccaacgtgtattctcactcgacgaagtcttcgaaatcgctaacttcaacaactacttaaaccaatcaggaataacaaaattcaacactataatcggaggaaaatttgtaaatggagaaaacacaaaaagaaaaggaataaacgaatatataaacctctattcacaacaaataaacgataagacgttaaaaaagtacaaaatgtctgtcctatttaaacaaatactatcagacacagaatctaaatcatttgtaattgataaactagaagatgacagcgacgtagtcacaacaatgcaatcattttacgaacaaatagcagccttcaaaaccttagaagaaaaaagcataaaagaaactctctcgctcctatttgacgaccttaaagcgcaaaaactagacctatccaaaatttatttcaaaaatgataagagtctaacagatttatcccaacaagtattcgacgattactccgtaataggaacagctgtactagaatacataacacaacaagtagcaccaaaaaacctggataacccctccaaaaaagaacaagacctcatagctaagaaaacagaaaaagccaaatacttatcacttgaaacaataaaactagcattagaagaattcaacaaataccgagacatcgacaaacaatgtagattcgaagaaatctttgcatcatttgccgacatacctgtcctatttgacgaaatagcccaaaacaaaaataacttagcacaaatctcgatcaaatatcaaaatcaaggaaaaaaagatctcctacaaacatctgcagaggtagatgtaaaagccattaaagacctacttgaccaaaccaacaacttgctccataaactaaaaatcttccatatcacccaaagcgaagacaaggccaatattctagacaaagatgaacatttttatctcgtattcgacgaatgctacttcgaactagcaaacatcgtcgcactatataacaaaattagaaactacataacacaaaaaccatattcggatgaaaaattcaaactaaattttgaaaattcaacacttgccaatggctgggataaaaacaaagaaccagacaacacagctattctcttcattaaagacgacaagtattatctcggcgtcatgaacaaaaaaaacaacaaaatattcgatgataaagccataaaggaaaacaaaggagaaggctacaaaaaagtagtatacaaactcctcccaggagcaaacaaaatgttacctaaagtattcttcagtgccaaatcaattaatttttacaatccctccgaagatatcctaagaataagaaatcactccactcataccaaaaacggctccccacaaaaaggttacgagaaattagaattcaacatagaagactgtagaaaattcatagacttctacaaacactcaataagtcgccatccagaatggaaagattttggcttcagattctctgatacaaaaaagtacaactccatagatgaattttacagggaagtagaaaaccaaggctacaaactaacctttgaaaacatatccgaatcatatatcgatagcctagtagacgaaggaaaattatacctattccaaatatacaataaagatttctcagtttactccaaaggaaaaccaaatctacacaccttatactggaaagcactcttcgatgaacgaaacctacaagacgtagtctacaaattaaacggtgaggcggaattattttacagaaaacaaagcatccctaagaaaatcactcatccagctaaagaagctatagctaacaaaaacaaagataacccaaaaaaagagtctatattcgagtacgatctaataaaagataaaagattcacagaagataaattcttctttcactgtccaattacaattaatttcaaaagctcaggagctaacaagttcaacgacgaaataaacttactcctaaaagaaaaagccaatgatgtacacatattatccatagaccgaggagaaagacacctagcctactacacattagtagacggaaaaggcaatatcatatgcaaaaactga

SEQ ID NO: 5787 - RNA, 3795 nt, synthetic construct
  misc_feature 1..3795: note = Cpf1 variant
  source 1..3795: mol_type = other RNA
atgctattccaagaatttacacacttatatccattaagcaaaactgttaggtttgaattaaaacctatcggaaaaaccctagaacacatacatgcaaaagacttcttatcacaagacgaaacaatggccgatatgtaccaaaaagtgaaagcaatactagatgactaccaccgcgacttcattgcagatatgatgtccggcgtagtacttacaaaacttgcagaattttacgaagtatacttagctttaagaaaaacaccaaaagacgactcccttcagaaacaattaacagaaattcaaaccgcattaagaaaagaaattgtaaaacccattggttcaggaggtaaatacaaagctggatatgacagactatttggagccaaattattcaaagatggcaaagaactaggtgacctagcgaaatttgtgataacacaagaaggagaatctagccccaaattagcacatatagcacacttcgagaaatttagcacatattttactggattccacgacaatcgtaaaaacatgtatagtgatgaagataaacacacagccatagcttatagattgattcatgaaaacctacccagatttatagataatcttcagatattagccactataaaacagaaacactcagccctgtacgatcaaatagtaaacgaactaaacgccaatggattagatgtatcactagcatcccacctcgacggataccataaactattaacacaagaaggtatcaccgcctacaatacattattaggaggaattagcggagaagcaggtagcagaaaaattcaaggaataaacgaactaatcaacatacaccataaccaacactgccaaaaatctgaacgaatagcaaaattacgaccgcttcataaacagatcttaagcgacggcatgggtgtatcatttctaccatcaaaattcgctgatgactcagaagtatgccaagcagtaaacgaattttacagacactatgcacacgtattcgctaaagtccaatcactcttcgatcgatttgacgactatcgaaaagatggcatttacgtagaacacaaaaatctaaatgaactctcgaaacaggctttcggcgatttcgcactactaggacgagtactagatggatattatgttgatgtagtaaatccagagttcaatgaacgcttcgccaaagccaagaccgataacgccaaagagaaattaacaaaagaaaaagataaattcatcaagggtgtacattcattagcctcacttgaacaagcgatagaacactacatcgcaggacatgacgacgaaagcgtacaagcaggaaaacttggtcaatatttcaaacatggtctagctggagttgacaacccaatccagaaaatacataactcccatagcactataaaaggcttcctagaaagagaaagaccagcaggagagagagctctacccaaaattaaatcagacaaaagtccagaaatgacccaactacgtcaacttaaagaactcctcgacaatgcactcaacgttgtccacttcgcgaaattactaacgacaaaaacaaccttagacaatcaagacggaaacttctatggcgagttcggtgccctatatgatgaactagcgaaaattgctacattatacaataaggtgagagactatttatcgcaaaaaccattctcaactgaaaaatataaattgaactttggaaatccaaccctactgaacggatgggacttaaataaagaaaaagataacttcggagtaatattgcaaaaagatggatgctattacctagcactattagacaaagcccacaagaaagtattcgataacgctccaaacgcaggaaaatccgtatatcagaaaatggtgtacaaactcttaccaggccccaacaaaatgttacccaaagtcttcttcgcaaaatcaaatctagattactataacccctctgcagaactattagataaatatgcacaaggaacacacaagaaaggcaacaattttaatctaaaagactgccatgccctgatagacttctttaaagcatcaataaacaaacaccctgaatggcaacactttggattcgagttcagtcccacatcatcataccaagacttaagcgacttttacagagaagtcgaaccacaaggatatcaagtaaaatttgtagacatcaatgcagagtacatcgacgaattagttgaacaaggccaactatatctttttcaaatttataataaagacttcagtcccaaagcccatggcaaaccaaatcttcacaccttatattttaaagcactattttcagagaataacctagcaaatccaatctataaattaaacggggaagccgaaatattttatagaaaagccagtttagatatgaacgaaacaaccattcatagagccggagaagtactcgagaataaaaatccagataatccaaagaaaagacaatttgtctacgacattataaaagataaacgatacacacaagacaaatttatgctacacgtacccataactatgaactttggggttcaaggaatgactatcaaagagttcaataagaaagtaaatcaatcaatacaacaatacaacgacgtcaatgtaattggtatcgatcgaggagaaagacacctactttatctaactgtaatcaacagtaaaggagaaatactagaacaaagatcactcaatgatataattacaacttccgcaaatggaacacaaatgaccaccccataccataaaatactagacaaacgcgaaatagagcgcctcaacgcacgggttggatggggtgaaatcgaaacaattaaagaattaaaatcggggtatttgtcccacgtagtacatcaaatctcccaactcatgctaaaatataacgcaatagtagtactagaagacctcaattttggattcaaaagaggaagatttaaagtagaaaaacaaatttaccaaaactttgaaaatgctttaataaagaaattaaaccatttagcccttaaagataaagcagatgacgaaataggatcatacaaaaatgctttacaattaacaaacaacttcacagacctgaaatcgatagggaaacaaactggatttttattttacgtacccgcctggaacacttcaaaaatagacccggcaacaggattcgtagatctgttaaaaccacgttatgaaaacatcgcacaatcccaagcatttttcggaaaatttgacaaaatcttttacaacgcagataaaggatactttgaattttatgtagactacgcaaaatttacagataaagcgaaaaactccagacaaacttgggtaatatgtagtcacggtgacaaacgatacgtatacgacaaaactgcaaaccaaaataaaggagccactataggaatcaacgtcaacgatgaactaaaatcactgttcgctagataccatataaacgataaacaaccaaatttagttatggacatctgtcaaaataatgacaaagagttccataaaagtctcatgtatttattaaaagcactcttagcactaaggtactccaacgcctcttcagacgaagatttcatattatctcccgtagctgacgacaaaggagtcttctttaacagcgctctagctgatgacacccaaccccaaaacgctgatgctaacggtgcataccatatagctctaaaaggtctatggctcttaaatgaactaaagaatagtaacgatttagacaaaatcaaactagcaattgacaatcaaacatggttaaacttcgcacagaacagatga

SEQ ID NO: 5788 - RNA, 3903 nt, synthetic construct
  misc_feature 1..3903: note = Cpf1 variant
  source 1..3903: mol_type = other RNA
atgtctatataccaagagtttgtcaacaaatactccctaagcaaaacactgagatttgaattaataccccaaggtaaaacccttgaaaacataaaagcacgcggactcatactcgacgatgagaaaagagcaaaagactataagaaagccaaacaaataatagacaaataccatcagttctttatagaagaaattctaagtagcgtctgcataagtgaagacctgctacaaaactattcagacgtttatttcaaattaaagaaatcagatgacgataacctccaaaaagatttcaaatcagccaaagacactatcaagaaacaaataagtgaatatataaaagatagcgaaaaattcaaaaatctatttaaccagaacctaatcgatgccaagaaaggacaagaatccgatctaatactatggttaaaacaaagcaaagacaacgggatcgaactcttcaaagccaatagcgacataactgacatcgatgaagcattagaaattatcaaatctttcaaaggatggacgacatacttcaaaggtttccatgaaaatcgcaaaaatgtctattcaagcgacgacatacccacaagcatcatatatcgaatagtagatgacaatttacccaaattcctagaaaacaaagctaagtacgaatctctaaaagacaaagcacccgaagccataaactatgaacaaataaagaaagacctagcggaagaactaaccttcgatatagactataaaacttccgaagtaaaccaaagagtcttctcattagacgaagtcttcgaaatagcgaatttcaataattacttaaatcaatctggaatcaccaaattcaacacaataataggcggaaaattcgtcaacggcgaaaacaccaaaagaaaaggcataaacgaatacattaatttatattcacaacaaatcaacgacaaaacccttaagaaatacaaaatgtcagtgctgttcaaacagattttatcagacaccgaatccaaaagtttcgtgatagacaaactagaagatgattctgacgttgtaaccactatgcagtcattttacgaacaaatagctgcatttaaaaccgtggaagaaaaatccataaaagaaacattatctttattattcgacgacttaaaagctcaaaaactcgacctatcaaaaatttattttaaaaatgataaatctttaactgatttatcacaacaagtatttgacgattattctgtgatcggtaccgcagtactagaatatattacacaacaagtggctcccaaaaatttagacaacccaagtaagaaagagcaagacttaatagctaagaaaacagaaaaagcgaaatatcttagtctagaaaccatcaaactcgcactcgaagaatttaacaaacaccgcgatatcgataaacaatgtcgctttgaagaaatattagcaaacttcgcagctatcccaatgatattcgatgaaatagctcaaaataaggataatctcgctcaaatatctctaaaatatcaaaatcaaggaaagaaagatttattacaggcctcagccgaagaagacgtaaaagctattaaagatctcctcgatcaaaccaacaacctactacatagattaaaaatattccatatctctcagagtgaagacaaagctaacattcttgacaaagacgaacacttttacctcgtattcgaagaatgctacttcgaattagctaacattgtaccgctatataacaaaataagaaactacattacacagaaaccttactcggatgaaaaattcaaactaaatttcgaaaatagtacattagcaaatggctgggataaaaacaaagaaccagacaatacagcgatactattcataaaagatgataaatattacctaggtgttatgaacaagaaaaataacaaaatctttgacgacaaagctatcaaggaaaataaaggagaaggatataagaaaatagtgtacaaattactccccggcgcaaataaaatgctaccaaaagtattcttctcggctaaatcaataaaattttataaccccagcgaagatatattacgaataagaaatcattcgacacacactaaaaacggaaacccacaaaaaggctacgaaaaattcgaatttaatatcgaagactgtagaaaatttatcgatttctacaaagaatctatatcaaaacaccccgaatggaaagacttcggctttcgtttctcagacacacaaagatataattccatagacgaattttacagagaagtagaaaatcaaggatacaaactcacatttgaaaatatatccgaatcttatatagacagtgttgtcaatcaaggaaaattatacctattccaaatatacaataaagatttctctgcgtactccaaaggacgaccaaatcttcatacactctactggaaagcattatttgacgaacggaatctacaggatgttgtatataaactaaacggtgaagcagaactcttctaccgaaagcaaagtattccaaagaaaataactcacccagccaaagaagccatagctaataaaaataaagataatccaaagaaagaatcggtattcgaatatgacttaatcaaagacaaacggttcactgaagacaaattcttcttccattgcccgataacaataaatttcaaatcaagcggggcaaataaattcaatgatgaaattaacctactccttaaagaaaaagcaaacgatgtgcatatcttatctattgatcgcggcgaacgacacctagcttattataccctagtagacggaaaaggaaacataatcaaacaagacacattcaacataatcgggaatgacagaatgaaaaccaattatcacgataaactagcagcaatcgaaaaagacagagactccgccagaaaagactggaagaaaataaacaacataaaagagatgaaagaaggctacctgtcccaagttgtccatgaaatagcaaaactcgtcatagaacataacgcaatagtcgtattcgaagatctaaatttcggcttcaaacgaggaagattcaaagttgagaaacaagtatatcaaaaactagagaaaatgttaatagaaaaattaaattacctagttttcaaagataatgaatttgacaaaaccgggggcgtactaagagcctaccaactgaccgcaccatttgaaacattcaagaaaatgggtaaacaaaccggtataatatactacgtcccggctggattcacatcaaaaatctgcccagtaaccggtttcgtcaaccaattatacccaaaatatgaatcagtatcaaaatcacaagagttcttctctaaattcgacaaaatctgctacaatctcgacaaaggctatttcgagttctctttcgactacaaaaacttcggtgataaagcagcaaaaggtaaatggactatcgccagttttggtagtcgtctaatcaacttcagaaacagtgacaaaaaccacaactgggacacacgagaagtctacccgacaaaagaattagaaaaattgcttaaagactacagcatagaatacggacacggtgaatgtataaaagccgccatatgtggagaatcagacaagaaattctttgcaaaattaacctcagtactaaacactatactccaaatgcgaaatagtaaaaccggcacagaattagattatttaatcagcccagtcgcagatgtcaatggaaatttctttgactcaagacaggcccctaaaaacatgccacaagatgctgacgctaacggagcataccacataggattaaaaggattgatgttactagatagaattaaaaacaaccaagaaggcaagaaactaaatttagtaattaaaaacgaagaatactttgaatttgtacaaaaccgaaacaattga

SEQ ID NO: 5789 - RNA, 3756 nt, synthetic construct
  misc_feature 1..3756: note = Cpf1 variant
  source 1..3756: mol_type = other RNA
atgaaccacatgaaacaattcaccaatcaatttagcctatcaaaaaccctacgattcgaattaatcccacaaggtaaaacaaaagaatttatagaaataaatggcttaatcgaaaaagacaacgaacgcgcagtatcgtataagaaagtaaagaaaattattgacgaatatcataaatactttatagaaatggtactgtgtgacttcaaactacatggtcttgaaacctatgaaacaatatttaacaagaaagaaaaagatgacacggacaagaaagagttcgataatataagaaattccctccgcaaacagatcgcagatgcatttgctaaaaaccctaacgacgaaataaaagaaagattcaaaaatctatttgcaaaagaacttattaaacaagacttgctcaacttcgtcgatgatgaacagaaagaactcgtgaatgaatttaaagacttcacaacatatttcacaggcttccatcaaaaccgaagaaatatgtacgtcgccgatgaaaaagctaccgccatagcatatcgacttgtgaacgaaaacctacctaaatttattgataatctaaaaatatatgagaaaatcaagaaagacgcaccagaattaatatcagatctaaataaaacattagtcgaaatggaagaaatagttcagggaaaaacattggatgaaatcttcagccttagcttcttcaaccaaacactaacacaaactgggatcgaactgtacaacatagtgattggcggcagaacagcagacgaaggaaaaaccaaaataaaaggactaaacgaatatataaatacagattataaccaaaaacaaacagataaaaagaagaaacaagccaaatttaaacaactctacaaacaaatattatcagacagacattcagtatcatttgtagcagaaacattcgaaacagatgcccaattattggaaaatatagaacaattctactcaagcgtactgtgcaattatgaagacgatggacacactactaatatatttgaagcaatcaaaaacctgataataggactcaaaaccttcgatttatccaaaatatacttacgaaacgacacatcattaactgacatttcacaaaaattatttggagactggtccataatatcctctgccctaaatgattactacgaaaaacaaaatccaatcagctccaaagaaaaacaagaaaaatacgacgaaagaaaagctaaatggctgaaacaggactttaacatagaaactattcaaacagcactcaatgaatgcgattcagaaataatcaaagagaaaaacaataaaaacatcgtatcagaatatttcgcaaaactaggtttagacaaagacaataaaattgatttacttcagaaaatacatcacaactacgtagttataaaagatttactcaacgaaccctacccagaaaacataaaactaggcaatcaaaaagaacaagtatcccaaattaaagattttctagattctatattaaatttaatacatttccttaaaccactctccctcaaagacaaagacaaagaaaaagacgaattattctattcactcttcacagcactattcgaacacttatcacaaacaatatctatctacaacaaagtccgcaactacctaacacaaaaagcctactcaacagagaaaatcaaactcaatttcgaaaactcaacattactaaacggttgggatgtgaacaaagaaccagtaaacacatccgtaatctttagaaagaacggactattctatttaggcataatgagtaaatccaacaatagaatattcgaacgaaacgtccccgtatgcaaaaacgaagaaaccgcattcgagaaaatgaactataaacttcttcctggagcaaacaaaatgctcccaaaagtattcctgtcagccaaaggtatagaaagtttccaaccaagtgctgaaatccaatcaaaataccaaaaagaaacccacaagaaaggagacgcattcgttcgaaaagatatggaaaatttaatagatttctttaaacaaagcatagctaaacacacagattggaaacattttaaccatcaatttagcaaaactgaaacatataacgatctatctgaattttataaagaagttgaaaaacagggatacaaactaacatttacaaaactcgacgaaacctacataaaccaacttgtagacgaaggaaaactctatttatttcaaatatacaataaagatttttcaccgttttctaaaggtaaaccaaacatgcacacgctatattggaaaatgctattcgacgaacaaaatctacaaaatgtagtgtacaaattaaatggagaagcagaagtcttctttagacaaagttctataaaacagaccgacagaatcatacacaaagccaaccaagcaatagacaacaaaaacccattaaacaataagaaacaaagctcatttaattacgacctaataaaagacaaaagatttacactagataaattccaatttcacgtccccattacactaaacttcaaagcagaagggaatgaatatttaaacactaaagtaaacgaatacctcaaaagcaactcagacgtaaaaataataggcttagatagaggtgaacgacatctaatctacctaacactcataaaccaaaaaggtgaattactaaaacaacaaagccttaacgtaatagcaacctcccaagaacacgaaacagactacaaaaacctcctcgtaaataaggaaaacgaaagagcaaacgcaagacaagactggaaaacaatcgaaacaatcaaagaacttaaagaaggatacctgtcccaagtagttcatcaaatagcaactatgatggttgacgaaaatgcaatagtagtcatggaagacttaaatgcgggattcatgcgaggtcgacaaaaagtcgaacgacaagtatatcaaaaactagagaaaatgttgatcgaaaaactgaactatttagtatttaaaaacaacgacgttaatgaaactgcgggagtcttgaacgcactccaactaacaaacaaatttgagagcttcgagaaaatgggaaaacaatctggattcctattctacgtaccagcgtggaacacatctaaaatagacccagcaacaggttttgtagatttcttaaaaccaaagtacgaaagcgttgaaaaagccaagctctttttcgaaaaatttgaatcaataaaattcaatgcagacaaaaattatttcgagttcgaatttgattataagaaattcaccgaaaaagctgaaggttcacaaactaaatggaccgtctgtacacatagcgacgtccgatacagatataacccacaaacaaaagctagcgatgaagtaaatgtaacaaacgaactaaaattaatctttgataaattcaaaatcgaatataaaaacggcaaaaacctaaaaaccgaactattattacaagacgataagcagctcttttcaaaacttcttcactatctagccctaacattaatgttacgccaatccaaaagcggaacagacattgacttcatcctctcccctgttgccaaaaatggagtattctatgacagcaggaacgccatgccaaaccttccaaaagacgcagacgccaatggagcttttcacatcgccctcaaaggactgtggtgtgtacagcagataaagaaagcagatgatttaaagaaaatcaaactggccataagcaacaaagaatggctatcctttgtgcaaaatctcaaatga

SEQ ID NO: 5790 - RNA, 4173 nt, synthetic construct
  misc_feature 1..4173: note = Cpf1 variant
  source 1..4173: mol_type = other RNA
atgatagacaatacaaaagagaagaaagaaggttccgtattcgatggattcactaggaaatatcaactatcaaaaacgctacgattcgaattacgaccaatattaaatacacctaaaatgctagacgacgaacaagttatcaaaaacgacgaaacacggagaaagaaatacgaagctgtcaaaccgtggtttgatcaactacacagagagttcatagaagatgcactcaaatcatttaaatttaaaaatctcgcgatatatcaagacacatttcaaacttggcaaaaagatcgaaaaagcaaacagaagaaagacacattagtaaaaatagaagtaggattaagagaagaaatagtgagaagatttgaagaagttgcaaatatatgggtacggtccgaacagtataaacttctaggaataaagaaagaaggcctcggaatgctctttgaagcaggcgtttttcgacttctgaaagaacgtttcaaaaatgaaaaagacactaccgttgacggcaacaatatctttgatgaatggacaagatggacaggctactttaagaaattcttcgaaacaaggaaaaatttttacaaatcagacgacacatcaacagcaatagcctatagagtaataaatcaaaatctcagaagattttgtgaaaatatccaaatctttgagaaaatttcagagaaaatagaattttctgaagtagaaaaatcctttgacataagctgtgcaggaatctttagcctagcttattacaatgcttgcctactacaaggtggcatcgacacgtacaataaaataatagggggcgaagttgatgaaaaagacaagaaaataccaggaataaacgaattgatcaacaaataccgacaagacaatagcggggaaaagataccattcttaaaacaattagacaaacaaatacacagtgcaaaagaagcgtttattgaaagtatagaaacaaataaagaactggtagggaaacttaaaacattctatgaaaacgcagaagtgaaaattcaaagtttcagaaatttaattgcagatatagtaacagactattccgggtacgacatagacaaaatatatcttactaaagaagcagtgtcacacaacgcaagtaggtggttcgccagcttcgaatcatttgaaagagatctattcgcagttgtagcagaaaaacaaaacaaactcgtatatgaactactacgaacacataaaaacgattcaaaaatatcggataaagatggcaaattctcatttcctgattttatcaaatgttctcacataaaacgagccctggaaaaacaagaaggtagaatatggaaaggtgaatattatgaagatattgtagatttcgagaaaatcaaagacgtattcacacaatttctttgcgtcttcaaattcgaactggaacaacaattctttcgcaaaacaacaagcgcacaaacaggcgaacaaacaaaaataggatatgaaatcttcgttacaaaaataaatgaactaataacaagagaaaatccagtcattgaccttgaagagaaaattgctatcaaaaatttcgctgatgcgacactattaatctatcaaatagcaaaatattttgctgtcgaaaaacgaagaggttggcttgataattatgatcttgacgaccgtttttacaaaagctcagatatcgggtacttaaacttctacagagacgcatttgaacaaatcgtacgaccatataacctattcagaaactacttgacaaagaaaccatacaacacgaataaatgggttctatcgttcgaaaacccaacactagcagatggttgggataaaaacaaagagaaaactaacgcagcagttatcctgcgaaaagacggcaggtactatctaggtatcatcaaagaagattgcaaatcattatttgcagatagatacagcaaagaaatgtcggaaggaatagaatcgggatcgttccagaaaatggcatataaattctttcctgaagcaagtaaaatgataccaaaatgttcaactcaaactaaaaacgtcaaagaacattttagaaaatcctccagtgactacaacctatttcatgaaaaagattacaaaataagtgtcgcaattaccaaaaatatttacgaactgaacaatgtattctataggaaagataatatagaagaatcgttcgtacctaaaaacgatttcgaaaagaaacttggcgtgaagaaatttcaaagacaataccttgaaatatcaagagacaataacggatataaacaagcgctagcacaatggatagaattttgcattagattcctaaaagcatacaaaagtacaacaattttcgactattcaagattaagagaagccaaagaatatgaaagtctcgatgcattctaccaagacataaacgccttaacgtacaacatatcatttgtccctatatctgaacaatacataaaagagaaaaacgataacggggaactcttcctattcgaaatttacaacaaagattggtcactcggacctatggataaaaataggaaaagaaccaaaaatctacatactctgtattttgaacaattattctcaaaagaaaatgaacaagaaaacttcctattccaactaaatggagaagctgagctctttttcagaccaaaaacggaagagaaaagactcgggtacaaagtatgggatgctggtgaaaagaaatgggtcaaagcaaaggaaaaagaagacggtgcagtcatagacaggaaacgatacgcaaaagatattatactatttcactgcccaatcacactaaaccgtgtatctgaaagcaagactaaaagagaaatggacgtagaaataagagaagtcctatcctcaacgcccggtgtccacataataggggttgacagaggagaaaaacatctagcatattacagcgttatagatcaaaacggaaaaataatagaaaccgacacactaaacagtattggaaaagacggacgaggtaaacccgttgaatacgcgtcaaaattggaaaaacgagcacaagaaagagaagccagcagacgagattgggaagaagttgaagcaattaaagacctcaagaaaggatacatatctcaagtaataaggaatctcgcagacctgataatcaagcacaacgcaataatagtatttgaggatctcaacatgagatttaaacaaatcagaggcggaatagagaaaagcgcataccaacaactagagagagcactaatagacaaactaagtttcctagttaaaaagggagaagaagatcctaaacaaacaggtcacatacttagagcctatcagctcgcagcgccggtaatcgctttcaaggatatgggcaaacaaactgggttgatattctacacccaagcaggatataccagtaaaacatgccccgaatgtggttacagaagaaatataaagtgtctattcgagaacatagaacaagcaaaaacattaatagaaaatctcgaaagcataaattacaataagaaagaagatgtattccaaatatcatactcattagagaaactaagctctaaggatcagaagaaagagaagaaagtctccaatgaattatacgcaaaaaccctaaagaaagacatatttatattgacaaccaaaaacgcattaagatacaaatggtatgatcgatactctgaaaaagcaaaagtagcaaaaaggggaattgacgaatacaaaggcgaagtaaacgaatcagaaaccaagaaaggtgtggttaaagaatttaatttaacagaatacttgaaaggactactcaaaacgtacgaaatagattacgaacatggaggaataagagaacaaatactatccgtggcgagaggaagagaattttataaagactttttatatgcgctattcctcctaacagaaaccaggcacagtataagtggtagaaacacagattatattcaatgtccagaatgcgagttcgattctagaaaaggcttcaaagacataaaagaatttaacggagatgcaaacggtgcttataacatagcgagaaaaggcataatgatactcgaaaagataaaacaattcaagaaagacaacgacggaaatcttgagaaaatgggatggggtgatttatcaatatcaatcgaggaatgggacaaattcacacaaaaagaatga

SEQ ID NO: 5791 - RNA, 4026 nt, synthetic construct
  misc_feature 1..4026: note = Cpf1 variant
  source 1..4026: mol_type = other RNA
atgaatgccgaaaaaaaatgtgcttttaacgaattcacaaatttgtatgaactcagtaagacgctaaaattcgaactaaaacctgtaggaaaaacgaaagaaataataaaaaatttccgtgaggaactagagaaaaacaatccaatacaattggacaaagaaatatctattgcaaaacaggaaattaaaaaagacctagacatattgcacagagaatttgtaagacaatcatttgaattagcctttaaagaaaataaaataaattacgaaatattctttgaaatatacagaaacttcaaaaaattctcaaagaacaaaaagagcgacgaatacattgctgctatcaaaaatctgaaagaagaaaaaataaaactcgtgaaaaaaatagcagattatttcgtcaaaatggaccaagaatggagaaaatactatcccagtgaaaaaaaaagctttttactcatgagcaacggggtcatcaacttattaatagacatcaacaaagaccgaatggactactcctttatacccaaggaagtttgtgaaaaaataaaaggtaaaggcaaaatagaattatatgaaaagttcaataagcacttcggttatctatccaaatacaacacagcaagagaaaacttctattcggacgacgtaaaaaactcagcaagcgttgcatacagggcgatctgtgaaaacctagaaaaattctgcgacaataaaataaaagttgaggcggacaacttccccaaggaaatcaaagaaaaatttctcgaatacttcaataaaataacggatttatcattctacaatcgctgcctgagtcaaaatggcatcgaagaatatcataaattcaaagacgaaatcaatcgatcaataaatgaactttacccaaacaatagtaaaaataaaccccaaaacatcccatacttaagcaaactagataaacaaatactttctgaaaaggacaaacaaagttggatcgaagaaggattcatagacgaaaataatttcatcttcgaatttgaaaagtttataaaaatgaacgacaaatatattccaagcgaaaaaaaattattcaacgagtttttcattttccagaataacgacgaagtacttcaaaaactcttcctattaaagaaaacaataaataactttgcaaacatctatctagatgatccaaaaaacttgatggacctaatgccctcaaaaggaacaaaaaaaagggattatttaagtttattagaaataaaagaagcactaaacagctatgcagaaaaccaaaacattggagaaacccagatatttaaaataaaatacgacgatgttatagataaaactaaaactccttttgaatgtttcatgaaaatatggaaatacgaatatgatctcctgtataatgaaggcgatgggaaaaagaatatcgaagaaggatgggaaaaaatctgcgaaaaattacaaaataaaaaagacgaatttacaggagactacggtaaatacaaaaaagaaatcaaagactactgcgaaatggccctaagcttatcacaaaggataaaacatctagacatcagaattaaaaaaagagacggcagcgaagacgcagacaacaacttatttgaaggtgtcgaaaaactcgatgagttctacgataggctattcgaaattgtagacgaacacaatgcataccaataccatcatgaatttcaagcattcctaactaaaaagccatataaaacagataagttcaaactaagttttgacaatccacaactgttaaaaggttgggacctaaacaaagaaccagattactttggtgccctattggtcaagaacgaaaaatatttcctagcagttttccataaacaatacgcgaacgaaatatttagacaaaaaaataaaaactcaacagtaaaaattaaagaagcatatgacgtgtttaacggaaattattataaaaaagtcgaactcaagcaaatcccaaaactattcatgaatttaccaagaatatgcttcgccaaaagtaatcaagaagaatttgggctaacaatagaacttgaaaaaattaaaagtgaatttgacaaattccaaaaactgaaaaaagaacgtcaagataacaacttaaaattcgatcaggaaaaatttatcaaactattagcatactacagacactgtttagaaattagagaagattggaaagtttttaaatacaacttcaaaccactatataaatacagcaacttaggagaattctacagggatctagaaaaagacacatataatctggacctagtcagagtgaactctgaatacgtcgaaaaaaaacgaaacgaaggaaaattatacttatttgaagtttacaacaaagatttctcagataaatcaataggaagaaaaaatatacacagcgactattttaaatcgttattcttaccagacaaccttacaaacaaaaaaatagcattagcggcagacgcggaaatatttttcagagagaaaagcttaaaaaataaagatgaaataataacacaaaagaataaaatcaaaatagacaaaaacaatcataaaggagaaaaagcatattcgaaaaacagatacacagacgacaaaataatcttgcaccttccgataaatttaaatttcggcgaaaacaaaaaccacaaagacttcaattacgaaataaacgactctctcttgaaaaacaaccgagatataaaaataattggcattgatagaggagaaaaatacctactatactactcagtaattgaccaaaaaggcgacatcaaagaaatgggagactttaatgtagtaaacggtgtggactactactcaaaactagtagcatacgaagagaaacgcaagcaggcaaggctagattggggggacatacaaagcataaaagaactaaaggaaggctacatctcgcacgtaatacatgaaatatgcgatctcataaagaaatataacgccatagtagtattggaggatttatccatggggtttaaaagaggaagattcttccgagaaagacaagtctaccagaagttcgaattagcgttattccgaaagttaaactattgggttgataaaaacaaagaagaaggggaaaagggatcagcactaagcgcatggcaattaacacccaatgagaaagactttaaagtaagtcaactagaaaaagctagacaattaggaattctattctacacagctgcaggatatacaagcaaaacatgcccagactgtggcttccgaaaaaatatcacactcaaatacgtgaacgacaaacagctaaaagaagaccttggaaaactaaaaataaatttcgtcgaagatcatttcaaaataaaatataatctactagattttgaaaaaaataaaaaatcagaaaaagccaaagacacggtcctacctaaagaagaaagaaaaatatcgttcgtagccaactcaaaagtaatccggataaggtggcacgacattaaaactaagctagccaaacgagaattggacggggaaaagataataaaaaaattccctaaaggagtaataaaagaatatgacatcaatatatgtctcaagagaataataggcgataaaattgatttcagcaaggattccataacagaacaactaatcaatggacgtttcggtaaagacttctactgggaactgatgtattttctaaatctaatcctcgaaataagaaacgtagtaagcgaaacagaaatagactacatacaatgtcctgtatgcggatttcactccgatgacggttttcgagggaataagtttaacggagacgcaaacggtgcctacaacatagcaagaaaaggacgtctgatattagaaaaaatcaatcaacacaaaaatcttaaagaactcaaaaccggagacctatcagtgaacatagtagaatgggacaaagcggttaacaactgggacaaatttgtacaaggggataacacagaatcaaagaatatagaaatacctgcaaaagaagagatgataagcgtagaagtacgtgagtcctga

SEQ ID NO: 5792 - RNA, 4107 nt, synthetic construct
  misc_feature 1..4107: note = Cpf1 variant
  source 1..4107: mol_type = other RNA
atgaagaaagaaaaagagttcaaatccttcggagacttcacaaatttatacgaaatatctaaaacactacgttttgaactaaaaccggtagaaaatacacaaacaatgctagatgaagcagacgtcttcggaaaagacaaagtaataaaagataaatatacaaaaacaaaaccatttattgacaaactgcatcgcgaatttgtggacgaatccctaaaagatgtatcactatctggtctcaagaaatactcagaagtcctggaaaattggaagaaaaacaagaaagataaagatattgtgaaagaactgaagaaagaagaagaaagacttagaaaagaagtagtcgaatttttcgacaacaccgcgaagaaatgggcgaatgaaaaatacaaagaactaggtcttaaaaagaaagatataggaatactatttgaagaatcggtctttgacctacttaaagaaaaatacggagaagaacaagactctttcctgaaagaagaaaaaggggacttccttaaaaatgaaaaaggcgaaaaagtatctatatttgacgaatggaaaggattcgtaggctactttacaaaattccaagaaacaaggaaaaatttttataaaaatgacgggactgaaacagcattagcaactcgaataatagaccaaaatctaaaaagattttgtgacaacatagacgactttaagaaaatcaaaaataaaatagactttagtgaagtagagaaaaacttcaataaaacagcagacgtattctcacttgacttctacaatcagtgtctactacaaaaaggtatagattcatacaatgaatttataggtgggaaaacactagaaaacgggaagaaactaaaaggcgttaatgaattagttaatgaatatagacagaaaaataaaaacgaaaaagttagcttcctaaaactactcgataaacaaatactctcagaaaaagaaaaactcagcttcggaatagaaaatgacgaacaactcttagtagttctaaactcattctacgaaacagctgaagagaaaacgaaaatattaagaacactattcggagacttcgtagaacacaatgaaaactacgacctagacaaaacctatattagtaaagtcgcatttaatactatatcacataaatggaccaacgaaacacacaaattcgaagaattattgtacggggcaatgaaagaagataaacccatcgggttaaattatgacaagaaagaagacagttacaaatttcccgattttatagcactaggctacctaaagaaatgcctaaataacttagattgtgatactaaattttggaaagaaaaatactatgaaaataatgcagacaagaaagataaagataaaggatttttaacaggaggacaaaacgcatgggatcaattcttacaaatctttatattcgaatttaaccaattattcaacagcgaagcatttgataataaaggcaaagaaatcaaaataggctatgataattttagaaaagattttgaagaaataataaatcagaaagattttaaaaatgacgaaaatttaaaaatcgctatcaaaaacttcgcggacagtgttctatggatatatcaaatggctaaatactttgcgatagaaaagaaaagaggatgggatgatgatttcgaactaagtgaattttacacaaacccaagcaacggatattcactattctatgatagagcatatgaagaaatagtacaaaaatacaacgatttgagaaattatctaactaagaaaccttacaaagaagataaatggaaattaaattttgaaaatccaactttagcaaacggatttgataaaaacaaagaatcagataattctaccgtaatactccgaaagaaaagaaaatactatttagggttgatgaagaaaggaaacaacaaaatcttcgaagacagaaacaaagcagaatttataagaaatatagaaagcggggcatacgagaaaatggcttacaaatatttacctgacgtagcaaaaatgataccaaaatgctcaacgcaactaaacgaagccaaaaatcattttagaaactcagcagacgatctggaaatcaagaaatcgtttagtaacccactaaaaataactaaacgcatatttgatttaaacaacatacaatacgacaaaacaaacgtgagcaagaaaatatccggcgataataaaggcataaaaatatttcaaaaagaatactataaaataagcggagatttcgacgtttacaaaagcgctctgaacgattggatagacttttgcaaggacttcctaagcaagtacgattcaactaaagatttcgattttagcatactacgaaagacgaaggactacaaaagcctagacgagttctacgttgacgtagccaaaataacatacaaaatatccttcaccccagtaagcgaatcatacatagaccagaaaaataaaaacggagaactttacctgttcgaaatatataatcaagacttcgccaaaggaaaaatgggcgccaaaaacttacacacattatacttcgaaaacgtattcagtcccgagaacataagcaagaattttccaatcaaattaaatggcaacgctgaactattctttagaccaaaatcaatcgagagtaagaaagagaaaagaaactttgtccgcgaaatagtgaacaagaaaagatactcagaggataaaatatttttccattgtcccataacgctaaatcgtgaaacaggatcaatatacagattcaacaactacgtaaacaatttcttaagcgaaaacaacataaacattataggtgtagatcgtggagagaaacacctagcctactactcagttatagacaaaaacggagtaaaaataggtggcggctcattcaacgaaataaataaggtggactacgcaaagaaattagaagaaagagcaggcgaacgagagcaaagtagaaaagattggcaggtagtggagggaataaaagatttaaagaaaggctacatatcgcaagtagttagagagctagcagacctagcaattaaacacaacgccataatagtgctcgaagatctaaatatgagattcaaacagataaggggaggaatagaaaaatctatatatcaacaactagaaaaagcactaatagacaaactaagttttctagtcgaaaaaggcgaaaaggatccgaaccaagcaggacacattttaaaagcctatcaactagcagctccattcacgtcatttaaggacatgggcaaacaaacaggaatcgtcttctatacccaagcaagctacacgtctaagacatgtcctaattgcggattcaggaaaaacaataacaagttctatttcgaaaataacattggcaaagcacaagacgctctaaagaaactaaaaacgttcgaatatgactccgaaaacaaatgctttggactaagctactgcctcagtgattttgcaaataaagaagaggtcgagaaaaataaaaataaaaagagaaataacgcaccatattcagacattgagaagaaagactgcttcgaactcagtacaaaggacgcagtaaggtataggtggcacgacaaaaatacagaacgtggaaagacattcttcgaaggagaaagtgtatacgaagaaaaagaagaaaaagaaataggacaaacaaaaaggggcttagtcaaagaatacgatataagtaaatgtctgataggcttattcgagaaaacggggttggactataaacaaaatctgctcgacaaaatcaatagcgggaaattcgacggaacattctacaagaatttattcaactatttaaacctactcttcgaaatacgaaactcgatatcgggaactgaaatagactacattagctgccccgagtgtcaatttcacacagataaaagcaaaacaatcaaaaacggagacgataatggatcttacaacatcgccagaaaaggaatgataattcttgacaaaattaaacaattcaagaaagaaaatggatcacttgacaaaatgggttggggagaactatttattgatctagaagagtgggacaaattcgcacagaagaagaataacaatataatagacaaatga

SEQ ID NO: 5793 - RNA, 4149 nt, synthetic construct
  misc_feature 1..4149: note = Cpf1 variant
  source 1..4149: mol_type = other RNA
atgagcaaaaacaacgtttgggataaattcacaaatcaatattccctaagcaaaacattaagatttgaattaaaaccggtaggtaaaactagagaaaaaatgaacgagcaactaaagtacgacaaacaattacaaaccttcctaaaggaccaagaaatagaagatgcataccaatatttaaaacccttttttgacaaactacataaagagtttataacagactcattagactcagacactaccaaaaaaatagacttttcagattatttaattgattacagagacaaaaaagacctaacgaaaaaagaagactcattgcgaaaaaatataggtgaagtcttcgtaaaggctggagataggtggaaaaaggagaaataccctaaatacgaatggaaaaaaggaagtaatgtagcaaatggcagcggaatcttgcttacccaagatgtattgatgctgataaaagatttaaatccaaatgaccaaaagataaagaaaatgatagaggaaaccttcaagggattcttcacctatttcagcggattcaacctaaatcgggaaaactactatacaaccaaagtagaaaaagcaaccgctgtagccactagaattgtacacgataatttaccaaaattctgcgataatctagtacaattcgaatgtataatcaaaaaaaaaaaaaacggcgaagtagacagaattgagcgaaaaagtgaatacctaaatgcttaccaatatctaaaaagcaaaggccggacaactcaaatcaaagatgcagaaagcggaaaaatgatcgaagctgaagtaatcaatgaaaacatgtttagtatttcatatttctccgcctgtctctcacaaagtggcatagaagaatataatcgcacgattgggcattataatttgctaattaacctatacaatcaagccaaagaaggggaagaaaaagacctaaaaaagagcgagaagaaattcaaaaggctaccaatatttaaaacgttatacaaacagataggctgtggagagaaggaacctctatttttcagtcttacacacgatacaaagttacaggtacaagaaaataaagaaaactacaaaaaaccttacagtgtggagcaaatattagaacaagccaaacttgcaggagacaaatactttaaaggaaaaagtaacgacggtatcctaaacactataccggaatttagtgattacatattacagaaagaatcttacggaggtgtctactggtcaaaagtcgcaataaacacaatcagcaacagatatttcgaaaattggcacacgttaaaagacgcactcattgatgcaaaagtattcgaaaagggcaaaaaaggagacgaggaagacgtgaaaataccagaaagcatagaattacagggatttttcgacgttttagatacacaagagggatggaaaagtgaaggtatctttttcaagaagagtttaactgaagagttaaaaaacaaagaagctgatacaaagaataagaagaggagagaaattgtaaaagaagcaaaaagaccatcccaagcactattagctcttttatttgatgacatacaagaacacgcaaatttgttcctaaatcaaagcgacgaaatcctcaaactcgaaaaatattctgaaaaagaatcaaaagaaaaaataaaacaatggatggattcggccttagcagttaaccgcatcctaaaatattttttcgttaaagaatctaaggcaaaaggagaacaaatagatcctatcataagtgaagcactaaaagtactattcaattccgaagacgcaacctggttcaaatggtacgacgcattaagaaattacttaactaaaaaaccacaggatgatgtaaaagaaaacaagttaaaattgaactttgaaaactcgacgctagcaggaggctgggatatcaacaaagaatcagataactactgcgtaatattacaagaccaaaaaggtaaacaacacctaggtataatagcaaaaaaagaaaaacaaagaggatataacaaaattttcgagagaacaccagagaatccactatacaaaatagatagcggagaagtgtggcaaaaaatggaatataaacaaatcgcggtcccgacaggcattggaggcttcgtaagaaaatgctttaacacagcacagcaatatggatggaaatgccccgacaattgcctaaatagtgaaggtaaaattataataaaaaatgatgaagctaaagaaaacctcgaagccattatagactgttacaaagacttttttaccaaatacgaaaaagacgggtttaaatataaaaatttcaacttcaatttcaaagaaagcgaagaatacgaagaactaaattccttcttctcagacgtcgaacgacaaggctacaaattaggatttattactgtaaacaaaacaataatagacaaatgggtcgaagacggaacaatctacttgttcgaaatcaaaaatcaagacacaaacgacggaaagaaagacgggcacaagaataatttacacactatctattggaaagcactattcgaagatgtaggaaacaaacctaaactcaatggaggagcagaactgttctatcgcaaagcattattaaaagacaaacaagaaaagatagaagataactacggaaaggaaataattaaaaactttaggttttcaaaagaaaaatttttattccattgccccataaaattaaactacaaagcaaaatcgtattcacacccaaaatacgctctgccagaaataaataaacaaacaaatgaattcttcataacaatatcagatatatgctttctgggtatcgacagaggagaaaaacatttagcatattactcgcttgtcaaccaaaaagaagaaatcatagaccagggaacgcttaacatgcctttcgttgataaggatgggaaaccaaggtcaattaaaaaagagaaatttagatttgatgcaaaagtagacaaatgggtaagcgaagaaatggattgctggaactataatgacttactagacgctatggctagtaaccgagacatggcacgaaaaaactggcaaaccatcggcacaataaaagaattaaaaaacggatacatttcacaagtggtcagaaaaattgtagatctcgcgatagacaaaaacaggggcataccatcctttatagtactagagaatttaaacgcaggcttcatgaggggaagacaaaaaatcgaaaaatcagtttaccaaaagctcgagttagcactagcaaaaaagctaaattttgttgtggacaaaactgtccaaaatggagaaataggatccgttacaaacgcacttcaattaaccccacccgttacgaatttccaaaacatcgaaaatagaaaacaagtcggaataatgctatacaccagagcagattatacatcccaaacagaccccgtaaccggatggcgaaaaagtatttatctaaagaaaggaagcgaagaatacataaaatcccagataatggacagttttgatgatttcggattcgatggaaaaaattactatttcaaatacacagtagacttaatcgatccaataaaaaaaacaagcgaaaaaaaattcaaaaaacaatggacactatacagcgggattaacgggaaaagtctagataggttccgaggagaaagatcttccgacaaaaacgtctggataaaaacgttacaagacataaaaaccactctggacgcagtattcatcggattcgacctgcaacattcactacgaagccaaataataaacgatgggattatgcctaaaaaaatagaaaactcacaatttacaggttgggaatcattaagattcgccatagaaatgattcaacaaatacgaaacataggcgtagaaaaaggagacgaagattttatattatcaccagtcagagacaaaaatgagaaccactttgatagccggaaggccaaagaaaatgaaccaaactctggtgacgccaatggggcatataacatagcaagaaagggaataataatgaacgaacacataaaaaaagatttaatccctttcatacaggataaagaatgggatgcatggttagctggcagagaggtatgggacaaatggctaatagaaaataaagactccctaatttataaaaaatga

SEQ ID NO: 5794 - RNA, 4203 nt, synthetic construct
  misc_feature 1..4203: note = Cas9 variant mRNA product
  source 1..4203: mol_type = other RNA
atggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaatga

SEQ ID NO: 5795 - RNA, 4986 nt, synthetic construct
  misc_feature 1..4986: note = Cas9 variant mRNA product
  source 1..4986: mol_type = other RNA
atggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaatga

SEQ ID NO: 5796 - RNA, 3258 nt, synthetic construct
  misc_feature 1..3258: note = Cas9 variant mRNA product
  source 1..3258: mol_type = other RNA
atggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaatga

SEQ ID NO: 5797 - RNA, 4326 nt, synthetic construct
  misc_feature 1..4326: note = Cas9 variant mRNA product
  source 1..4326: mol_type = other RNA
atggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaatga

SEQ ID NO: 5798 - RNA, 3402 nt, synthetic construct
  misc_feature 1..3402: note = Cas9 variant mRNA product
  source 1..3402: mol_type = other RNA
atggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaatga

SEQ ID NO: 5799 - RNA, 4263 nt, synthetic construct
  misc_feature 1..4263: note = Cas9 variant mRNA product
  source 1..4263: mol_type = other RNA
atggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaatga

SEQ ID NO: 5800 - RNA, 3345 nt, synthetic construct
  misc_feature 1..3345: note = Cas9 variant mRNA product
  source 1..3345: mol_type = other RNA
atggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaatga

SEQ ID NO: 5801 - RNA, 4101 nt, synthetic construct
  misc_feature 1..4101: note = Cas9 variant mRNA product
  source 1..4101: mol_type = other RNA
atggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaatga

SEQ ID NO: 5802 - RNA, 4134 nt, synthetic construct
  misc_feature 1..4134: note = Cas9 variant mRNA product
  source 1..4134: mol_type = other RNA
atggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaatga

SEQ ID NO: 5803 - RNA, 3267 nt, synthetic construct
  misc_feature 1..3267: note = Cas9 variant mRNA product
  source 1..3267: mol_type = other RNA
atggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaatga

SEQ ID NO: 5804 - RNA, 3345 nt, synthetic construct
  misc_feature 1..3345: note = Cas9 variant mRNA product
  source 1..3345: mol_type = other RNA
atggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaatga

SEQ ID NO: 5805 - RNA, 3351 nt, synthetic construct
  misc_feature 1..3351: note = Cas9 variant mRNA product
  source 1..3351: mol_type = other RNA
atggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaatga

SEQ ID NO: 5806 - RNA, 3051 nt, synthetic construct
  misc_feature 1..3051: note = Cas9 variant mRNA product
  source 1..3051: mol_type = other RNA
atggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtga

SEQ ID NO: 5807 - RNA, 3462 nt, synthetic construct
  misc_feature 1..3462: note = Cas9 variant mRNA product
  source 1..3462: mol_type = other RNA
atggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaatga

SEQ ID NO: 5808 - RNA, 4020 nt, synthetic construct
  misc_feature 1..4020: note = Cpf1 variant mRNA product
  source 1..4020: mol_type = other RNA
atggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaatga

SEQ ID NO: 5809 - RNA, 3999 nt, synthetic construct
  misc_feature 1..3999: note = Cpf1 variant mRNA product
  source 1..3999: mol_type = other RNA
atggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaatga

SEQ ID NO: 5810 - RNA, 4716 nt, synthetic construct
  misc_feature 1..4716: note = Cas9 variant mRNA product
  source 1..4716: mol_type = other RNA
gggagagtcccgcagtcggcgtccagcggctctgcttgttcgtgtgtgtgtcgttgcaggccttattcaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5811 - RNA, 5499 nt, synthetic construct
  misc_feature 1..5499: note = Cas9 variant mRNA product
  source 1..5499: mol_type = other RNA
gggagagtcccgcagtcggcgtccagcggctctgcttgttcgtgtgtgtgtcgttgcaggccttattcaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5812 - RNA, 3771 nt, synthetic construct
  misc_feature 1..3771: note = Cas9 variant mRNA product
  source 1..3771: mol_type = other RNA
gggagagtcccgcagtcggcgtccagcggctctgcttgttcgtgtgtgtgtcgttgcaggccttattcaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5813 - RNA, 4839 nt, synthetic construct
  misc_feature 1..4839: note = Cas9 variant mRNA product
  source 1..4839: mol_type = other RNA
gggagagtcccgcagtcggcgtccagcggctctgcttgttcgtgtgtgtgtcgttgcaggccttattcaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5814 - RNA, 3915 nt, synthetic construct
  misc_feature 1..3915: note = Cas9 variant mRNA product
  source 1..3915: mol_type = other RNA
gggagagtcccgcagtcggcgtccagcggctctgcttgttcgtgtgtgtgtcgttgcaggccttattcaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5815 - RNA, 4776 nt, synthetic construct
  misc_feature 1..4776: note = Cas9 variant mRNA product
  source 1..4776: mol_type = other RNA
gggagagtcccgcagtcggcgtccagcggctctgcttgttcgtgtgtgtgtcgttgcaggccttattcaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5816 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5817 - RNA, 4614 nt, synthetic construct
  misc_feature 1..4614: note = Cas9 variant mRNA product
  source 1..4614: mol_type = other RNA
gggagagtcccgcagtcggcgtccagcggctctgcttgttcgtgtgtgtgtcgttgcaggccttattcaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5818 - RNA, 4647 nt, synthetic construct
  misc_feature 1..4647: note = Cas9 variant mRNA product
  source 1..4647: mol_type = other RNA
gggagagtcccgcagtcggcgtccagcggctctgcttgttcgtgtgtgtgtcgttgcaggccttattcaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5819 - RNA, 3780 nt, synthetic construct
  misc_feature 1..3780: note = Cas9 variant mRNA product
  source 1..3780: mol_type = other RNA
gggagagtcccgcagtcggcgtccagcggctctgcttgttcgtgtgtgtgtcgttgcaggccttattcaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5820 - RNA, 3858 nt, synthetic construct
  misc_feature 1..3858: note = Cas9 variant mRNA product
  source 1..3858: mol_type = other RNA
gggagagtcccgcagtcggcgtccagcggctctgcttgttcgtgtgtgtgtcgttgcaggccttattcaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5821 - RNA, 3864 nt, synthetic construct
  misc_feature 1..3864: note = Cas9 variant mRNA product
  source 1..3864: mol_type = other RNA
gggagagtcccgcagtcggcgtccagcggctctgcttgttcgtgtgtgtgtcgttgcaggccttattcaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5822 - RNA, 3564 nt, synthetic construct
  misc_feature 1..3564: note = Cas9 variant mRNA product
  source 1..3564: mol_type = other RNA
gggagagtcccgcagtcggcgtccagcggctctgcttgttcgtgtgtgtgtcgttgcaggccttattcaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5823 - RNA, 3975 nt, synthetic construct
  misc_feature 1..3975: note = Cas9 variant mRNA product
  source 1..3975: mol_type = other RNA
gggagagtcccgcagtcggcgtccagcggctctgcttgttcgtgtgtgtgtcgttgcaggccttattcaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5824 - RNA, 4533 nt, synthetic construct
  misc_feature 1..4533: note = Cpf1 variant mRNA product
  source 1..4533: mol_type = other RNA
gggagagtcccgcagtcggcgtccagcggctctgcttgttcgtgtgtgtgtcgttgcaggccttattcaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5825 - RNA, 4512 nt, synthetic construct
  misc_feature 1..4512: note = Cpf1 variant mRNA product
  source 1..4512: mol_type = other RNA
gggagagtcccgcagtcggcgtccagcggctctgcttgttcgtgtgtgtgtcgttgcaggccttattcaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5826 - RNA, 4813 nt, synthetic construct
  misc_feature 1..4813: note = Cas9 variant mRNA product
  source 1..4813: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5827 - RNA, 5596 nt, synthetic construct
  misc_feature 1..5596: note = Cas9 variant mRNA product
  source 1..5596: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5828 - RNA, 3868 nt, synthetic construct
  misc_feature 1..3868: note = Cas9 variant mRNA product
  source 1..3868: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5829 - RNA, 4936 nt, synthetic construct
  misc_feature 1..4936: note = Cas9 variant mRNA product
  source 1..4936: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5830 - RNA, 4012 nt, synthetic construct
  misc_feature 1..4012: note = Cas9 variant mRNA product
  source 1..4012: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5831 - RNA, 4873 nt, synthetic construct
  misc_feature 1..4873: note = Cas9 variant mRNA product
  source 1..4873: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5832 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5833 - RNA, 4711 nt, synthetic construct
  misc_feature 1..4711: note = Cas9 variant mRNA product
  source 1..4711: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5834 - RNA, 4744 nt, synthetic construct
  misc_feature 1..4744: note = Cas9 variant mRNA product
  source 1..4744: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5835 - RNA, 3877 nt, synthetic construct
  misc_feature 1..3877: note = Cas9 variant mRNA product
  source 1..3877: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5836 - RNA, 3955 nt, synthetic construct
  misc_feature 1..3955: note = Cas9 variant mRNA product
  source 1..3955: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5837 - RNA, 3961 nt, synthetic construct
  misc_feature 1..3961: note = Cas9 variant mRNA product
  source 1..3961: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5838 - RNA, 3661 nt, synthetic construct
  misc_feature 1..3661: note = Cas9 variant mRNA product
  source 1..3661: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5839 - RNA, 4072 nt, synthetic construct
  misc_feature 1..4072: note = Cas9 variant mRNA product
  source 1..4072: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5840 - RNA, 4630 nt, synthetic construct
  misc_feature 1..4630: note = Cpf1 variant mRNA product
  source 1..4630: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5841 - RNA, 4609 nt, synthetic construct
  misc_feature 1..4609: note = Cpf1 variant mRNA product
  source 1..4609: mol_type = other RNA
gggagagggcgcttggcttgcaaggaccctgagctgcggcattgaagcacacccaacccaactcgactgaagtcagcctcactgaaccggatctgagaatcttctctctctgggcttgccagggctctccgaacctagctagcatcctcttcaattccaactagaaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtgaagggaacacccaaatttaattcagccttaagcacaattaattaagagtgaaacgtaattgtacaagcagttggtcacccaccatagggcatgatcaacaccgcaacctttcctttttcccccagtgattctgaaaaacccctcttcccttcagcttgcttagatgttccaaatttagtaagcttaaggcggcctacagaagaaaaagaaaaaaaaggccacaaaagttccctctcactttcagtaaataaaataaaagcagcaacagaaataaagaaataaatgaaattcaaaatgaaataaatattgtgttgtgcagcattaaaaaatcaataaaaattaaaaatgagcaagatctaaaaaaaaaaaaaaaaaaaaaaaaaaaaaaaaaaaaaaaaaaaaaaaaaaaaaaaaaaaaaaaagaatt

SEQ ID NO: 5842 - RNA, 4497 nt, synthetic construct
  misc_feature 1..4497: note = Cas9 variant mRNA product
  source 1..4497: mol_type = other RNA
gggagagcggctcggccattttgtcccagtcagtccggaggctgcggctgcagaagtaccgcctgcggagtaactgcaaagaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5843 - RNA, 5280 nt, synthetic construct
  misc_feature 1..5280: note = Cas9 variant mRNA product
  source 1..5280: mol_type = other RNA
gggagagcggctcggccattttgtcccagtcagtccggaggctgcggctgcagaagtaccgcctgcggagtaactgcaaagaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5844 - RNA, 3552 nt, synthetic construct
  misc_feature 1..3552: note = Cas9 variant mRNA product
  source 1..3552: mol_type = other RNA
gggagagcggctcggccattttgtcccagtcagtccggaggctgcggctgcagaagtaccgcctgcggagtaactgcaaagaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5845 - RNA, 4620 nt, synthetic construct
  misc_feature 1..4620: note = Cas9 variant mRNA product
  source 1..4620: mol_type = other RNA
gggagagcggctcggccattttgtcccagtcagtccggaggctgcggctgcagaagtaccgcctgcggagtaactgcaaagaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5846 - RNA, 3696 nt, synthetic construct
  misc_feature 1..3696: note = Cas9 variant mRNA product
  source 1..3696: mol_type = other RNA
gggagagcggctcggccattttgtcccagtcagtccggaggctgcggctgcagaagtaccgcctgcggagtaactgcaaagaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5847 - RNA, 4557 nt, synthetic construct
  misc_feature 1..4557: note = Cas9 variant mRNA product
  source 1..4557: mol_type = other RNA
gggagagcggctcggccattttgtcccagtcagtccggaggctgcggctgcagaagtaccgcctgcggagtaactgcaaagaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5848 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5849 - RNA, 4395 nt, synthetic construct
  misc_feature 1..4395: note = Cas9 variant mRNA product
  source 1..4395: mol_type = other RNA
gggagagcggctcggccattttgtcccagtcagtccggaggctgcggctgcagaagtaccgcctgcggagtaactgcaaagaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5850 - RNA, 4428 nt, synthetic construct
  misc_feature 1..4428: note = Cas9 variant mRNA product
  source 1..4428: mol_type = other RNA
gggagagcggctcggccattttgtcccagtcagtccggaggctgcggctgcagaagtaccgcctgcggagtaactgcaaagaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5851 - RNA, 3561 nt, synthetic construct
  misc_feature 1..3561: note = Cas9 variant mRNA product
  source 1..3561: mol_type = other RNA
gggagagcggctcggccattttgtcccagtcagtccggaggctgcggctgcagaagtaccgcctgcggagtaactgcaaagaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5852 - RNA, 3639 nt, synthetic construct
  misc_feature 1..3639: note = Cas9 variant mRNA product
  source 1..3639: mol_type = other RNA
gggagagcggctcggccattttgtcccagtcagtccggaggctgcggctgcagaagtaccgcctgcggagtaactgcaaagaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5853 - RNA, 3645 nt, synthetic construct
  misc_feature 1..3645: note = Cas9 variant mRNA product
  source 1..3645: mol_type = other RNA
gggagagcggctcggccattttgtcccagtcagtccggaggctgcggctgcagaagtaccgcctgcggagtaactgcaaagaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5854 - RNA, 3345 nt, synthetic construct
  misc_feature 1..3345: note = Cas9 variant mRNA product
  source 1..3345: mol_type = other RNA
gggagagcggctcggccattttgtcccagtcagtccggaggctgcggctgcagaagtaccgcctgcggagtaactgcaaagaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5855 - RNA, 3756 nt, synthetic construct
  misc_feature 1..3756: note = Cas9 variant mRNA product
  source 1..3756: mol_type = other RNA
gggagagcggctcggccattttgtcccagtcagtccggaggctgcggctgcagaagtaccgcctgcggagtaactgcaaagaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5856 - RNA, 4314 nt, synthetic construct
  misc_feature 1..4314: note = Cpf1 variant mRNA product
  source 1..4314: mol_type = other RNA
gggagagcggctcggccattttgtcccagtcagtccggaggctgcggctgcagaagtaccgcctgcggagtaactgcaaagaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5857 - RNA, 4293 nt, synthetic construct
  misc_feature 1..4293: note = Cpf1 variant mRNA product
  source 1..4293: mol_type = other RNA
gggagagcggctcggccattttgtcccagtcagtccggaggctgcggctgcagaagtaccgcctgcggagtaactgcaaagaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtaataaggaaactgtatgaatgtctgtgggcaggaagtgaagagatccttctgtaaaggtttttggaattatgtctgctgaataataaacttttttgaaataataaatctggtagaaaaatgagatctaaaaaaaaaaaaaaaaaaaaaaaaaaaaaaaaaaaaaaaaaaaaaaaaaaaaaaaaaaaaaaaagaatt

SEQ ID NO: 5858 - RNA, 4439 nt, synthetic construct
  misc_feature 1..4439: note = Cas9 variant mRNA product
  source 1..4439: mol_type = other RNA
gggagagtccgctcagccaggttgcagaagcggcttagcgtgtgtcctaatcttctctctgcgtgtaggtaggcctgtgccgcaaacaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5859 - RNA, 5222 nt, synthetic construct
  misc_feature 1..5222: note = Cas9 variant mRNA product
  source 1..5222: mol_type = other RNA
gggagagtccgctcagccaggttgcagaagcggcttagcgtgtgtcctaatcttctctctgcgtgtaggtaggcctgtgccgcaaacaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5860 - RNA, 3494 nt, synthetic construct
  misc_feature 1..3494: note = Cas9 variant mRNA product
  source 1..3494: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5861 - RNA, 4562 nt, synthetic construct
  misc_feature 1..4562: note = Cas9 variant mRNA product
  source 1..4562: mol_type = other RNA
gggagagtccgctcagccaggttgcagaagcggcttagcgtgtgtcctaatcttctctctgcgtgtaggtaggcctgtgccgcaaacaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5862 - RNA, 3638 nt, synthetic construct
  misc_feature 1..3638: note = Cas9 variant mRNA product
  source 1..3638: mol_type = other RNA
gggagagtccgctcagccaggttgcagaagcggcttagcgtgtgtcctaatcttctctctgcgtgtaggtaggcctgtgccgcaaacaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5863 - RNA, 4499 nt, synthetic construct
  misc_feature 1..4499: note = Cas9 variant mRNA product
  source 1..4499: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5864 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5865 - RNA, 4337 nt, synthetic construct
  misc_feature 1..4337: note = Cas9 variant mRNA product
  source 1..4337: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5866 - RNA, 4370 nt, synthetic construct
  misc_feature 1..4370: note = Cas9 variant mRNA product
  source 1..4370: mol_type = other RNA
gggagagtccgctcagccaggttgcagaagcggcttagcgtgtgtcctaatcttctctctgcgtgtaggtaggcctgtgccgcaaacaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5867 - RNA, 3503 nt, synthetic construct
  misc_feature 1..3503: note = Cas9 variant mRNA product
  source 1..3503: mol_type = other RNA
gggagagtccgctcagccaggttgcagaagcggcttagcgtgtgtcctaatcttctctctgcgtgtaggtaggcctgtgccgcaaacaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5868 - RNA, 3581 nt, synthetic construct
  misc_feature 1..3581: note = Cas9 variant mRNA product
  source 1..3581: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5869 - RNA, 3587 nt, synthetic construct
  misc_feature 1..3587: note = Cas9 variant mRNA product
  source 1..3587: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5870 - RNA, 3287 nt, synthetic construct
  misc_feature 1..3287: note = Cas9 variant mRNA product
  source 1..3287: mol_type = other RNA
gggagagtccgctcagccaggttgcagaagcggcttagcgtgtgtcctaatcttctctctgcgtgtaggtaggcctgtgccgcaaacaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5871 - RNA, 3698 nt, synthetic construct
  misc_feature 1..3698: note = Cas9 variant mRNA product
  source 1..3698: mol_type = other RNA
gggagagtccgctcagccaggttgcagaagcggcttagcgtgtgtcctaatcttctctctgcgtgtaggtaggcctgtgccgcaaacaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5872 - RNA, 4256 nt, synthetic construct
  misc_feature 1..4256: note = Cpf1 variant mRNA product
  source 1..4256: mol_type = other RNA
gggagagtccgctcagccaggttgcagaagcggcttagcgtgtgtcctaatcttctctctgcgtgtaggtaggcctgtgccgcaaacaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5873 - RNA, 4235 nt, synthetic construct
  misc_feature 1..4235: note = Cpf1 variant mRNA product
  source 1..4235: mol_type = other RNA
gggagagtccgctcagccaggttgcagaagcggcttagcgtgtgtcctaatcttctctctgcgtgtaggtaggcctgtgccgcaaacaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5874 - RNA, 4420 nt, synthetic construct
  misc_feature 1..4420: note = Cas9 variant mRNA product
  source 1..4420: mol_type = other RNA
gggagagtcccgcagtcggcgtccagcggctctgcttgttcgtgtgtgtgtcgttgcaggccttattcaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5875 - RNA, 5203 nt, synthetic construct
  misc_feature 1..5203: note = Cas9 variant mRNA product
  source 1..5203: mol_type = other RNA
gggagagtcccgcagtcggcgtccagcggctctgcttgttcgtgtgtgtgtcgttgcaggccttattcaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5876 - RNA, 3475 nt, synthetic construct
  misc_feature 1..3475: note = Cas9 variant mRNA product
  source 1..3475: mol_type = other RNA
gggagagtcccgcagtcggcgtccagcggctctgcttgttcgtgtgtgtgtcgttgcaggccttattcaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5877 - RNA, 4543 nt, synthetic construct
  misc_feature 1..4543: note = Cas9 variant mRNA product
  source 1..4543: mol_type = other RNA
gggagagtcccgcagtcggcgtccagcggctctgcttgttcgtgtgtgtgtcgttgcaggccttattcaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5878 - RNA, 3619 nt, synthetic construct
  misc_feature 1..3619: note = Cas9 variant mRNA product
  source 1..3619: mol_type = other RNA
gggagagtcccgcagtcggcgtccagcggctctgcttgttcgtgtgtgtgtcgttgcaggccttattcaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5879 - RNA, 4480 nt, synthetic construct
  misc_feature 1..4480: note = Cas9 variant mRNA product
  source 1..4480: mol_type = other RNA
gggagagtcccgcagtcggcgtccagcggctctgcttgttcgtgtgtgtgtcgttgcaggccttattcaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5880 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5881 - RNA, 4318 nt, synthetic construct
  misc_feature 1..4318: note = Cas9 variant mRNA product
  source 1..4318: mol_type = other RNA
gggagagtcccgcagtcggcgtccagcggctctgcttgttcgtgtgtgtgtcgttgcaggccttattcaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5882 - RNA, 4351 nt, synthetic construct
  misc_feature 1..4351: note = Cas9 variant mRNA product
  source 1..4351: mol_type = other RNA
gggagagtcccgcagtcggcgtccagcggctctgcttgttcgtgtgtgtgtcgttgcaggccttattcaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5883 - RNA, 3484 nt, synthetic construct
  misc_feature 1..3484: note = Cas9 variant mRNA product
  source 1..3484: mol_type = other RNA
gggagagtcccgcagtcggcgtccagcggctctgcttgttcgtgtgtgtgtcgttgcaggccttattcaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5884 - RNA, 3562 nt, synthetic construct
  misc_feature 1..3562: note = Cas9 variant mRNA product
  source 1..3562: mol_type = other RNA
gggagagtcccgcagtcggcgtccagcggctctgcttgttcgtgtgtgtgtcgttgcaggccttattcaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5885 - RNA, 3568 nt, synthetic construct
  misc_feature 1..3568: note = Cas9 variant mRNA product
  source 1..3568: mol_type = other RNA
gggagagtcccgcagtcggcgtccagcggctctgcttgttcgtgtgtgtgtcgttgcaggccttattcaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5886 - RNA, 3268 nt, synthetic construct
  misc_feature 1..3268: note = Cas9 variant mRNA product
  source 1..3268: mol_type = other RNA
gggagagtcccgcagtcggcgtccagcggctctgcttgttcgtgtgtgtgtcgttgcaggccttattcaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5887 - RNA, 3679 nt, synthetic construct
  misc_feature 1..3679: note = Cas9 variant mRNA product
  source 1..3679: mol_type = other RNA
gggagagtcccgcagtcggcgtccagcggctctgcttgttcgtgtgtgtgtcgttgcaggccttattcaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5888 - RNA, 4237 nt, synthetic construct
  misc_feature 1..4237: note = Cpf1 variant mRNA product
  source 1..4237: mol_type = other RNA
gggagagtcccgcagtcggcgtccagcggctctgcttgttcgtgtgtgtgtcgttgcaggccttattcaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5889 - RNA, 4216 nt, synthetic construct
  misc_feature 1..4216: note = Cpf1 variant mRNA product
  source 1..4216: mol_type = other RNA
gggagagtcccgcagtcggcgtccagcggctctgcttgttcgtgtgtgtgtcgttgcaggccttattcaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtccctgttcccagagcccacttttttttctttttttgaaataaaatagcctgtctttcagatctaaaaaaaaaaaaaaaaaaaaaaaaaaaaaaaaaaaaaaaaaaaaaaaaaaaaaaaaaaaaaaaagaatt

SEQ ID NO: 5890 - RNA, 4530 nt, synthetic construct
  misc_feature 1..4530: note = Cas9 variant mRNA product
  source 1..4530: mol_type = other RNA
gggagaggcgctgcctacggaggtggcagccatctccttctcggcatcaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5891 - RNA, 5313 nt, synthetic construct
  misc_feature 1..5313: note = Cas9 variant mRNA product
  source 1..5313: mol_type = other RNA
gggagaggcgctgcctacggaggtggcagccatctccttctcggcatcaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5892 - RNA, 3585 nt, synthetic construct
  misc_feature 1..3585: note = Cas9 variant mRNA product
  source 1..3585: mol_type = other RNA
gggagaggcgctgcctacggaggtggcagccatctccttctcggcatcaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5893 - RNA, 4653 nt, synthetic construct
  misc_feature 1..4653: note = Cas9 variant mRNA product
  source 1..4653: mol_type = other RNA
gggagaggcgctgcctacggaggtggcagccatctccttctcggcatcaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5894 - RNA, 3729 nt, synthetic construct
  misc_feature 1..3729: note = Cas9 variant mRNA product
  source 1..3729: mol_type = other RNA
gggagaggcgctgcctacggaggtggcagccatctccttctcggcatcaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5895 - RNA, 4590 nt, synthetic construct
  misc_feature 1..4590: note = Cas9 variant mRNA product
  source 1..4590: mol_type = other RNA
gggagaggcgctgcctacggaggtggcagccatctccttctcggcatcaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5896 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5897 - RNA, 4428 nt, synthetic construct
  misc_feature 1..4428: note = Cas9 variant mRNA product
  source 1..4428: mol_type = other RNA
gggagaggcgctgcctacggaggtggcagccatctccttctcggcatcaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5898 - RNA, 4461 nt, synthetic construct
  misc_feature 1..4461: note = Cas9 variant mRNA product
  source 1..4461: mol_type = other RNA
gggagaggcgctgcctacggaggtggcagccatctccttctcggcatcaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5899 - RNA, 3594 nt, synthetic construct
  misc_feature 1..3594: note = Cas9 variant mRNA product
  source 1..3594: mol_type = other RNA
gggagaggcgctgcctacggaggtggcagccatctccttctcggcatcaagcttaccatggcccccaaaaagaaacgaaaagtagggatacacggcgtaccagcagcacaaacaactaatttaagttatatcttaggactagatctaggcatagcctcagtaggatgggccgttgttgaaatcaacgaaaacgaagacccaattggactcatagatgtaggagttagaatttttgaacgagctgaggtaccaaaaaccggagaatctctcgctctctcaaggcgattggcaagatctaccagacgacttataagaagaagggcacacagattactattagcaaaaagatttttaaaacgagaaggtatcctatccacaatcgatctagaaaaaggattaccaaaccaagcctgggaacttagagtcgcaggcctcgaaagacgtctatccgcaatagaatggggtgctgtacttctacatctaataaagcacagagggtatttatcaaaaaggaaaaatgaaagtcaaaccaataataaagaacttggtgctttactaagtggggtggcacagaatcaccaattattacaatcggatgattatagaactccagctgaactggcattaaagaaattcgcaaaagaagaaggacacataagaaatcaaagaggagcgtacacgcatacattcaacagactagacctattagctgaattaaatttactattcgcacaacagcaccaatttggaaacccacattgtaaagaacacatacaacaatatatgactgaacttctaatgtggcaaaaaccggcattatcaggagaagcaatattaaaaatgcttggaaaatgtacccatgaaaagaatgagttcaaagcagccaaacatacttatagtgcagaaagattcgtgtggttaacaaaattaaataacttaagaatcctcgaagatggagctgaacgagcactgaatgaagaagaaagacaactcttaataaatcatccatacgagaaaagcaaactcacttacgctcaagttagaaaactcttaggattatcggaacaagcaatatttaaacatctaaggtattcaaaagaaaatgcagaaagtgcaacatttatggaattaaaagcatggcatgcaataagaaaagccttagaaaatcaaggtctaaaagatacatggcaagatttggctaagaaaccagacttgctagacgaaataggaactgcattttcgttatacaaaacagacgaagatatacaacagtatctgacaaataaagtgcccaatagcgtgatcaacgcattattagtatccttgaatttcgataaatttatagaattgagcctaaaaagtttaagaaaaattctaccactaatggaacaaggaaaaagatacgaccaagcatgccgagaaatctacggacatcactatggcgaagcaaatcagaaaaccagtcaattactcccagcaattccagcacaagaaatacgaaaccccgtagtactaaggacactatctcaagcacgtaaagtaatcaatgcaataataaggcaatacggatctcctgccagggtacacatagaaacaggcagagaacttggcaaatcattcaaagaaagaagagaaatacaaaaacaacaagaagataatagaacaaaaagagaaagcgcagtacaaaaatttaaagagttattttctgacttctcctcagagcctaaatccaaagatattcttaaattccgtctgtatgagcaacaacatggaaaatgcttatacagcggaaaagaaataaacatacatcgactcaacgaaaaaggatacgtagaaatagatcacgccttaccatttagccgaacatgggatgattcattcaacaataaagttctagtattagcaagcgaaaatcaaaacaaaggaaaccaaacaccctatgaatggttgcaaggaaaaataaattcagaacggtggaaaaatttcgtcgctctagtactaggcagccagtgtagcgcagcaaagaaacaaagattattaacgcaagttatagacgacaataaatttattgacagaaacctaaacgatacgcgttacatagcaagatttttaagcaattacatccaagaaaacttactcttagtcgggaaaaacaagaaaaatgtatttacgccaaacggacaaataacagctctacttaggagcagatggggattaataaaagcaagagagaataataatagacatcacgcattagacgcaatagtagtagcttgtgctactccaagtatgcaacagaaaatcacgcgtttcattagattcaaagaagtacatccatataaaatcgaaaatagatacgaaatggtcgaccaagaatcaggagaaataatctcaccgcactttccagaaccctgggcatattttcgacaagaggtaaacataagagtcttcgacaaccatccagataccgtcttaaaagaaatgctacccgacagacctcaagccaaccatcaatttgtacaaccattattcgtttcaagagcacccacaagaaaaatgtcaggacaaggacatatggaaactataaaaagcgcaaaacggctagcagaaggaatctctgttctacgaatacccttaacacaattaaaaccgaatctcttagaaaacatggtcaacaaagagagagaacccgcactatacgcaggcttaaaagcgcgattggcagaatttaatcaggacccagcaaaggcttttgcgacaccattttataaacagggaggacaacaagttaaagcaattcgagttgaacaagtccaaaaatcgggagtcttagtaagagagaataatggtgttgcagataatgcatcaattgttagaaccgacgtgtttataaagaataacaaattcttcctcgtcccaatctatacatggcaagtagcaaaagggatattaccaaacaaggcaatcgtagctcacaaaaatgaagacgaatgggaagaaatggatgagggagcaaaatttaagttttcattatttccaaatgatttagtagaactcaaaacgaagaaagaatactttttcggttattatataggactcgatagggctaccggaaacatatctttaaaagaacacgacggagaaatatcaaaaggaaaagatggagtctatcgtgttggagtcaaactcgcacttagttttgaaaaataccaagttgacgaacttggaaagaatagacagatttgcagaccacaacaaagacaaccggtaagaaaacgacctgcggcaacaaagaaggcaggacaagcaaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5900 - RNA, 3672 nt, synthetic construct
  misc_feature 1..3672: note = Cas9 variant mRNA product
  source 1..3672: mol_type = other RNA
gggagaggcgctgcctacggaggtggcagccatctccttctcggcatcaagcttaccatggcacctaaaaagaaaagaaaagtaggtatacatggagtaccagcagcagccgctttcaaaccaaacccaatcaattacattctaggtcttgatataggaatagctagtgttgggtgggcaatggtagaaatagatgaagacgaaaatccaatatgcttaattgatttgggagtaagagtattcgaacgagcagaggtaccaaaaaccggagatagcctagcaatggctaggcgattggcccgaagtgtaagaagattaacacgacgacgagcgcatcgactacttagagccagacggttactaaaaagagaaggagtactacaagcagctgattttgatgaaaacggactgataaaaagtttgccaaacactccatggcaattaagagcagccgctctagacagaaaactaacaccattagaatggagtgcagtcttgttacatctaataaaacatagaggatatttatcccaaagaaagaatgaaggtgaaacagcggataaagaattgggagcgttacttaaaggagtcgcagataacgcacacgcattacaaacaggtgattttagaactcctgctgaactcgcgcttaataaattcgagaaagaatccggacatatacgaaatcaacgaggtgactattcacacacatttagcagaaaagatttacaagctgaattaatactattatttgaaaaacaaaaagagttcggtaacccacatgtttcaggaggacttaaggaaggaatagaaaccttattaatgacacaacgtccagcattatcaggagatgcagtacaaaagatgttaggtcattgtacattcgaacctgcagaacccaaagcagcaaagaatacatataccgcagaacgatttatatggttaacgaagctaaacaatttaagaatactggaacaaggaagcgaacgccctttaacagacacagaaagagctacattaatggatgaaccatacagaaagtcaaaacttacctatgcgcaagcaagaaaattactagggctagaagacactgctttcttcaaaggattaagatacggaaaagataatgcagaagcatctacattaatggaaatgaaagcataccacgctatatcaagagcattagaaaaggaaggtttgaaagataagaaatctccgctaaatttatctccagaattacaagatgaaataggtacagcattttctttattcaaaactgatgaagatatcacaggcaggttaaaggatcgaatacaaccagaaattctcgaagctcttttaaagcatattagctttgataaatttgtacagatatcactaaaagcactaagaagaatagtgccacttatggagcaaggtaaaagatatgatgaagcatgtgcagaaatttacggcgaccactatgggaagaaaaatactgaagagaaaatatacttaccaccaataccagcagacgaaataagaaatccagtcgtactcagagcattaagccaagctagaaaagttataaatggagtagtgagaagatatggatcaccagccagaatccatatagaaaccgcaagagaagttggaaaaagttttaaagacagaaaagaaatagaaaaacgacaagaggaaaacagaaaagacagggaaaaagctgcagccaaattccgtgaatatttccctaattttgtaggagaaccaaaaagcaaagacattttaaaattaagattatacgaacaacaacatggtaaatgtctatatagcggtaaagaaattaacttaggcagactcaatgaaaaaggttacgtagaaatagaccatgctttaccattcagcagaacttgggatgatagctttaataacaaagtattagtattaggatcagaaaatcaaaacaagggaaaccaaacaccctacgaatacttcaatggaaaagacaactcaagagagtggcaagaatttaaggcacgtgtcgaaacatcgagatttcccagaagtaagaaacagaggattttattgcaaaaattcgacgaagatggtttcaaagaaaggaatctaaatgacacaaggtatgttaatagattcctttgtcaatttgtagcagatcgtatgagacttaccggtaaaggtaagaaaagagtttttgcttcaaacgggcaaataaccaatttgttaagaggattttgggggcttagaaaagtgagagctgagaacgatcgacatcacgcattagacgcagtagtcgtagcatgtagtacagtagcgatgcaacagaaaatcacccgatttgtaagatataaagaaatgaatgcatttgacggcaaaactattgataaagagacaggagaagtattacatcagaaaacacactttccacaaccctgggaatttttcgcacaagaagtaatgataagagtatttggaaaaccagatggaaaacctgagttcgaagaagctgacacacccgagaaacttcgaacccttttagcagaaaaattgagtagtagaccagaagctgttcacgaatatgtaacacccttattcgtaagcagagcaccaaaccggaaaatgtcaggacaagggcacatggaaacagtcaaaagtgctaaacgactggatgaaggggttagcgtattgcgagttcctctaactcaactaaaacttaaagacttagaaaagatggttaatcgagaaagggagccaaaattgtatgaagcactaaaagcaagactagaagcgcataaggacgatcctgctaaagcctttgctgaaccgttctataaatatgacaaagcaggcaatcgcacccaacaagtaaaagccgtgagggtagaacaagtacagaaaacgggtgtttgggtaagaaatcacaacggtatagcagataatgctactatggttcgtgtagatgtatttgagaaaggagataagtattacttggtaccaatatattcttggcaagttgcaaaagggatacttccagacagagcagtagtacaaggcaaggatgaagaagattggcaacttattgatgacagttttaatttcaaattttcattacatccaaacgatttagtagaggttataacaaagaaagcacgaatgttcggttattttgctagttgccatagaggaactggaaatattaatatacgtatacacgacctagatcataaaataggtaaaaatggaatcttagaaggtataggcgttaaaaccgctctatcattccaaaaataccaaatagacgagttaggtaaagaaataagaccatgtagattgaagaaacgccctccagttagaaaaagacccgctgccactaagaaagcaggacaagccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5901 - RNA, 3678 nt, synthetic construct
  misc_feature 1..3678: note = Cas9 variant mRNA product
  source 1..3678: mol_type = other RNA
gggagaggcgctgcctacggaggtggcagccatctccttctcggcatcaagcttaccatggcacccaaaaagaaaagaaaagtaggaatacacggtgtaccagccgctaaataccatgttggaatagatgttgggacattttccgtaggactagcagcaatcgaagtagatgatgcaggaatgcctattaaaaccttaagtctagtaagtcacattcatgattcagggctagacccggatgaaataaaaagcgctgttacgcgactggcgagtagtggaatagcccgtcgaactaggcgattatatagaagaaaaagacgtaggttacaacaattagacaaatttatacaaagacaaggatggccggttatagaactagaagattattctgacccactatatccttggaaagtgagagcagaattagctgctagttacatcgcagatgaaaaagaacgaggggaaaaactatctgttgctttaaggcatatagcaagacatagaggatggcgtaacccatacgcgaaagtaagcagcctttatttaccagatggacctagtgacgcatttaaagcaataagagaagaaattaaaagagcgagtggacaaccggtcccagaaactgcaacagtaggacaaatggtaacgctatgcgaattaggaacactaaaattgagaggcgaaggtggggtgctatcagccagattacaacagtctgattatgccagagaaatacaagaaatatgtcgaatgcaagaaataggacaagaactctatagaaaaataattgatgtagttttcgcagctgaaagtcctaaaggttccgcatcgagtagggtgggaaaagatccattacaaccaggcaaaaatcgcgcattaaaagcatcagatgcattccagcgatacagaatagcggctttaataggaaacctccgagtgagagtagacggagagaaaagaatcctaagcgtagaagagaaaaacctagtattcgaccacttagtcaatctaacacccaagaaagaaccggaatgggtaactattgcagagatactggggatagatagaggccaattaatcggtacagcaactatgacagatgatggggaaagggctggtgcaagaccgccaacgcacgatacaaatcgaagtatagtaaattcaagaatagcaccactggtagattggtggaaaacagcaagcgcattagaacaacatgcgatggtaaaagcattaagtaatgctgaagtagacgacttcgacagtccagaaggagccaaagtacaagcctttttcgccgatttagacgatgatgtacatgccaaattagatagtctccacctacctgtaggacgagcagcatacagtgaagacactctagtacgtttgacacgtaggatgctatcagatggagtggacttgtacacagcaaggttacaagagtttggaatcgaacctagttggacaccaccgacacccagaataggagaacccgtaggtaaccccgcagttgatagagtattaaaaacagttagcagatggttagagagtgcaaccaaaacctggggagctcctgagagggtcattatagaacatgttagagaaggattcgttacagagaaaagagcaagagaaatggatggagatatgagaagacgagccgcccgtaatgcaaaactattccaagaaatgcaagaaaaactcaacgttcaaggtaaacctagtagagcagatttatggagatatcaaagcgtacaaagacaaaactgtcaatgcgcttactgcggctcaccaataacattctccaacagtgaaatggaccacattgtaccccgtgccggtcaaggttcaactaatactagagaaaatctagtagcagtttgtcatcgatgcaatcaatctaaaggcaatacaccgtttgcaatatgggccaaaaatacatcaattgaaggtgtatcggtaaaagaagcagtcgaaaggacaagacactgggtaacagatactggtatgagatccaccgacttcaagaaattcactaaagcagtagtggaaaggtttcaaagagcaacaatggatgaagaaatcgacgcccgttcaatggaaagtgtcgcatggatggctaacgaattaagaagtcgagtagcacaacactttgcatcacatgggacgactgtaagagtatatagaggatcgctaacagcagaggccaggcgagcaagcggtataagcggaaaattaaaattcttcgatggcgtcgggaaaagtaggctggacagaagacaccatgcaatcgatgcagcggtgattgcatttacatccgactacgtcgccgagacattggcggtcagaagtaatcttaaacaatcccaggcacaccgacaagaggcaccacaatggagagaatttacaggaaaagatgcagaacatcgagccgcttggagagtttggtgtcagaaaatggaaaaactaagtgcacttctaacagaggatttgagagatgatagagtagtagttatgagcaatgtaagactcagattaggaaacggatcagctcataaagaaacaataggaaaattaagtaaagtcaaattaagctcacaactatcagtatctgatattgacaaagcatcaagcgaggctttatggtgtgcgttaacaagagaacctgggtttgatccaaaagaaggtttaccagccaatccagaacgtcacatccgagtaaatggcacacacgtttatgcaggggataatataggcctatttcctgtatcagcaggaagtatagctcttagaggaggatatgcagaattaggatcaagttttcaccatgccagagtatataaaatcacatccggaaagaaaccagcattcgcaatgcttagagtctatacaatcgacctactaccgtacagaaaccaagacctattttccgtggaattgaaaccacaaacaatgagtatgagacaagccgaaaagaaattaagagacgcactcgcaactggaaacgcagaatatctcggctggctagtagttgacgatgaattagtagtcgacacaagtaaaatagcaacagaccaagtaaaagctgttgaagcagaattaggaacgataagacgatggagagtagatggattcttttccccaagtaaactaagattaaggccattacaaatgagtaaagaaggtattaagaaagaaagtgcaccagaactatctaaaattatagatcgtccaggctggctaccagctgtgaataaactattttcggatggtaatgttacagttgttagaagggactcattaggcagggttcgcctggaatctacagcacacttgccagtaacttggaaagttcagaaaagaccagcagctacgaagaaagcaggacaagctaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5902 - RNA, 3378 nt, synthetic construct
  misc_feature 1..3378: note = Cas9 variant mRNA product
  source 1..3378: mol_type = other RNA
gggagaggcgctgcctacggaggtggcagccatctccttctcggcatcaagcttaccatggccccaaaaaaaaaaagaaaagtaggcatacatggcgtgccagcagccgcaagaatacttgcgtttgatataggaatcagctcaataggttgggctttctcagaaaatgatgaactcaaagattgtggcgtcagaatatttacaaaagtagaaaacccaaaaactggagaatcattggccttaccacgtagactcgcaagaagcgcaagaaaacgactcgcacgaagaaaagctagattaaaccacctaaaacaccttatagcgaatgaattcaaactcaattacgaagactaccaatcattcgacgaaagcctagcaaaagcatataaaggatcgctcataagtccgtacgaactaaggttcagagcacttaatgagctactaagtaaacaagacttcgctcgtgtcatattacacattgcaaaacggaggggatatgacgatataaaaaatagcgacgataaagaaaaaggagcaattttaaaagcaataaaacaaaacgaagagaaactggcaaattaccaatctgtaggagaatatttatacaaagaatatttccaaaaattcaaagaaaactcaaaagaatttactaacgttcgaaataaaaaagaaagttatgaaagatgcattgcacagagcttcctaaaagacgagctgaaactaatatttaaaaaacaacgagaattcggcttctcgttttcaaaaaaattcgaagaagaagtcctatctgtcgctttctacaaacgagccctaaaagactttagccatttagttggaaactgctcatttttcacagatgaaaaacgagctccaaaaaattcacccttagcattcatgttcgtcgcgctaactcgcattataaacttactaaacaatcttaaaaataccgaaggcatactatatacaaaagatgatttgaacgcattactaaacgaagtgttaaaaaatggaaccctgacctacaaacaaacaaagaaactactcggtctttcagacgattacgaattcaaaggcgaaaaaggtacatacttcatagaattcaaaaaatacaaagaatttataaaagccttaggagaacataatctatctcaggatgacttaaacgaaatcgccaaagatataacactaataaaagacgaaatcaaactaaaaaaagctttggcaaaatacgacctcaatcaaaatcaaattgatagtctatcaaaactagaatttaaagaccacctaaatatatcatttaaagcactaaaattggtaacaccactaatgctcgaaggcaaaaaatacgatgaagcgtgcaacgaattgaacctaaaagtagctatcaatgaggacaaaaaagacttcctaccagcttttaacgaaacatactacaaagacgaagtaacaaacccagtagtactaagagcaataaaagaatacagaaaggtactgaacgcactcctaaagaaatatgggaaagtccacaaaataaacatagaactagcaagggaagtaggcaaaaaccactcacaaagagcaaaaattgaaaaagagcaaaacgaaaattataaagccaaaaaagacgcagaattagaatgtgaaaaacttggattaaagattaactcaaaaaacatattaaaactacgcctatttaaagaacaaaaagaattctgtgcatacagtggggagaaaatcaaaatatcagacttacaagatgaaaaaatgttggaaatcgaccatatttatccatacagcagaagtttcgacgattcatatatgaataaagtgttagtattcacaaaacaaaaccaagaaaaattaaaccaaactccattcgaagcatttggtaacgactccgcaaaatggcagaaaatagaagtactagcaaaaaatctaccgacaaaaaaacaaaaaagaatattagacaagaactacaaagacaaagaacaaaagaatttcaaagatcgaaaccttaatgatacaaggtatatcgcaagacttgtactaaactacacaaaagattacttagatttcttgcctttgtcagacgacgaaaacaccaaattaaacgacactcaaaaaggttcgaaagtacatgtagaagcaaaatcaggaatgctaaccagcgcactgcgacacacctggggctttagcgcaaaagatagaaacaatcacttacaccacgcaatagacgcagtcattattgcatacgctaacaactctattgtaaaagctttctccgactttaagaaagaacaagaaagcaattcagctgaactttatgccaaaaaaatctcggaactggactacaaaaataaaaggaaatttttcgagccattcagtgggtttagacagaaagttctagacaaaattgatgaaatctttgtatcaaaaccagaaagaaaaaaaccttctggagccctacacgaagaaacatttagaaaagaagaagaattctaccaatcatatggcggtaaggaaggcgtattgaaagccttagaattaggaaaaatccgaaaagtaaacggaaaaatagtaaaaaacggcgacatgttccgggttgatatattcaaacacaaaaagacaaacaagttttacgcagtcccaatatacactatggacttcgccctaaaagtactacctaacaaagctgtagcaagatcaaaaaaaggcgaaataaaagattggatattaatggacgaaaactatgaattctgcttctccctatataaagatagccttatcttaatacagacaaaagatatgcaagaaccagagtttgtctattacaatgcttttactagttcaactgtaagcctaatagtaagcaaacacgacaataaatttgaaacactatcaaaaaaccaaaaaatcttatttaagaacgctaacgaaaaagaagtcatagcaaaatcaataggaatacaaaacttaaaggttttcgaaaaatatattgtatcagcactaggagaagtaacaaaagcagaattcagacaacgagaagactttaaaaaaaaacgaccagcagcaacaaaaaaagctggacaagccaagaaaaaaaagtaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5903 - RNA, 3789 nt, synthetic construct
  misc_feature 1..3789: note = Cas9 variant mRNA product
  source 1..3789: mol_type = other RNA
gggagaggcgctgcctacggaggtggcagccatctccttctcggcatcaagcttaccatggcacccaaaaagaaacgaaaagtagggatccatggagtgccagcagcatcagacctagttttaggtctagacataggaattggatcagtaggagtcggaatactgaacaaagtaactggtgaaataatacacaaaaattcaagaatatttccagcagcacaagcagaaaataacctagtgagacgaacaaatagacaaggaagaagactggcacgtaggaagaaacatagaagagtaagattaaacagactattcgaagaatcaggactaattacagatttcactaaaataagtatcaacctaaacccataccaacttagggttaaaggattaacggacgaattatcaaacgaagaactattcattgcactcaaaaacatggttaaacataggggaatatcctacctcgacgacgcttctgatgatggtaatagctcggtcggagactatgcacaaatagtaaaagaaaatagcaaacaactagaaaccaaaactccgggacaaatccaacttgaaagataccaaacatatggacaactaagaggagacttcacagtagaaaaagacggcaagaaacatcgcttgataaacgtattccccacatcagcatatagaagtgaagcactaagaatattacaaacacaacaagaatttaacccacaaataacagatgaatttataaacaggtacttagaaatcctaacaggaaaaagaaaatactatcacggcccgggaaacgaaaaatcaagaacggattatggaagataccggacaagcggggaaaccttagataatatattcggaatactaatcggaaaatgcactttttaccctgatgaatttagagcggcaaaagcatcatacacagcacaagaatttaatttactcaatgacctaaataacttaacagtaccaacagaaaccaagaaactatcaaaagaacagaaaaaccaaataataaactacgtcaaaaatgaaaaagctatgggccctgcaaaattattcaaatatatagcaaaactactaagctgcgatgttgcggacattaaagggtatagaatagacaaaagtggaaaagcagaaattcacacctttgaagcatacagaaaaatgaaaacattagaaacgctcgatatagaacaaatggaccgcgaaacgctagataaactagcttatgtactcactcttaacacagaacgcgaaggaatacaagaagccctagaacacgagttcgcagacggttcattttcacaaaaacaagtagatgagctagtacaatttcgaaaagccaactcgtcaatatttggaaaaggatggcacaacttcagtgtaaaattaatgatggaactcatacccgaactttacgaaacatcagaggaacaaatgacaatattaacaagattaggaaaacagaaaacaacatcaagttctaacaaaactaaatacatagacgaaaaactattaactgaagaaatatacaatccagtcgtcgcaaaaagcgtacgacaagcgatcaaaatagtgaatgctgcaatcaaagaatatggcgattttgacaatatcgttatagagatggcacgcgaaacaaacgaagatgatgagaagaaagctatacagaaaatacaaaaagcaaataaagatgaaaaagatgcagctatgttaaaagctgccaaccaatataacggaaaagccgaattaccacattcagtattccatgggcacaaacaattggccacaaaaatcagactatggcatcaacaaggcgagcgatgcctatacacaggaaaaactatctccatacacgacctgatcaataatagtaaccaattcgaggtagaccacatactaccactatcgataacattcgatgatagcttggcgaataaagtccttgtgtatgctacggcaaaccaagaaaaaggccagagaactccttaccaagccctagacagcatggacgatgcatggtcattcagggaattaaaagcatttgttagagaatctaagactctaagtaacaaaaagaaagaataccttcttacggaagaagacataagtaaatttgatgtgcggaagaaattcatcgaaagaaacttagtagacactagatatgcgtcacgcgtggtactaaacgctctacaagaacacttcagagcacacaaaattgacactaaagtcagtgttgtgagaggacaatttacaagccaactaaggagacattggggtatagagaaaacaagggatacttatcatcatcacgctgttgatgcactgatcatcgccgcaagcagtcaactaaatttatggaagaaacagaaaaacacattggtaagctatagcgaagaccaattactagacatagaaactggagaactaatatctgatgacgagtacaaagaaagtgtttttaaagcaccttaccaacactttgtagatacattaaaaagtaaagagttcgaagattcaatactcttctcttatcaagtagacagcaaattcaacaggaaaatatcagacgccacaatatacgcgactaggcaagcaaaagtaggaaaagataaagcagacgaaacgtacgtcttagggaaaatcaaagatatttatacacaagacggttacgatgccttcatgaaaatatataagaaagataaaagtaaatttctgatgtatcggcatgatcctcaaacatttgaaaaagtcattgaacctatactggaaaattacccaaataaacaaataaacgaaaaaggtaaagaagtaccatgtaatcccttcttgaaatataaagaagaacacggatacataagaaaatactctaagaaaggaaatggaccggaaataaaaagcctgaaatattatgacagcaaattaggaaatcacatagatataacgcccaaagactcgaataacaaagtcgtattacaaagtgttagcccatggagagcagatgtttatttcaacaaaactactggtaaatatgaaattctagggttaaaatatgccgatcttcaatttgaaaaagggacgggtacatataaaataagccaagaaaaatataatgatattaaaaagaaagaaggagttgactccgattcagagttcaaatttactctctataaaaacgacttactcctagtcaaagatacggaaacaaaagaacaacaactattcagattcctttcaagaacaatgccaaaacaaaaacactacgtggaacttaaaccgtatgacaaacaaaaattcgaaggaggagaagcattaataaaagtattaggtaacgtagccaatagcgggcaatgtaagaaagggttgggaaaatccaacatcagcatatataaagttagaacagatgtactaggcaatcaacatataatcaaaaacgaaggcgacaaaccaaaactagatttcaaaagacccgcagcaactaaaaaggcaggacaggccaagaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5904 - RNA, 4347 nt, synthetic construct
  misc_feature 1..4347: note = Cpf1 variant mRNA product
  source 1..4347: mol_type = other RNA
gggagaggcgctgcctacggaggtggcagccatctccttctcggcatcaagcttaccatggcacctaaaaagaaacgaaaagtaggcatccatggagtcccagcagcaacccagttcgaaggattcactaacttatatcaagtatccaaaaccctaagatttgaattaatcccacaaggtaaaacactaaaacatatccaagaacaaggttttatcgaagaagacaaagcccgaaacgatcactacaaagaactaaaaccaattatagatagaatatacaaaacctatgccgatcaatgccttcaacttgtccaattagactgggaaaatttatcagctgcgatagactcatacagaaaagagaaaacagaagaaacaagaaacgcacttatcgaagaacaggcaacataccgaaacgctatacacgactattttataggtagaacagacaatcttacggatgctataaacaaaagacacgcagaaatttacaaaggactctttaaagcagaattatttaatgggaaagtactaaaacaactaggaactgtaacaaccactgaacacgagaatgcactgctgcgctctttcgacaaatttacgacttacttctccgggttctacgaaaacaggaaaaatgtcttcagcgctgaagacatatctactgcaatcccacatagaatcgtccaagacaactttccaaaatttaaagaaaactgccatatatttacccgccttattaccgcagttccctccctacgtgaacatttcgaaaatgtcaagaaagcgataggtatcttcgtctcaacaagtatagaagaagttttcagcttcccattttataatcaattactaactcaaacacaaatagacttatacaatcaacttctcggtggcattagccgagaagcgggaacagagaaaataaaaggtctaaatgaagtgttaaaccttgcaattcagaaaaacgatgaaactgcacacattatagcaagtctaccgcaccgttttataccactattcaaacaaattcttagtgaccggaataccctgtcattcattctagaagagttcaaatctgatgaagaagtcatccaaagtttctgcaaatacaaaacactactaagaaacgaaaacgtgttagaaacagcagaagcactcttcaacgaactcaattccatagacctcacacatatatttatctcccataaaaagttagaaacaatatctagtgctctgtgcgaccactgggacacactaagaaacgcattatacgaaagaagaattagcgaattaaccggaaaaataactaaaagtgccaaagagaaagtccaacgatcactgaaacacgaagacatcaacctacaagaaatcatctctgcagccggaaaagaactatctgaagcgttcaagcagaaaacttccgagatattatctcacgcccatgcagcattagaccaacccctcccaacaactctaaagaaacaagaggaaaaagaaatattaaaatcacaactggattccttattaggcttataccatcttttagactggttcgcagttgatgaaagtaacgaagtcgatcccgagttcagcgcccgactaacgggaataaaactggaaatggaaccaagcctttcattctacaataaagctcgaaactacgccacgaagaaaccctattccgtcgaaaaattcaaacttaactttcaaatgccaacgctagcatcaggttgggatgtcaacaaagagaaaaacaacggagccatactattcgtcaaaaacggcctatattatctagggattatgccaaaacaaaaaggaagatacaaagccttatcatttgaacctactgagaaaacatctgaaggattcgataaaatgtactacgattattttccagatgctgctaaaatgatcccaaaatgctcaacacaactaaaagcagtaacagcacactttcaaactcatacaaccccgatcctactaagtaacaattttattgaacccctagaaatcacgaaagaaatctacgatctaaacaatccagaaaaagaacctaagaaattccaaaccgcctatgcgaagaaaacaggagatcaaaaaggatacagagaagcactatgtaaatggattgatttcacaagagacttcctcagcaaatatacaaaaacaacaagcatagacttaagttctttacgcccatcttcccaatacaaagatttaggcgaatattatgcagaacttaacccactcctatatcatatatcttttcaacgcatcgctgaaaaagaaataatggacgcagtcgaaacaggaaaactatatctattccaaatctacaataaagactttgcgaaaggccatcacggaaaaccaaatctccacacactttattggacaggattattcagcccagaaaacctagcaaaaacctcaataaaattaaacggccaagcagaactgttttatcgcccaaaatctagaatgaaacgaatggctcaccgccttggggagaaaatgctaaataagaaattaaaagaccagaaaaccccaataccagatactctttaccaagaactctacgattacgtcaatcaccgactatctcacgatctatccgacgaagccagagccctgttaccgaatgtaatcaccaaagaagtctcacacgaaataattaaagaccgacgcttcacatccgataaatttttctttcacgttccaataacactaaattatcaagctgccaactccccaagcaaattcaatcaacgcgtaaacgcatacttaaaggaacacccagaaacaccaatcatcggtatagaccgcggcgaacgaaacttaatatatataacagttatagattcaactggcaaaatattagaacaacgatcacttaacacaatccaacaattcgactaccaaaagaaactcgacaatagagaaaaagaaagggtggctgctagacaagcatggtctgtagtcggaacaataaaagacctaaaacaaggatacctatctcaagttatacacgaaatagtagatttaatgattcattaccaagcggtagttgtactagaaaatttaaactttggatttaaaagcaaacgaaccggcatcgctgaaaaagcagtataccaacaatttgaaaagatgctaatagataaattaaattgccttgtgcttaaagattacccagccgaaaaagtagggggagttttgaatccataccaattaactgaccaattcacctcctttgctaaaatggggacccaatccggcttcctcttttacgtacccgcgccatacaccagcaaaattgaccctcttacgggcttcgtcgatccatttgtttggaaaacaataaagaaccacgaatctagaaaacacttcttagaaggatttgacttcctacattacgacgtaaaaacaggagatttcatactacacttcaaaatgaacagaaatctttcattccaacgaggccttcctggattcatgcccgcttgggacatagtcttcgagaaaaatgaaacgcaatttgatgcaaaaggaacgccctttatcgcaggtaaacgaattgtaccggtaatagaaaatcataggtttacgggacgttatagagacctatatccagctaatgaacttatagctttattagaagaaaagggaatcgtatttcgtgacggttcaaacatactacccaagttactagaaaacgacgattcacacgcaattgatacaatggtagctttaataagaagcgtcctgcaaatgagaaattctaatgcagcaacaggagaagattacatcaactcaccagtacgagatctaaatggcgtgtgctttgattcacgcttccaaaacccagaatggccaatggatgccgacgcaaatggcgcttaccacatcgcactaaaaggccaactactactgaatcacctaaaagaatccaaagacctcaaacttcaaaacgggataagcaaccaagattggctcgcttatatacaagaactacgtaataagcgaccggcagcaacaaagaaagccggccaagccaaaaagaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5905 - RNA, 4326 nt, synthetic construct
  misc_feature 1..4326: note = Cpf1 variant mRNA product
  source 1..4326: mol_type = other RNA
gggagaggcgctgcctacggaggtggcagccatctccttctcggcatcaagcttaccatggcaccaaaaaaaaaacgcaaagtaggcatacatggagtgcccgccgcatcgatttaccaagaatttgtaaataaatactcactttcaaaaacgttacgcttcgaattaatcccacaaggtaaaacactagaaaacataaaagcacgtggactcatactagatgacgaaaaaagagcaaaggactataaaaaagcaaaacaaataatcgacaaatatcaccaattcttcatagaagaaatcttatcaagtgtttgtataagtgaagacttactacaaaactatagtgatgtatatttcaaactaaaaaaaagcgatgacgacaatctccaaaaagatttcaaaagcgcaaaagacactataaagaaacaaatatcagaatatataaaagactcagagaaattcaagaacctattcaaccaaaacttaatagatgcaaaaaaaggacaagagtccgatctaatactatggctgaaacaatctaaagataacggaatagaattattcaaggccaactccgatataaccgatatcgacgaagcattagagataattaaatccttcaaaggatggactacttatttcaaaggatttcatgaaaatagaaaaaacgtatactcctctaacgatattcccacttccattatctatagaatagtagatgacaacctcccaaaatttttagaaaacaaagcaaaatacgaatccctaaaagacaaagctccggaagcaattaactatgaacaaatcaagaaagatttggccgaagaactaaccttcgacatagattataaaacatcagaagtaaatcaaagagtattttctttagacgaagtattcgagattgcaaacttcaataattacttaaatcaatcaggcattacaaaattcaacacaatcataggaggcaaattcgtcaacggagaaaacaccaaaagaaaagggattaatgaatatatcaacttatattcacaacaaataaatgataaaaccctaaaaaaatataaaatgagtgtgctatttaaacaaatattgtccgacaccgaaagcaaatcattcgtgatagacaaattagaagacgatagtgatgtagtaactaccatgcaatcattctatgaacaaatagcagcatttaaaacagtcgaagaaaaaagtatcaaagaaacactttcactattattcgacgacttaaaagcacaaaaattagacctcagtaaaatctattttaaaaatgacaaatcattaactgatttatcccaacaagtattcgacgactacagcgtcattggcaccgccgttctagaatacataacacaacagatcgcacctaagaaccttgataatccttctaaaaaagaacaagaactcatagcaaaaaaaacagaaaaagcaaaatacctcagtcttgaaacaataaaactcgcactagaagaattcaataagcaccgagatatagataaacaatgtcgattcgaagaaattctggccaactttgcagctatcccaatgatctttgacgaaatagcacaaaataaggacaacttagcacaaatttcaataaaatatcagaaccaaggaaagaaagatttgctccaggcgagcgctgaggacgacgtcaaagccataaaagatcttcttgatcaaacaaacaatttactacacaaactaaagattttccacataagtcagtcagaagacaaagcaaacatattagataaggatgaacatttctacttagtattcgaagaatgctattttgagctcgcaaatatagtaccactgtacaataaaatccggaattacatcactcaaaaaccttattcagacgaaaagtttaaactaaatttcgagaattccacattagcaaatggatgggacaagaacaaagaacccgacaataccgctattttattcattaaagatgacaaatattacctcggcgtgatgaataaaaaaaacaataagatattcgacgacaaagctataaaagaaaacaaaggagaaggatacaaaaaaattgtatataaactcctcccaggagcaaacaaaatgttgccaaaagtcttcttctcagcaaagtccataaagttctacaatcccagcgaagacatccttaggattagaaatcactccacacacactaaaaacggatcaccccaaaaaggctacgaaaaattcgagttcaacattgaggactgcaggaaattcatcgatttttacaaacaaagtatctcaaaacatccagaatggaaagactttggctttagattttcagatacacaaagatacaactccatagatgagttttatagggaagtagaaaaccagggatacaagttaacattcgaaaacataagtgagtcatacatagacagcgttgtgaaccaaggaaagctctatctattccaaatatataacaaagactttagcgcatactccaaaggaagaccaaacctacacacattatattggaaagcactatttgacgaaaggaacttacaagacgttgtttataaactaaatggtgaagcagaactattctatagaaaacaatcaatacccaagaaaatcacccacccagccaaagaggcaatcgcaaataagaataaagataacccaaaaaaagaatcggtcttcgaatacgacctcataaaagacaagcgatttaccgaagataaattcttcttccactgcccaatcacaatcaatttcaaaagctcaggggcaaacaaatttaatgacgaaataaacctactattaaaagaaaaggcaaatgatgtacatatactctcaatagacaggggcgaaagacatctagcatactacacactcgtagatggaaaaggaaatatcataaaacaagatacattcaacataatcgggaacgaccggatgaagacgaattaccacgataaactagcagctatagagaaagacagagattccgcaagaaaagactggaaaaaaatcaacaacatcaaagagatgaaagaaggctatctgagccaagtagttcacgagattgcaaaacttgtaattgaatacaatgcaatagtggtatttgaggacctcaacttcggattcaaaaggggtcgattcaaagtagaaaaacaggtttaccaaaaactagaaaaaatgttaatagaaaaactaaactatctagtatttaaagacaacgaattcgataagaccggcggagtactaagagcatatcaattgaccgcaccatttgaaacattcaaaaaaatgggtaaacaaactggaattatatattacgtcccagcaggcttcacctcaaaaatatgtccagtaacgggatttgtaaaccaattatatcccaaatatgaatcagtttctaaaagtcaagagtttttcagcaaattcgataaaatatgctacaacctcgacaagggatactttgaattctcattcgactataaaaattttggagacaaagcagccaaaggtaagtggacgatagcaagtttcggctcaaggctaataaacttcagaaattctgacaaaaatcacaattgggacactagggaagtataccccacgaaagaactagaaaaattactaaaagattactctatagaatatgggcacggggaatgtataaaagcagcaatatgcggcgaatcagacaagaaattcttcgcaaaattaacttcagtcttaaacactattctgcaaatgcgaaatagtaaaactggaactgagttagactatttaatatcacccgtagccgacgtaaatggaaactttttcgactcaagacaagcaccgaaaaatatgccacaagatgccgacgctaacggagcctatcacataggccttaaaggtttgatgttattaggcagaataaaaaacaaccaagaaggaaaaaaactaaatctcgtaatcaagaacgaagaatactttgaattcgtacaaaaccgcaataataaacgacccgcagcaacaaaaaaagctgggcaagcaaaaaaaaagaaataaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaagaatt

SEQ ID NO: 5906 - RNA, 4582 nt, synthetic construct
  misc_feature 1..4582: note = Cas9 variant mRNA product
  source 1..4582: mol_type = other RNA
ggggcgctgcctacggaggtggcagccatctccttctcggcatcaagcttaccatggcacctaaaaaaaaaaggaaagtaggaattcatggagtacctgctgccgacaaaaagtacagtatagggcttgacatcggtacaaattctgttggatgggctgtcataactgatgaatacaaagtaccaagcaagaaattcaaagtgttaggaaacaccgacagacacagcataaaaaaaaaccttataggagcccttttatttgacagtggcgaaacagctgaagccacaaggctaaaaagaacagctaggagacgttatactagaagaaaaaacagaatatgctatctacaggaaatattctccaacgaaatggcaaaagtagatgacagtttcttccatcgtttggaagaatcatttctagtcgaagaggacaaaaaacacgaacgacatccgatatttggaaatatcgttgatgaggtagcgtatcacgagaaatatccaaccatatatcatttgagaaaaaaactagtagactccacagataaagcggatctacggttaatataccttgcactggcccacatgataaagttccgcgggcactttctaatcgaaggagacttaaaccccgataatagtgacgtcgataaactatttatacaattagtacaaacttataaccagctctttgaagaaaaccccatcaacgctagcggcgttgatgcaaaagcaatactgtcagcacgtctgtcaaaaagccgcaggctagagaacctcatcgcacaactaccaggagaaaaaaaaaatggactattcgggaacttaatcgcactatcacttggcctaacacccaatttcaaaagcaatttcgacctcgccgaagacgctaaactacaactatccaaagacacttacgacgacgatcttgacaacctcttggcacaaatcggggaccaatacgcagatctgtttttggcagcaaaaaatctatcggacgctatactactatctgatatcttacgagtgaataccgagataactaaagccccccttagcgcgtcaatgataaaaagatatgatgaacaccaccaggatcttacactattaaaagctctagtacgtcaacagctaccagaaaaatacaaagaaatattttttgatcaatcgaaaaatggatacgccggatacatcgacggaggagcttctcaagaagaattctataaattcataaaacctatccttgaaaagatggacgggactgaagaattattagtaaaactaaacagagaagacttactaagaaaacaaagaacattcgacaacggcagtattcctcatcagatacatctgggtgaattacacgcaattctacgaagacaggaggacttttatccattcctaaaagacaacagagaaaagatcgaaaaaatactaacattccgtatcccatattacgttggtccactagcaagaggaaattctagattcgcttggatgaccagaaaaagcgaagaaacgattacaccttggaattttgaagaagtagtagacaaaggggcttcagcacaaagctttatcgaaagaatgacaaattttgacaaaaatttgccaaacgaaaaagtactaccaaaacatagcctattatatgaatactttactgtatacaacgaactcactaaggtaaaatacgtaacggaagggatgagaaaacccgcattcttaagtggagagcaaaaaaaagcaattgtcgacctattatttaaaacaaatcgaaaagtcacagtaaaacaactcaaagaagattactttaaaaaaattgaatgcttcgactcagtcgaaataagcggagtcgaagataggttcaatgctagcctgggcacatatcacgatttacttaaaataataaaagataaagatttcttagataacgaagaaaatgaagacattttagaggatattgtattaactttaacattattcgaagatagagagatgattgaagaaagactaaaaacatatgcccacctattcgacgataaagtaatgaaacaactgaagagaaggagatatacaggatggggaagactctcaaggaagttaataaatggtattagggataaacaaagtggaaaaacgatactcgattttctaaaaagtgatggatttgcaaatcgcaacttcatgcaattaattcatgacgattcactaacattcaaagaagacatacaaaaggcacaagtatccggacaaggagattcactacacgagcacattgccaacttagcaggatcaccagcaattaaaaaaggcatactacaaacggtgaaagtagttgacgaattagtcaaagtcatgggtaggcataaaccagaaaacatagtaatcgaaatggcaagagaaaatcaaacgacacaaaagggacaaaaaaactcgagagaaagaatgaaaaggatagaagaaggaataaaagaactaggatcacaaatacttaaagaacaccctgtagaaaacactcagcttcaaaacgaaaaattatacttgtattacctccaaaacggtcgagatatgtacgtcgatcaggagttagatatcaatagattaagcgactatgacgtcgatcatatagtaccacaaagctttctaaaagatgatagcatagataataaagtattaacaagaagcgataaaaatcgtggaaaatcagataatgtgccatctgaagaagtagtaaagaagatgaaaaattactggaggcaactactaaacgcaaaattaataactcagagaaaattcgataacctaactaaagccgaaagaggaggactaagtgaactagacaaagccggattcataaagagacaattagtagaaacgagacaaattacaaagcatgttgctcaaatcttagatagtaggatgaacacaaaatatgacgaaaatgacaaattgattagagaagtcaaagtaattacactaaaatccaagttagtatccgacttcagaaaagattttcagttttacaaggttagagaaatcaacaactatcatcacgcccacgacgcatatctgaacgcagtcgtaggaacagcgctaataaaaaaatacccaaaactagaatcagaatttgtatacggcgattataaagtgtatgatgttcgcaaaatgatcgctaaatcagagcaagaaataggtaaagctacagcgaaatactttttctacagtaatattatgaattttttcaaaaccgagatcacactagcgaatggagagatcagaaaaagaccactgattgaaacaaacggagaaacaggagaaatagtttgggataaaggcagagactttgcaaccgtaagaaaagtactaagtatgccacaagtaaatatcgtaaaaaaaacagaagtacaaacaggtgggttttctaaagaaagcatactaccaaaacgtaattcagataaactaatagctcgaaaaaaagattgggatcccaaaaaatacggaggatttgactctccaacggtcgcctattctgtcttagtagtagcgaaagtagaaaaaggaaaaagtaaaaaattaaaatccgtaaaagaattgctcggtataacaatcatggagagatctagcttcgaaaaaaatcccatagatttcctagaggcaaaggggtacaaagaagtaaaaaaagatctcataattaaattacctaaatactctttatttgaattagaaaacggtagaaaaagaatgttagcatcagcaggagaattgcaaaaaggtaatgaactggcactaccctctaaatatgtaaatttcttatatttagcaagccactatgaaaaactaaaaggttctccagaagataacgaacaaaaacaactgttcgtcgaacagcacaaacactatttagacgaaataattgaacaaatatcggagttctctaaaagagtaatactggcagatgcaaatttagacaaggtactatcagcctacaataaacacagagataaaccaatacgtgaacaagcggaaaacatcatacatctctttaccctcacaaatctaggagcacctgcagcatttaaatactttgatacaacaattgatagaaaaaggtatacgagcaccaaagaagtgctagacgcgacactaatccaccaatcaataaccggcctatatgaaaccagaatagatctaagtcaattaggaggggacaaaagaccagcagctacaaaaaaagcaggccaagcaaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5907 - RNA, 5365 nt, synthetic construct
  misc_feature 1..5365: note = Cas9 variant mRNA product
  source 1..5365: mol_type = other RNA
ggggcgctgcctacggaggtggcagccatctccttctcggcatcaagcttaccatggcccctaaaaaaaaaagaaaagtgggtatccatggagtacccgccgcaaacttcaaaatattaccaatcgcaatagatcttggcgtaaaaaacacaggggtattctcagcgttttatcagaagggaaccagtctagaaagattagacaataaaaatggtaaggtatacgaactttcaaaagattcttacaccttactcatgaataaccgaacagcaagacggcaccaaagaagaggaattgaccgaaaacagttagtaaaacgacttttcaaactgatatggacagaacaactaaatctcgaatgggataaagatacccagcaggctatatcattcttattcaatcgccgcggattttcatttattacagacggttactcgcccgaatatctaaatatagtacccgaacaagtaaaagcgatattgatggatatatttgacgattataacggcgaagatgaccttgattcatacctaaaactcgcaacagaacaagaaagtaagataagtgaaatatataacaaactgatgcaaaaaatattagaatttaaactaatgaaactatgcacagatattaaggatgacaaagtatcaactaaaactttaaaagaaattactagctacgaattcgaactacttgcagattacctagcgaactactcagaatccttaaagactcaaaaattttcctacaccgacaaacaaggtaatctaaaagaactgtcatactaccatcacgataaatacaacatacaggagttccttaagcggcacgctaccattaacgatcgaattcttgacacactactaactgacgatctagacatctggaattttaactttgagaaatttgactttgacaaaaatgaagaaaaattacaaaatcaagaagataaggatcacatccaagcccatttgcaccatttcgtattcgctgttaacaaaataaagtccgaaatggcatcaggcgggcgccatcgatcccaatacttccaagagataacaaatgttcttgatgagaacaaccatcaagaaggctaccttaaaaacttctgtgaaaatcttcataataagaaatattcaaacttatcagtcaaaaatcttgtcaatctaataggaaacttatcaaacttggaactcaaaccactccgtaagtatttcaacgataaaatacatgcaaaggctgatcattgggacgaacaaaaattcacagagacctactgtcactggatattaggcgaatggagggtaggagttaaagatcaagacaaaaaagatggagcaaaatactcatataaggacctttgtaacgaactaaaacaaaaagtaactaaagcgggactcgtagacttcctactagaacttgatccctgcagaactataccgccttacttagacaacaataaccgaaaaccaccaaagtgccagtcactaatactcaaccccaaatttctagacaatcagtaccccaattggcaacaatacctacaagaattgaaaaaacttcaatccattcaaaactatctagacagttttgaaactgatctaaaagtcctaaaatcctccaaggaccaaccatacttcgtagaatataaatcaagcaaccaacaaatagccagtggtcagcgagactataaagatttagatgcacgcatcctacaatttatattcgatagggttaaagctagcgacgaattattactgaatgaaatatacttccaagcgaaaaaacttaaacaaaaagcgtcatctgaactagagaaacttgaatcatcaaaaaagctagacgaagtaatagcaaacagtcaactttcacaaatactcaaatcacaacataccaatggaatcttcgaacaaggaacatttctacaccttgtgtgtaaatactataaacaaaggcaacgcgcacgagattcacgattatacataatgccggaatatagatacgataaaaaattacacaaatacaacaatactggaagattcgacgacgataaccaactcctaacatactgtaaccacaaaccaagacaaaaaagataccaattacttaatgacctagcaggcgtcttacaagtatcacctaacttcctaaaagataaaattggatcagacgacgacctcttcataagcaaatggctagtcgaacacataagaggattcaaaaaagcatgcgaagattccctcaaaatccaaaaagataatagaggtcttctcaaccataaaataaatatagccagaaacacaaaaggaaaatgtgaaaaagaaatatttaatttaatttgcaaaattgaagggtctgaagataaaaaaggcaactacaaacatggcctagcctatgaactcggcgtattactattcggtgaacctaacgaagcatcaaaacctgaattcgatcgtaagataaagaaattcaattcaatatactcttttgcccaaatccaacaaatagcattcgccgaaagaaaaggaaatgcaaatacctgcgcagtatgcagtgctgacaacgcacaccgtatgcagcaaataaagataacagaacccgtggaagacaataaagataaaataatactcagtgcgaaagcccaaagactaccagccatacccacccgtattgtagatggagcagtaaaaaaaatggcaaccatcctagctaaaaacattgtcgacgataactggcaaaacatcaaacaagtattatccgcaaaacatcaattacatatacccatcataaccgaatcaaacgcatttgagttcgaacccgcccttgcagacgtgaaaggaaaatccctcaaagacagacgaaaaaaagccctagaaagaatatcaccggaaaatatctttaaggacaaaaacaaccgtatcaaagagtttgcgaaaggaatatcagcatactcgggagcaaacctcaccgatggagatttcgacggcgcaaaagaagaattggaccatataattccaagatcccataaaaagtacgggacccttaatgatgaggcgaatttaatatgcgtaacacggggtgacaacaaaaacaaaggaaatagaatcttttgtttaagagatctcgcggacaattacaaactaaaacaattcgaaacaacagatgacctagaaatagaaaaaaaaatcgctgatacaatatgggacgctaataaaaaagactttaaatttggaaattataggtcatttatcaacttaacgccacaggaacaaaaggcattcagacatgcgttgtttttagcagatgagaaccctataaaacaagcagtaattagagccataaataacagaaaccgaacattcgtcaacggcactcaacgatactttgccgaagttttagccaacaacatatacctgcgagcaaaaaaagaaaatttaaatacagataagatatcattcgactatttcgggatcccaaccattggtaatggaagaggaatagccgagatcagacaattatacgaaaaagtcgatagtgacatacaagcatatgcaaaaggcgacaaaccacaagcatcatattctcacttgatcgacgctatgctagcattttgtattgccgcagacgaacatcgaaacgatggctcaatcggactagagatcgataaaaattactccctatatccactagacaaaaacacaggagaagtctttacaaaggatatatttagccaaattaaaattacggacaatgaattcagtgacaaaaagcttgttagaaaaaaagcaatcgaaggatttaacacacaccgacaaatgacaagagatggaatatacgcagaaaactatctgcctatacttattcacaaagaactgaatgaagtaagaaagggttacacatggaaaaattcagaagaaataaaaatatttaaaggaaaaaaatatgacatccaacaacttaacaatttagtctattgcttaaaatttgtagataaacctatatctatcgatattcaaataagcacacttgaagaattaagaaatatacttacaacgaacaatatagcggcaacagcagagtattactatataaacctaaagacacaaaaattacatgaatactacatcgaaaactacaacaccgctctcggatataaaaaatacagtaaagaaatggaattccttaggagtttagcctacaggtctgaaagagtaaaaataaaaagcatagacgacgttaaacaagtactcgataaagactcaaattttatcatcggcaaaataacacttccctttaaaaaggagtggcagagactctaccgagaatggcaaaacaccaccataaaagacgactacgaatttctcaaatcgtttttcaatgtgaaatcaataacaaaactacacaaaaaagtgcggaaagacttctcactaccaatatcaacaaacgagggtaaattcctagtcaaaagaaaaacttgggacaacaattttatttaccaaattcttaacgattcagacagtagagcggatggaacgaaaccattcattccagcattcgacatatcaaaaaatgagatagttgaagcaataatagattcatttacttctaaaaatatattttggctcccaaaaaatatcgaactacaaaaagtagacaacaaaaacatatttgcaatagatacatccaaatggtttgaggttgagacacccagtgacctacgtgatatcggaatagctaccatccaatataaaatagataacaacagccgtccaaaagtacgtgtaaagttagactatgttatcgacgacgacagcaaaataaactacttcatgaatcatagcttactaaaaagtagatatcccgacaaggttttagaaatacttaagcaatcaaccattatagaattcgaaagttcgggtttcaacaaaaccataaaagaaatgcttggaatgaaactcgctggaatatataacgaaacaagtaacaataaaagaccagcagcaaccaaaaaagcaggacaagcaaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5908 - RNA, 3637 nt, synthetic construct
  misc_feature 1..3637: note = Cas9 variant mRNA product
  source 1..3637: mol_type = other RNA
ggggcgctgcctacggaggtggcagccatctccttctcggcatcaagcttaccatggcaccaaaaaaaaaacggaaagtaggaatccacggcgtccctgccgcaaaaagaaattacatactcggactagacataggcataacatcagtaggatacggtataatagactacgaaacgcgagatgtaatagacgccggagtgagactatttaaggaagcaaatgtagagaacaacgaaggacgaagaagtaaaagaggtgcacgcagactcaaacgacgtcgaagacaccgaatacaacgagtaaaaaaactcttattcgattacaatctgctcacagatcactctgaattatcaggaataaacccatatgaagcaagggtaaaaggcctaagtcaaaaactctcagaagaagaattttccgccgctctcctacacttagccaaacgaagaggtgtacacaacgtaaatgaggtagaagaagacacaggaaacgaactatctacaaaagaacaaatatcacgtaacagcaaagcattagaagaaaaatacgtagcggaactacaactagaacgacttaaaaaagacggcgaagtaagagggtccataaacagatttaaaacaagtgattacgtaaaagaagcgaaacaactcctgaaagtacaaaaagcatatcaccaactcgatcaaagcttcatcgatacatatatagatttattagaaacccgacgaacttactatgaaggaccgggagaggggtcaccatttggctggaaagatatcaaagaatggtacgaaatgctaatgggtcactgtacatacttcccggaagaacttcgatccgtaaaatatgcatacaacgcagacctttataacgcattaaacgacctcaataatttggtaataacacgagacgaaaatgagaagcttgaatactatgaaaaatttcaaataatagaaaacgtattcaaacaaaaaaaaaaaccaacactaaaacaaatagccaaagaaatattagtcaacgaagaagacataaaagggtatagagtaacatcgacaggtaaaccagaatttaccaacctaaaggtttaccacgatataaaagatataacagccagaaaggaaataatagaaaatgcagagctactcgaccaaatagcaaaaatactaacaatatatcagagcagcgaagacatacaggaagaattaacaaaccttaactccgaattaacacaagaagagatagaacaaatatcaaacttaaaaggatatacaggaactcacaacctaagcttaaaagcaataaacctcatattagacgagctttggcacacaaatgataatcaaatcgcaatattcaacagactaaagctagttccaaaaaaagtagacctctcacaacaaaaagaaatcccgacaaccttagtagacgactttatcctatcaccagtagttaaaagaagctttattcaatcaattaaggtcattaatgctatcataaaaaagtatggactaccaaatgacatcataatcgaactagcaagagaaaagaacagcaaggacgcccaaaagatgataaacgaaatgcaaaagcgcaatagacaaaccaacgaaagaattgaagaaataataagaacaacaggtaaagaaaacgctaaatatctcatagaaaaaataaaactacacgacatgcaagaaggtaaatgtttatatagtttggaggcgataccattggaagacctactaaacaacccatttaattacgaagtagaccatatcataccaagatctgtaagtttcgataattcgtttaacaacaaagttctagttaaacaagaagagaattcaaaaaagggaaatcgtacaccttttcagtatctctcatcatccgacagtaaaatatcatatgaaaccttcaaaaagcacatacttaacctagcaaaaggaaaaggaagaatatcaaaaacaaaaaaggaatatttgctagaagagcgagacatcaatagattttcagtacaaaaagactttattaatagaaacttagtagatactagatacgccacaaggggactaatgaatttactaagatcgtatttcagagtaaacaacctagatgtaaaagtgaaatcaataaacggcggattcacttctttcctaagaagaaaatggaaatttaaaaaagaaaggaacaaaggatacaaacaccatgcggaagacgccctaattatagcaaacgctgattttatattcaaagaatggaaaaaattagataaagcaaagaaagtcatggaaaaccaaatgttcgaagaaaaacaggctgaatcaatgcccgaaatagagaccgagcaagaatataaagaaatattcattaccccacatcagattaaacatataaaagatttcaaagactacaaatactcacatagggttgacaaaaaacccaatcgagaactaatcaacgacacactgtacagcactcgaaaagacgataaaggcaacactctaatcgtaaacaatttaaacggattatatgacaaagacaatgacaaacttaaaaaattaataaataaatcacctgaaaaacttctaatgtaccaccacgatccacagacctaccaaaaattaaaactcatcatggaacaatacggtgatgagaaaaatccattatataaatattacgaagaaaccgggaattacctcaccaaatatagtaaaaaagataacggacctgtaatcaaaaaaataaaatactatggaaataaactgaacgcccacttagacataactgatgactaccccaatagcagaaataaagtagtaaaactttcacttaaaccataccgattcgacgtctatctcgataatggcgtatataaattcgtaacagtgaaaaaccttgacgtaataaaaaaagaaaattactacgaagtaaacagtaaatgctatgaagaagccaaaaagctaaaaaaaatatctaaccaggcagaattcattgctagcttctacaataacgacctcataaaaattaacggagaactatatagagtaatcggagtcaataacgacctactaaatagaatagaagtcaatatgattgacattacatatagagaatacttagaaaatatgaatgataaaagaccaccacggataataaaaaccatagcttcaaaaacacaatccataaaaaaatactctacagacattttaggaaatttatatgaggtaaaaagcaaaaaacaccctcaaatcataaaaaaaggaaaaagaccagctgcaacaaaaaaagctggtcaagccaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5909 - RNA, 4705 nt, synthetic construct
  misc_feature 1..4705: note = Cas9 variant mRNA product
  source 1..4705: mol_type = other RNA
ggggcgctgcctacggaggtggcagccatctccttctcggcatcaagcttaccatggcgcccaagaagaaacgcaaagtaggaatccatggagtaccagccgcattatttaacaaatgcatcataatttccattaacctagatttctcaaacaaagagaaatgtatgaccaaaccctacagtattggactagatatcggcactaacagcgtaggatgggctgtgataacagacaattacaaagtaccatcgaaaaaaatgaaggttttaggaaatacctcaaaaaagtacatcaaaaagaatttacttggcgtcttattattcgactcaggaataaccgctgaaggaagacggctcaaaagaacggcaagacgaagatacacacgccgcagaaaccgaatattgtaccttcaagagattttctcaactgaaatggcgacattggacgacgcgttctttcaaaggttagacgattcatttctagttccagatgacaaacgagactcaaaatatcctatctttggaaatctggtcgaagaaaaagtttatcacgatgagtttcctacaatataccacttaagaaaatatttagcagacagtacaaaaaaagcagacctaagactagtttacctcgcattagcacacatgataaaataccgaggccactttctgatagaaggagaattcaatagtaagaataacgatattcaaaaaaatttccaagattttctagacacctataatgctatcttcgaaagcgatctcagccttgaaaattcaaagcagttagaagaaatagtaaaggataaaatatcaaagttagaaaagaaagatcgaattttaaaactattcccaggagaaaaaaattctggaatattcagcgaatttttaaaattaattgtaggaaatcaagccgactttagaaaatgtttcaatcttgacgagaaagcaagcctacacttctcaaaagagtcatatgatgaagatctcgaaacactgctaggatacataggcgacgattattcagatgtttttcttaaggcaaaaaaactatatgatgcaatacttctatccggtttcctcacagtgacagacaatgaaaccgaggcgccactttcatccgctatgataaaaaggtataatgaacataaagaagacttagcacttttaaaagaatatatacggaatatatcacttaaaacctacaacgaagtttttaaagatgatacaaaaaacggctacgcaggctacatcgacggcaaaaccaatcaagaagacttttacgtatacttaaagaacctgctggcagaatttgaaggagctgactactttctagaaaaaatcgacagagaggatttcctacgaaaacaaagaacgttcgataacggttcaataccgtatcaaatacacctacaagagatgcgagctatcttagataaacaagccaaattttatccttttttggccaaaaacaaagaaagaatagaaaaaatcttgacatttagaatcccttactatgttggacctcttgcaagaggcaacagcgatttcgcatggagtattcgtaagcgaaacgaaaaaattactccttggaactttgaagatgtcatagataaggagtccagtgctgaagcgtttattaatcgaatgactagctttgacctatacctaccagaagaaaaagtactaccaaaacattccctactttacgaaacatttaacgtatacaatgaactgacaaaagtaagattcattgccgaaagtatgagagattaccaattcctcgacagtaaacaaaaaaaagacatagtacgattatactttaaagacaagagaaaagtaacggacaaagatataatagaatatctacacgcaatatacggatacgatggtatagaacttaaaggaattgaaaaacagtttaactcaagcctatccacgtatcacgacctcctaaacataataaatgacaaagaatttctagacgactcatcgaatgaagcaataattgaagaaatcatccatactctaacgatcttcgaagacagggaaatgattaaacaacgtttatctaaatttgagaacatattcgataaaagcgtactaaaaaagctaagccgccgccattacacgggctggggtaagctaagcgccaaattaataaacgggataagagacgaaaaaagtggcaacactatactcgattacctcatcgatgatggaatttcgaacaggaacttcatgcaattaatacacgatgatgctctttcattcaaaaagaaaatacaaaaagcccaaatcataggagatgaagacaaaggcaacattaaagaagttgtcaaatccttaccaggatcaccggccataaaaaaaggaatattacaatcgatcaaaatagttgatgaacttgttaaagtaatgggtggacgcaaaccagaaagcatagtcgtagaaatggcacgcgaaaaccaatacaccaatcaaggaaaatctaattcacaacaacgcttaaaaagactagagaaatcattaaaggaactcggttctaaaatcttaaaggagaatataccagcaaaactatcaaaaatagacaacaatgcgttacagaacgatcggttatacctctactatctacaaaatgggaaagacatgtacaccggtgatgatctagacatagatagactaagcaattacgacatagatcacataataccacaagcattccttaaggacaactccatagataacaaagtcttagtaagttcagcatcaaacagaggcaaaagtgatgacttcccatcactcgaagtagtgaaaaaaagaaaaacattctggtaccaactcctaaaatctaaattgatttcacaaagaaaatttgacaatctcacgaaagcagagcgtggaggattactccccgaggacaaagcaggatttatacaaagacaactcgtggaaactaggcaaataacaaaacatgtagctagactattggacgaaaaatttaacaataaaaaagatgaaaacaatagggcagtccgtactgttaagattataacactaaaatccacactcgtatctcaatttagaaaagattttgagctatataaagtccgcgaaataaacgatttccaccacgcacatgacgcatacctcaacgcggtcatagcgtcagcactgttaaagaaatatcctaaactcgaaccagaattcgtgtacggtgactatccgaaatataacagctttcgcgaaagaaaatcagcaacagaaaaagtatacttctactccaacataatgaacatctttaaaaaatccataagtctcgcggacggtagagtaatcgaaagaccactcatagaagtaaatgaagagacaggagaatcagtttggaacaaagaatcggacctagcaacagtaaggcgagtactctcctacccccaagtgaatgtggtcaaaaaagtagaagaacaaaatcacggcctagacagaggaaaaccaaaaggactatttaacgcaaacctttcaagtaaaccaaaaccgaactccaatgagaacttagtgggcgccaaagagtatctagacccgaagaaatatggcggctatgccggaatcagtaacagtttcgcagtactagtaaaaggcactatcgaaaaaggagccaaaaagaaaatcaccaacgtacttgaattccaagggattagcatactagatagaatcaattatcgaaaagacaagttaaattttctccttgaaaaaggatacaaagacatagaacttataatagaactacccaaatactcactcttcgaattaagtgatgggtcccgcagaatgttagccagtattctaagcacaaacaataaaagaggggagatacataaaggtaatcaaatttttttatcgcaaaaatttgtaaaattactataccacgcaaaaagaatctcaaacacaataaatgagaatcaccgaaaatacgtagaaaaccataaaaaagaattcgaggaactattctactatatcttagaattcaacgaaaattatgtaggagcaaaaaaaaacggaaaattactaaattccgcatttcaatcctggcagaatcatagtatagacgaactatgttcatcgttcattggacctaccggtagtgaacgaaaaggattattcgaactcacttccagagggtcagcagcagatttcgaattcttaggggtcaaaataccacgataccgagactacacacctagctcactactcaaagatgctaccctcatacatcaatcagtaaccggactctatgaaacaagaatagacctagcaaaattaggtgaaggtaaaaggccagctgcaacaaaaaaagctggacaagcgaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5910 - RNA, 3781 nt, synthetic construct
  misc_feature 1..3781: note = Cas9 variant mRNA product
  source 1..3781: mol_type = other RNA
ggggcgctgcctacggaggtggcagccatctccttctcggcatcaagcttaccatggcaccgaaaaagaaaagaaaagttggaatccatggtgttccagcagcatggtatgcatctttaatgtctgcacaccatctaagagttggaattgatgtaggaactcatagtgttggcttggcaacgctaagagtagatgatcacggaaccccaatagaactactatccgcgctatcccatattcatgattcaggagtgggaaaagagggcaagaaagatcatgatacacgaaagaaactgtcaggaattgcaagacgagcaagaagattactacatcacaggagaacccaactacagcaattagatgaagtactccgagatttaggatttccaattccaacaccaggagaatttctcgacctaaatgaacaaaccgacccatatagagtatggagagtaagagcacgtttagtagaagaaaagttgccagaagaactacgagggcccgcaatcagtatggctgttaggcatatagcacggcatcgcggatggcgtaacccatacagtaaggtagaatcattgttaagccccgcagaagaaagcccattcatgaaagcgctaagagaacgaattttagcaacaactggggaagtattagatgatgggattactcctggacaagcaatggctcaagttgccttaacgcataatatatcaatgaggggaccagaaggaatattgggcaaactacatcaatctgacaacgctaacgaaattagaaaaatatgcgcaagacaaggagtcagtccagatgtttgtaaacaactattaagagcagtgtttaaggcagacagtccaagagggtcagcggtaagcagggtagctcctgacccactaccgggacagggatcatttaggagagcaccaaaatgcgaccctgaatttcaaagatttagaataatatcaattgtggctaatctcagaatatcagaaacaaaaggagaaaatagaccactaacagcagacgaaagaagacacgttgtaacatttcttactgaagatagtcaagcagatctaacatgggtcgatgtcgcagaaaaactaggagtacataggagggatctaagaggaacagcagtacacacagatgatggtgagagatcagccgcaagaccaccaatagacgctactgatcgaataatgagacaaacgaaaatttcatcgttaaaaacatggtgggaagaggcggattccgaacaaagaggtgcaatgatcagatacttatatgaagacccgacggactcagaatgtgctgagataattgcggaactaccagaagaagaccaagcaaaactagacagtctacatttacctgcaggcagagcagcctacagtagagaaagtctaacagcattaagtgatcatatgttagcaacaacagacgatcttcatgaggctagaaaaaggttatttggagttgatgattcatgggctcctcctgcagaagctattaatgctcccgtaggaaacccgtctgtggacaggacactaaaaatagtagggagatatctctcagcagttgaatctatgtgggggactccagaagtaattcatgttgaacatgttagagatggctttacaagtgagcggatggctgatgaaagagataaagcaaatcgaagaagatataacgacaatcaggaagcaatgaagaaaatccaaagagactatggcaaagaaggatatataagcagaggagatattgtaagattagatgctctagaattacagggctgcgcatgtctttattgtgggacaacgattggctatcatacatgccagctagatcacatagtaccacaagcaggccctggatctaataatcgtagaggtaatttagtagccgtgtgtgaaagatgtaatcgtagcaaatcaaatacgcctttcgcagtttgggctcaaaaatgtggaatcccacacgtaggagtaaaagaagcaataggaagagtacggggttggagaaaacaaacaccaaatacttcatccgaagatttaaccaggctaaagaaagaagttatagcaagacttcgaaggacacaagaagatccagaaattgatgaaagatcgatggagagtgtagcctggatggccaacgaactacaccataggatagcggctgcatacccagaaactacagtaatggtttaccgggggagcattacagccgctgctcgaaaagcagcaggtattgatagcaggattaaccttataggtgaaaaaggaaggaaagacagaatagatagaaggcatcatgcagtagatgcaagtgtagtggctctaatggaagcatcagtagcgaaaacactagcagaaaggtcatcattaagaggagaacaaagactgactggaaaagagcaaacatggaaacaatacacaggaagtacagtaggcgcacgagaacatttcgaaatgtggcgaggccacatgttgcatttaacagaattattcaatgaaaggttagcagaagataaagtatacgtaacacaaaacataagattaagactaagtgatggaaacgcccacactgttaatccatcaaaattagttagccatagactaggtgatggattgacagtacaacaaatcgaccgagcttgtacgccagctctatggtgcgcattgactagagagaaagacttcgatgagaaaaatggattacctgcacgagaagatagggccataagggtacacggacatgaaataaaaagttcggattacatacaagtattttcaaaacggaaaaagacagattcggaccgagatgaaacaccatttggagcgattgcggtaagaggtggatttgttgagataggaccaagtattcatcatgcgcgaatatatagggtagaaggaaagaaaccagtctacgcaatgcttagagttttcacacatgatctactgtcacaaagacatggagacctattcagtgcagtaataccacctcagagtataagtatgagatgtgcagaacccaaattaagaaaagcaattacaacaggtaacgcaacgtaccttggctgggtggtagttggagatgaattagaaataaacgtagattcatttaccaaatacgccataggaaggtttctagaagatttccccaatacaacgagatggcgaatatgtggctacgatacaaactccaaacttacactaaaaccaattgtattagcagcagaaggcttagaaaatccttcaagtgcggtaaacgaaatcgtagaattaaaaggatggagggtagctatcaacgtactaacaaaagtccaccctacagttgtgcgtagggatgcattaggcagacctagatactcaagtcgcagcaatcttcctacttcatggactattgagaaaagaccagcagctactaagaaagccggacaagcaaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5911 - RNA, 4642 nt, synthetic construct
  misc_feature 1..4642: note = Cas9 variant mRNA product
  source 1..4642: mol_type = other RNA
ggggcgctgcctacggaggtggcagccatctccttctcggcatcaagcttaccatggccccaaaaaaaaaaagaaaggtaggtattcacggcgtaccggctgctacaaaaccatactcaataggcttagacataggtacgaacagtgtaggctgggcagtaacaacagacaattacaaagtacccagcaagaaaatgaaagtcctaggcaacacaagtaaaaaatacatcaagaaaaacctactcggagtattattattcgacagcggcatcaccgcagaaggacgtagactaaaaaggacagctagaagaagatacacaaggcgacgaaaccgtatattatatcttcaagaaatattttcaacagaaatggcaacattagatgatgcgttttttcaaagactagatgacagctttctagtcccagacgataaacgtgactccaaatacccaattttcggaaacctagtagaggaaaaggcatatcatgacgaattcccaactatataccatttacgcaaatacctagctgattcaacaaaaaaagccgacttacgattagtttacttagcattagcccatatgattaaatatagaggacattttctaattgaaggagaatttaactcaaaaaataatgacatacagaaaaacttccaagactttctcgacacatacaacgcaatatttgagtccgatttaagcctggaaaactcaaaacaattagaagaaatcgtaaaagacaaaatatctaaacttgaaaaaaaagaccgaatactaaaactatttcctggagaaaaaaattcaggaattttctctgaattcttaaaattaatagtaggaaatcaagctgatttcagaaagtgcttcaacctagacgagaaagcaagcttacacttttcaaaagaaagttatgacgaagatctggaaacattactaggatacattggtgatgattacagtgacgtattcctaaaagcgaaaaaattatatgacgctatactactgagcgggttcttaacagttacagacaacgagacagaagcaccactgagtagtgcaatgataaaaagatataacgaacacaaagaagacctagcactgttaaaagaatacataagaaatatttcattaaagacttataacgaagtgttcaaagacgatacaaaaaatggatacgcgggatacatagacggcaaaaccaaccaagaagatttttatgtctatttaaaaaagttattagcagaatttgagggagcagactacttcctagaaaaaatcgatcgggaagactttttaagaaaacaaagaacattcgacaatggctcaatcccgtatcaaatccacctccaagaaatgagagcgatattagataaacaagcaaaattttatccatttctagcgaagaacaaagaacgaatcgaaaaaatattaacatttcgcataccatactatgttggtccactagctaggggtaactcagattttgcatggagcataagaaaacgaaatgaaaaaataacaccttggaacttcgaagatgtaatagacaaagaaagtagcgcagaagcatttattaatcgaatgactagctttgatctatatttgccagaagaaaaggtgttgccaaaacatagcttactttacgaaacttttaacgtatacaacgaactaaccaaagtaagattcatagccgaaagcatgcgtgattaccaattcctggactcgaaacagaaaaaggatatagtaagactctactttaaagacaaacgtaaagttactgataaagatataatagagtatctacatgcaatatatggatatgacgggattgaactaaaaggcatagaaaaacaatttaacagttcactgtctacataccatgatctattaaacatcataaacgataaagaattcctggatgatagctccaacgaagccataatagaagaaataatccacactcttacaatctttgaggatagagaaatgataaaacaacgtctatcgaaatttgaaaatatattcgacaaaagcgtactaaaaaaattatctagacgacactatacgggctggggaaagctatcagccaaactaataaatggcataagggacgaaaaaagtggaaatacgatacttgactacttaatcgacgatggaatcagcaacagaaactttatgcaattaattcatgatgatgccctaagctttaagaaaaaaatacagaaagcacaaatcatcggtgatgaagataaaggcaatataaaggaagtagtaaaatcattaccaggaagcccggcaataaaaaaaggaattctacaaagtataaaaatagtagatgaattagttaaagtaatgggaggaagaaaaccagaatcaatcgtagttgaaatggccagagaaaatcaatacacaaaccagggaaaatccaattcccaacaaagactaaaacgactcgaaaaatccctaaaagaacttggctcaaaaatactcaaagaaaacatacccgctaaactatcaaaaatcgacaataacgcattacagaacgacagattatatctatactacttgcagaacggcaaagatatgtacactggtgacgacctagacatcgaccgtctatctaattacgacatagatcacattattccccaagcattcctaaaagataattctatcgataataaagtactagtatccagtgccagtaaccgtggtaaatcagatgatgttccaagcttagaagtagtaaagaaaaggaaaaccttctggtatcaactattaaaatcaaaactaataagccaaagaaagtttgacaatctaactaaagcagaaaggggaggattatcccctgaagacaaagcgggatttatacaacgtcaattagtagaaacaagacaaataactaaacacgtcgcacgcttgctagatgaaaaatttaataataaaaaagatgaaaacaacagagccgtacgtacagtgaaaataataaccctaaaaagcacactagtgagtcaattccgaaaagattttgagctatacaaagtgagagaaatcaatgactttcaccatgcgcatgatgcttatttaaacgctgttgtagcttccgcgttgttaaaaaagtatccaaaactagaacccgaattcgtgtacggagactatcccaaatacaactcgtttcgagaaagaaaatcagcgacggaaaaagtttatttctacagtaatatcatgaatatatttaaaaaaagtatatcattagcagacggaagagttattgaaagacccctaatagaagtcaacgaagaaacaggagaatctgtttggaacaaagaatccgacttggctacggttagacgagtcctgtcttacccccaggtaaacgtagtaaagaaagtagaggaacaaaaccatggattagaccgtggcaaaccaaagggcctgtttaacgcaaatttaagctctaaaccaaaaccaaacagcaacgaaaacctagtgggagccaaggaatatctagatcctaaaaaatacggaggttatgctggaatttctaattcctttacagtactcgtcaaaggaaccatcgaaaaaggagcaaaaaaaaaaataacgaacgtcctagaattccaaggaatatctatattagatcgaataaattatagaaaagacaaactcaacttccttctagaaaaagggtataaagatatagaactaataattgaattaccaaaatactccttatttgagcttagtgatggctcaagaagaatgttagcaagcattctctcaacaaacaataaaagaggagagattcataaaggaaaccaaatatttctcagtcaaaaatttgtcaaattactatatcatgcaaaacgaatctccaacacaatcaacgaaaatcatcgaaaatatgtggagaaccacaaaaaagagttcgaagaattattttactacattctagagttcaatgaaaactacgtaggggcaaaaaaaaacggcaaactactgaattcagcgtttcagagctggcagaaccattcaatcgatgaactatgtagttcctttataggacccacaggatcagaacgtaagggcctgtttgagctgacctcaagaggatcagctgccgacttcgaatttctaggagttaagataccaagatacagagattacacgccgagctcacttcttaaagatgcaactctgattcaccaatctgtaacaggtctatatgagactcgaatagacctagccaaattgggcgaagggaaacgacctgcagccacaaaaaaagctggacaagcaaaaaagaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5912 - RNA, 3724 nt, synthetic construct
  misc_feature 1..3724: note = Cas9 variant mRNA product
  source 1..3724: mol_type = other RNA
ggggcgctgcctacggaggtggcagccatctccttctcggcatcaagcttaccatggcaccaaagaagaaacgaaaagtaggcatacacggtgtacccgcggcagcagcattcaaacctaattccatcaactacatactgggattagatatcggcatagcatccgtaggctgggcaatggtagagattgatgaggaagaaaacccgattagattaatagacttgggagtaagagtttttgaaagagcagaggtgccaaaaacaggagattcattagcaatggcacggaggttagcacgttcagtcagaagattaacaagaagacgtgcacatagactactaagaactagaaggttattaaaacgtgaaggggtattacaagcagcaaacttcgacgagaatggacttattaaatcattacctaatactccatggcaactacgagcagcggccttagacagaaaattgacgcccttagaatggagcgcagtactgttacatttaataaaacatcgcggatatctatctcagcgtaaaaacgaaggagagactgccgataaagaactcggtgcactactaaaaggagtagcaggaaacgcacatgcactacaaacgggagattttagaacaccggcagaactggcattaaataaatttgaaaaagaaagtggtcatataagaaatcaaaggtcagattatagtcatacatttagtcgaaaagacctccaagcagaactaatattattatttgaaaaacaaaaagagtttgggaacccccatgtatccggagggctgaaagaaggtatcgaaacactacttatgacgcaacggcccgcattatccggtgatgcagtacagaaaatgttagggcattgcacattcgagcctgccgagccaaaagcagctaaaaatacatacactgcagaaaggtttatctggttaacaaaattaaacaatcttaggattctcgaacaaggatcagaaagacctttaacagacacagaaagagcaacgctaatggatgaaccttatagaaaatcaaaattaacttatgcacaagcacgaaaattattgggcttagaagacacagcgtttttcaaaggattaagatatggcaaagataatgcagaagcgagcacactaatggaaatgaaagcataccacgctataagccgagcattagagaaagaggggttgaaagataagaaatctccattaaacctttctccagaactccaagacgaaatagggacagccttttccctttttaaaaccgatgaagatataacaggaagattaaaagatagaatacaacccgaaatacttgaagcattactaaaacacatatcatttgataaatttgtacaaattagtctaaaggctttaagacgaatagtaccactgatggaacaaggaaaaagatatgatgaagcatgtgcagaaatatacggagaccattacggaaagaaaaatacggaagagaaaatatacttaccaccaataccggcagatgaaattagaaacccagtagttctcagggcattaagtcaagcaagaaaagtaataaatggagtagtgagacgttacggatctcctgcgcgcatccatatagagacagcaagagaagtaggaaaatcattcaaagatagaaaagagattgagaaaagacaagaagaaaatcgaaaagatcgagaaaaagcggcagctaaattccgggaatatttcccgaattttgtaggagaacccaaatcaaaagacatactaaaattgagattatatgaacaacaacatgggaaatgtttgtattcaggaaaagaaatcaatctcggtagacttaatgaaaaaggctacgtagaaatagaccacgcactaccctttagccggacatgggacgacagctttaacaacaaagtattagtattaggaagtgaaaatcaaaataaaggaaaccaaactccttatgaatatttcaatggaaaagataactctagagaatggcaagaatttaaagctcgagtcgaaacatctagattccccagaagtaagaaacaaagaatattactccaaaaattcgacgaagatggatttaaagaaagaaacctaaatgatacaagatacgttaatagatttctatgccaatttgtcgccgacagaatgagactaacaggaaaaggaaagaaaagggtatttgcaagcaatggccaaataaccaacctgttaagaggtttttggggactaagaaaagtaagagctgaaaacgatagacatcacgcattagatgctgtcgtagtggcctgtagcacggttgcaatgcaacagaaaattactagattcgtaagatacaaagaaatgaacgctttcgatgggaaaacaattgataaagaaacaggtgaagtattacatcagaaaacacattttccacaaccttgggagttctttgcccaagaagtaatgatcagagtgtttggtaaaccagatggtaaacctgaatttgaagaagcggatacattagaaaaattaagaactcttctagcagaaaaattgtcttcaaggccagaagccgtacatgagtatgtaactccactatttgtaagccgcgcacctaaccgaaaaatgtctggacaaggacatatggaaaccgtgaaatcagccaaacggttagacgaaggtgtctcagtattgagggttccactaacacaattaaaactaaaagatctggagaaaatggtcaatagagaaagggaaccaaaattatacgaagcacttaaagcacgtttagaagcgcataaagatgatccagcaaaagcatttgcagaacccttctacaaatatgacaaagccggaaataggactcagcaagttaaagcagtaagagtagaacaagttcagaaaacgggagtatgggtacgaaaccataatggaatagcggataatgctacaatggttcgtgtagacgtattcgaaaaaggagataaatattatctagtcccgatatattcctggcaagtagcaaagggtatattaccagatagagcagtagtacaaggaaaagatgaagaagactggcaattaatagacgatagctttaactttaaattttcccttcatcctaacgacttggtagaagtaataacgaagaaagcgagaatgtttggctattttgcatcatgccatcgcggaacagggaatattaatattagaatacacgatctagaccacaaaataggtaaaaacggtattttagaaggaattggtgtaaaaacagctcttagtttccaaaaataccaaattgacgagttagggaaagaaatacgaccctgtaggctcaagaaaaggccaccagtaagaaaaagaccagcagccaccaagaaagctggtcaagcgaaaaagaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5913 - RNA, 4480 nt, synthetic construct
  misc_feature 1..4480: note = Cas9 variant mRNA product
  source 1..4480: mol_type = other RNA
ggggcgctgcctacggaggtggcagccatctccttctcggcatcaagcttaccatggccccaaaaaaaaaaagaaaagtaggaatacatggtgttccagcagctaaaaaaccttacaccatcggactagacattggaacaaattcggtagggtgggctgtacttacagaccaatacgacctcgtaaaaaggaaaatgaaaatagcgggagactctgaaaaaaaacagataaaaaaaaatttctggggggttagactattcgatgaaggacaaaccgcggcagacagacgaatggccagaacagctaggcgaagaattgaaaggcgacgcaacagaatatcctatttacaaggaatatttgccgaggaaatgtcaaagacagatgccaattttttctgccgattgtcagactccttctatgtcgataacgaaaaaagaaatagtcgtcaccccttctttgccacgatagaagaggaggtcgaataccacaaaaactacccaactatataccatttaagagaagagctagtaaactcatctgaaaaagctgacctacggctagtttacctcgcattagcgcatatcatcaaataccgtggtaattttttaatagaaggagctttagacacacaaaacacaagtgtagatggtatatacaaacaattcatacaaacttataaccaagtgttcgcctcaggaatagaagatggctcactaaagaaactagaagacaataaggacgtagctaaaatattagtcgaaaaagtgacacgcaaagaaaaattagaacgaattctaaaattatatccaggagaaaagtcagcaggaatgtttgcccaattcatttcacttatagtgggatcaaaaggtaacttccaaaaaccattcgacctaattgaaaaaagcgatatagaatgtgcaaaagatagctacgaggaagatctcgaatccttactagcacttataggagatgaatacgccgaattattcgtagcagccaaaaacgcttactcggccgtcgtactgtcatcgatcatcaccgtagcagaaacagaaacaaacgcaaaactttcagcatcaatgatagaacgttttgacacacatgaggaagatttaggcgaattaaaagcatttataaaacttcacctgccaaaacactacgaagaaatcttcagtaacaccgaaaaacatggttacgcaggatatattgacgggaaaaccaaacaagcagacttttataaatacatgaaaatgacacttgaaaatatagaaggtgccgactattttatcgcgaagatagaaaaagagaacttcttaagaaaacaaaggacttttgacaacggtgccatacctcatcaattacatctagaagaactggaagccatattacaccagcaagccaaatactacccttttttaaaagaaaattacgataagataaaatccctagtaacatttcgtataccatatttcgtaggaccattggcgaacggccaatcagaattcgcatggttaacaagaaaagcagatggtgagataagaccatggaatattgaagaaaaagttgacttcggtaaatcagctgtggatttcatagaaaaaatgacaaacaaagacacataccttccaaaagaaaacgtacttccaaaacactcattatgttaccaaaaataccttgtctataacgaattaacaaaagtaagatatataaacgatcaaggcaaaacatcatactttagtggtcaagaaaaagaacaaatattcaatgacctatttaaacaaaaaagaaaagttaaaaaaaaagacctcgaattatttctacgtaatatgtcacatgtggaatcacctacaatcgaaggacttgaagactcctttaactctagttacagtacatatcatgacctcctgaaagttggcataaaacaagaaatattagataatcctgttaatacagaaatgttggagaacatagtaaaaatcttaacagttttcgaagacaaacgaatgattaaggaacaattacaacaattctccgacgtacttgacggggtagtactaaagaaattagaacgaagacattacacaggatggggacgcttaagcgcaaagctcttgatgggaatccgagacaaacaaagccacttaaccatcttagactatttaatgaatgacgacggattaaatagaaatctaatgcaacttatcaacgactccaatctatcctttaaatctatcatcgaaaaagaacaagtaacaactgctgacaaggacatacaaagtatagtagcagatctagcaggaagcccagcaattaaaaaaggaatattacaaagtctcaaaatagttgacgaattagtctctgtaatgggatacccgccacaaacgatagttgtagaaatggcaagggaaaatcaaaccacaggaaaagggaagaataattcaagacctagatataaatcactagagaaagcaataaaagagtttggatcacaaattttaaaggaacaccctactgataaccaagaacttagaaacaatagattatatctctactacctccaaaatggaaaagacatgtataccggtcaagatctggacatacataatctctccaattacgacatagaccacatagtgccacagagttttataacggacaattccattgataacctagtactaacaagtagtgcaggtaatagggagaaaggcgacgacgtaccacccttagagatcgtcagaaaacgcaaagttttctgggagaaactatatcagggaaatctaatgtccaagcgcaaattcgattacctaacaaaagcagagcgagggggcttaacggaagcagataaagcccggttcatacatagacaattagtagaaacaagacagataacaaagaatgtcgccaacattttacaccaaagattcaattacgaaaaagacgatcacggaaacacaatgaaacaggtaagaatagtgacattaaaatctgccttagtctcacagtttcggaagcaatttcagctatacaaagttcgagacgtaaatgactatcatcacgcacatgatgcttacctaaacggcgtagtggcaaacacattactaaaagtatatcctcaactagaaccagaattcgtatatggcgattatcaccagttcgattggtttaaagcaaataaagcaaccgcaaaaaaacaattttacacaaatattatgttattctttgcccagaaagaccgaattatagacgaaaacggagaaatattatgggacaaaaaatacctagacaccgtaaaaaaagtaatgtcatacagacagatgaacatagtaaaaaaaacagaaatccagaaaggtgaattctccaaagctacaatcaaaccaaaagggaattctagcaagctaatcccaagaaaaacgaactgggatcccatgaaatatggtggactagattcacctaacatggcatacgcagtcgtaattgaatatgccaaaggtaaaaacaaactcgtgttcgaaaaaaaaataattagagtcacgattatggaaagaaaagcctttgaaaaagacgaaaaagctttcttagaagagcaaggatatcgtcaacctaaagtattagccaaattacctaaatacacattatatgaatgcgaagaaggacgaagacgaatgctagcatcggcaaacgaggcacaaaaaggaaaccaacaagtcctccccaaccacttagtaacacttttacaccacgcagcaaattgcgaagtatcagatggaaaatcattggattacatagaatcaaacagagaaatgtttgctgaattactagcacatgtatcagaatttgcaaaaaggtacactttagccgaagcgaacctcaacaaaataaaccaactattcgaacaaaacaaagaaggagatataaaagcaatagcgcaaagttttgtagacttaatggctttcaacgcgatgggagcaccagcaagcttcaagttctttgaaactaccattgaaagaaaacgctataataatctgaaggaactattaaactccactataatttatcaatcaatcactggcttatacgaaagcagaaaacgattagacgacaaaagacctgcagcaaccaaaaaagcaggacaagcaaagaaaaagaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt

SEQ ID NO: 5914 - RNA, 4513 nt, synthetic construct
  misc_feature 1..4513: note = Cas9 variant mRNA product
  source 1..4513: mol_type = other RNA
ggggcgctgcctacggaggtggcagccatctccttctcggcatcaagcttaccatggcgccaaaaaaaaaaagaaaagtaggaatccatggtgtccccgcagcaaaaaaaccatattccatcggactcgatataggcactaatagcgtaggttgggcagttgtcacagatgactataaagtaccagcaaaaaaaatgaaagtactaggaaatactgacaaatcacacatagaaaaaaacctactcggtgcattactctttgacagtggaaataccgcggaggatagaaggctcaaaagaacagccagacgacgttacacaagaagacgaaatcgaatactctacctacaagaaatattctcagaagaaatgggaaaagttgacgattcattttttcatcggttagaagattccttcctagttacagaagacaaaagaggggaaagacaccccattttcggcaatctagaggaagaagtaaagtatcacgaaaacttcccaacaatttatcaccttagacaatatctagctgataaccctgaaaaagtagatctcagattggtatatttagccttagcacatattattaagtttagaggccactttctaattgaaggcaagtttgatacacgcaacaacgacgtccaacggttgtttcaagaatttttagcagtctacgataacacattcgaaaattcatcactacaagaacaaaacgttcaagtcgaagaaatactaacagataaaatctctaaatcagctaaaaaagacagagtcctcaaactattccctaatgaaaaatcaaatggaagattcgcagaatttttgaaattgatcgtgggaaatcaagcagacttcaaaaaacatttcgaattagaggaaaaagcaccactacagtttagcaaagatacatatgaagaagagttagaagtcttactagctcagataggagacaattacgcagaattattcttaagcgcaaaaaaactatacgattccatattgcttagtggaatcctaactgtaacagacgttggaaccaaagcaccattatcagcaagcatgatacaaagatacaacgaacatcaaatggacctagcacaacttaaacaattcattcgacaaaaactatctgacaaatataacgaagtcttctccgacgtcagcaaggacggctatgcaggctatatagacggaaaaacaaatcaggaagcattctacaaatatctaaaaggtctactgaacaaaattgaaggaagcggatacttccttgataaaatagaaagggaagacttcctaaggaaacaacgaacattcgataatggatcaatcccacatcaaatacatctacaagaaatgcgcgctatcatcagacggcaagctgaattctaccctttcctcgccgataaccaagaccgaatagaaaaacttctaaccttcagaatcccctattacgtaggaccactagctcgcggcaaatccgattttgcttggttatcacgaaagtccgcagataagattacaccatggaactttgacgaaatagttgacaaagaatcttcggcagaagcgttcattaaccgaatgacaaattatgatttatatctacccaatcaaaaggtacttccaaaacactcactactatacgaaaaatttactgtctacaacgagttaacgaaggtaaagtataaaaccgaacaaggaaaaactgctttttttgacgcaaatatgaaacaagaaatattcgatggtgtattcaaggtatatagaaaagttaccaaagacaagttaatggatttcctcgaaaaagaatttgacgaattcagaattgtcgatttaacaggactagacaaggaaaacaaagtctttaacgcctcatatggaacttatcacgacctttgtaaaatcctcgacaaagacttcttagataactcaaaaaacgaaaaaatattagaagatatagtacttaccttgaccttgttcgaagatagagaaatgataagaaaaagactagaaaactattcagatctcctaaccaaagaacaagtaaaaaaactagaaagacgtcattacaccggttggggcagactatcagcagaattgatccatggcatacgcaacaaagaatcccgaaaaacaatactagattatctaattgatgatggtaattcaaaccgaaatttcatgcaactaataaacgatgacgcactctcattcaaagaagaaatagcaaaagcacaagtaataggtgaaaccgacaacctaaaccaagtagtatcagacatagcaggaagtccagctataaaaaaaggtattctacagtccctcaagatagtcgacgaactagtaaaaataatgggacatcaaccagaaaacatcgtagtagaaatggctagagaaaaccaatttacaaatcaaggtcgacgcaattcacaacaaaggctaaaaggattaacagatagtatcaaagaattcggatcacaaatattaaaagaacacccagttgaaaatagtcaactacaaaatgaccgtctattcctgtactatttacagaacggacgcgacatgtatacaggcgaagaactagatatagactacttatcgcaatatgatatcgatcatattatcccccaagcatttataaaagacaattcaattgacaatcgtgttctcacgtcatcaaaagaaaacagagggaagagtgatgatgtacctagtaaagatgttgtacgtaaaatgaaatcttactggtccaaattattatctgcaaaattaatcacgcaacgaaaattcgataacctaacaaaagctgaaagaggcggactgaccgatgacgacaaagccggctttataaaaagacaattagtagaaaccaggcaaataacgaaacatgtcgcacgtattctagacgagaggtttaacaccgaaactgatgaaaacaacaaaaagataagacaagttaaaatagttaccttaaaaagtaacttagtatccaacttccgtaaagaatttgaattatataaagtcagagaaatcaacgactaccaccatgctcatgatgcctaccttaacgcagtcattggtaaagccctactcggagtgtatccccaattagagccagaattcgtatacggtgactacccacacttccacggtcataaggaaaacaaagcaacagcaaaaaaattcttctatagtaatatcatgaacttttttaaaaaagatgacgtacgaacagacaaaaatggggaaatcatatggaaaaaagatgaacacatttcaaatattaagaaagtactatcctatccccaagtgaacattgtcaaaaaagtagaagaacaaacaggtggattttcaaaagaaagcatcttaccgaaaggtaactccgacaagcttataccccggaagaccaagaaattttactgggacacaaaaaaatacggagggtttgattcccccatagttgcatattcaatattagtaatcgccgacatagaaaagggaaaaagcaaaaagctaaaaaccgtaaaagcattagtaggagtgaccattatggaaaaaatgaccttcgaacgtgatccagtcgcattcttagagcgaaaaggatatagaaacgttcaagaagaaaatataataaaattgccaaaatacagtctatttaaattagaaaacggacgaaaaagactattagcatcggcacgggaactccaaaaaggtaacgaaatagtacttcctaatcacttagggacactcttatatcatgcaaaaaacatacataaagtagatgaaccaaaacatctcgactatgttgataaacataaagatgaattcaaagaattattagacgtagtgagcaacttcagcaaaaaatatactctagccgagggaaacctcgaaaaaataaaagagttatacgcccagaacaacggagaagatctaaaagaactggcaagtagcttcatcaacctattaactttcacagcaataggagcaccagccactttcaaattcttcgataagaacatagacagaaaaagatacacttcgaccacagaaatattaaatgccacattaatacaccaaagtataacaggactatacgaaacaagaatcgatttaaacaaattaggtggtgataaaagaccggctgcaacgaaaaaagcaggccaagccaaaaaaaaaaaaggactagtgcatcacatttaaaagcatctcagcctaccatgagaataagagaaagaaaatgaagatcaatagcttattcatctctttttctttttcgttggtgtaaagccaacaccctgtctaaaaaacataaatttctttaatcattttgcctcttttctctgtgcttcaattaataaaaaatggaaagaacctagatctaaaaaaaaaaaaaaaaaaaaaaaaaaaaaaaaaaaaaaaaaaaaaaaaaaaaaaaaaaaaaaaatgcatcccccccccccccccccccccccccccccccaaaggctcttttcagagccaccagaatt
